United States Patent 9,328,346 (POLYCOMB-ASSOCIATED NON-CODING RNAS) - sequence listing, part 130

SEQ ID NO: 191603 - RNA, 2304636 nt, Homo sapiens
uuaggauaauuaaaacuacuuugaauuuuuuauuuaucaaucugguuucuaauauaauuuuaguuaaaugaaagacauucacaaagaauauuaggcauacguacauaauuuccuucuuucauucuaguuuacaugcuguugcuuuuagagagugaaauuuuguguuauuucacaggggauggaauccuguuugacuuuacagaaagaauauuuagcccagcuuuucacagcacuaaccucugcagucaccacgcucacugaaaaaauuuaaaaaaccugacaaaauaaaacuuaguaaaaucuagaacuguuucuuggccuacuugagaggaacuuccauauuuucacagccaucuccgaaagcagcaguugcuguaaauuaacugagacuuggaaauggugcagacugucuugguagagcuguucuuauagcacaauuuuaucuggaaaauaaacuuguaaaugcgugcuguauauuaauacaugugugcccauauuuauuuuuauuaucuccugccagucuuugcucaaugggagaugacagaccaacuucucaacgugauuuccccauuucauugaaugacauuuauaugccacuuaugaaaaaaaauacugcugugaaagaaauguacuuuaaaguuugcagcacuaccaugcaggguacauggagaauaggcauauagccacuaggcuacaugaacacgucacguuuguauuuuguguuggccuauguauaagccaaucuagcauguuugagggcaugugugagaguagguaagggagcuguaaguuacauucaggugggaauuuagggcuuucugcacaaaaaauucuaauuucucuguccuuuugcuauguugcaucucccaguguugacagguuagucugcaugauuaauaacugagcagcuguagagccaugccaguaagucuccaauuccugaacguggccacauuugucuuuugaugugacuuucaaccacaagccacaaaguaagucuuucacuaggcuccguugacuucagucuuuauauaaggguuucaagguauuuugcagucaagaaucaauggcaccucgcaacugucuuaugaaguagguaaaacagcuccaucuuaaauacgggacaaaaguucgaggacuugaccaaggucacacagggagggucccaccaaggcagggagagagaaaggggaugcugucagcuaauucucaugguccacucuuaaccaaaacaucauuuaaaaaauggggcuggcucggcacgguggcucacaccuguaaucccagcaauuugcaaggccgagguggacggaucacuugaggucaggaguucgagaccacccuggccaacauggugaaaccuggcuucuacuaauaauacaaaaaaaaaaaaaaauuagcugggugugauggcgggugccuguaaucccagcuacuugggaggcugaggcaggagaaucgccucaaugugggaggaggaggagguugcagugagcccgagauugcgccagugcacuccagccugggggacagagcaagacuccgucucaaaacaaaacaaaaaacaacaaaaaaaagcggggcggggguaggagccauugguucuuagcugaagucagcuggggacauuguuacuguuuguuucgcacugguuuaggaucaggugguucuacugggacuagcaauuuaggaccuaucuuuggcuggcuuacuugaauucaauuuaauaauugcugcccuuuuuuugggaaaauugcucaacaggguggugaaaagaaaaaaugggggguuucaaauucaguguuguuuggaggcaugagacauaaacgggccauuaaaacguuuacugcguaagagcaggguauaauguggugaggagaggaagagagaaaaaaguaggauagaaaagaacagauuccaucauagaaggaaagaaaagcuucuugacacaaccugaacacuugcauguucaagucccacagcugugugcuuguuccugaagugcuuccaauggcuucgccugugcccagcucucagccugcauaugguggccgcucagcagauuuucaaaaguaacauuaagacagacucuuuggcucaugccaaugcuuuuucuugugccucugaauuccugcucuuguuaguaaaggaugcuuguuugucaaaugcagggcaguaggacauuuucuaggaauggcucucuaaauucuuguuuucagcucuuuaaugaaaacuuucauguaacaagucucuuuuuuugagcaggugguugaaagccacaaggggaaauacauuuuuaaauauuaagaagggccagaaaauaauuuaacaacaaaauagcuuuuucaaccuccuggaccagcuuucuugagcucuagggaauaugcuauuuugagagcuuaggaucucacuaaccuugcauucauucaaagucaucuccuagcuuuuuucaaaacaucgacauuugcuucauacacagaagauguuuccugcacaacuuuaaaucagccaccaacuuucccugaaacuuuaaaacagucuauuuuuugucguuguuguugucuauacauauuauuuaaagaggcuacuaccagcauacuugugcuugcuugauaauguauuggaauguaagaugucaagauuuugugagaugugaaugacaaagcaggauuaggcacugagagcuugggcgggaaugucaugguuauggaggcugcacugugcuaggcuauccaaggagagaguuggaagaaagacuuaauucuuuuucuucacauaaacagauuauuuaccauuuaaaauguacugaauauggccuucauaaacagauguagggauuuuuguuacacccauaaucccaaggagaggucaagauuuccagcauuuauuuggcacuuaguuacuuaauacuuuauccaccguuugguuuccugucugauggccacauuguaacccucuugaaggaagacaguguccuauaugucuuaauugauggugauaugggagaaccacugaucccugcagucauuccaguguccuagguuugaaauuuuggugagaggauuggaucucauuuuucaccuuuuguggcaggaaaaggagagggaggagaaaggaugagaacauuuuaguagcagaagcuguuuuggguggcuuuaauucucuacucauuuugggaaaaaagggaaaguguugagacaaugcauaaagaacagagcuaucaugggaauugcaagaaauaauaaauuuccaucuggcauuauuugguaagugcagaaguaauaccuguaaaccagguuuaaaaaucagaaacacuucuaaaacaucauguuuaaaauuugcuuucaacaauacauaaaguaacuccuaaugguaaucaucuuggcuaaauaaaacagccuuugcuuucaauaugucauuuguaaauguuacauuguucugauauuuagugauauuaaguauuuuuccauuuuaaauguauuuuauagaagaaugauuaaaaccuuuuaaaauuaaggguguccaugacagugccugagcucaaccagcaaugguaaaagggcaucaggauucccuuuuguucuguuaccuugacuuguaugggaauuaacugguccaaugucuccuuuggaaugugcucuguacugguguaaugugccacuggcaacucuagguaauguuuuccauuacccaagaaacugaugugcuccaauaaguuaggcacacugagaaucuugaaaaagaaugcauaauucuaacaaacuagaauuuccauuuuauucagccgggccaucagaacaauagcaucuauaccuucgaaaccuccucuuaaccucucccaggcaaagaaggaaaaagugaucauauugaauuccucagaauggugggaucucaagacuuuuuagaaagugcuuauuaaguauaagaggcuugaaauauaaugaugauaaaugguagccuuucuggaaauaauuuuuguguaaucuguuuaaaaagauuuuuuggaugcauuguccccauuuguuuacaggaaguguauuacuuuuaaauauaaucaaugagguauuuauuuguuaaauaacugggucaagauuucagauuaaacuaagaggugugauuaacuacacuucuccauccucugggaagcaacagguaccagguuugugaugaaccugagguucaaauguguccgucuuagaagaaagaucccugaaucacagcagugugauuggauggaaaaacacguggaguaguugauuuaaaauauggcaguguuuuccauaucauccagaguaacagcaauaauaacuugacuuuauuguguuguguccauuuacaggacacugucuauuaggauugugucacagggguggaaaaacuaccagagauuuaaagcaaaauaagaaacgcaaccuaauuuaugcauucacuagaaauuauccauauuuuugcuauaacuaaacuauaaaagaaaaagagcaaacaaaucauaacaucuggcucuaauuccccauugaggcgcuuauacauauauaaauccaguauguuucagauaaaacaggaaaaaaucuuuuguaacagcuggucaccaugguauugcagcugauaguuacagcuauuggucuaagacuacauacguggaacaauauuagcuuguagaauucaaugaaaaaucaaacuaccuucccugguucuuuaaugccucucuccaguugugcugauugugucguuacacaccaggugccaugcacucucuuccuucaacugcugguaucagucaggaaccccagaugccagagagcuggcauagauugagcucugcuuaaaaacuggcaaauaauagguucucuuugccccuuucuuuuccgacuuauaggacaucaaaggaaauaguauauaaacacgaacuaguuucuguaacagcccauuaagguugacuagaagcaaaaggaagagaauguugggggccaucuguaggugcauuagcuuuucucaagaaaaaaaauacccacguucuaagggcucuuaaaaacguagaaaacuugcccuguuaccacgggucuuuagaacaccucuaaacacacacaaaauaagacagauaguaccuacaaauuucaaccauugcuuaaacucuaaaagcauuuuuuguauuauuuuguuuugauacagaagggaaaacucagcuauaaagaaauauuaaaaagguuuuuuuuuuugugaucagucucaagaauauuccauuauauuccauugccugccucccccaacuugugcugauauuuuaaggaugugcucaagaguaugaagcagggugcuuuugucccuuucucuccucccuaguaauucccuccucccuaucccauagccaaguagccaccccucaaaugagccauuccuuuuugcuuucaucaauggucucugugaaguuggggucguuguucaugauggcggcguccgcgcucucugccgacuccgcccccuuugcuucguugguaugguaggugcccuuguggcggaacauguaccggaucaggaagaccagggugcacaggauggugaaaaucaccacagcaaugacgccugacggagaaaggagaagcacgagagguuagacagggcuugggagucccuccaacacuguccccacuucacuacagcuccgucagacacagcccucucccauauaaaacacaaccuccaaaacaacaaagauaacaaaaaugaaguaagaugucuguuuuuguccaugaaggaguaacaggaaaaacaggaguaacuugucuuccagccaaaaguaacuaaaauacuggacacagucuaugaaaugacagucuacagacauuagaaaacaggcagaaaggaaccaugaugucugagaacagagaaacaaaaaggaggaauccuacauuuuuccuaguuuucuggcuggcagcgauuuuuggacagcaguguagggaggggcagcacaagaaagcacagugguuucccugaauggagaggggagauagagugggcgcgcgagagagcuauguauagaaagaacccuaauaaucugcacauaagucucucugaauuuguggccgaauaauacuaacaugugcauguacagaauaaaaguccacaggccaggcaaaaaaccagagcucacggagggcugggagauguuuauaguccaacaaccacacugaagagaccucauugaacaaucagagcauuuaauacaguugauagaauggucaugcugaagguguuugcuaaaauaggccuagaauaaagacuacucuagcucuguccugaaaaagcuuuaaaacacaucuaaauaacgucaagcugcagagaaaaauaauucagagaaaaaaaauguagcaaaaugucacuugaccagaagaaacaucagucaauuagaaggagagccagaaaggacagagcauggaaugagcagaugaggacaguacaauagcuauuagaaacagaaaggacagagcauggaaugagcagaugaggacaguacaauagcuauuagaaaccugcacagggguuuaaaggaaaacaugaucaaaaugaggggaaaaaaaaugagacaacguggaacuuguagaggugaaacacacaaugucugaaaugagcaguggcucgcgccuguaaucccagcacuuugggaggcugaggcgggcggauuacuugaggucaggaguuuaagaccagccugggcaacauggugaaacccggucuuuuauacuaaaaguacaaaaaucagccaggcaugguggcacgcuccugugaucccagcuagccaagaugcugaggcgugagaaucgcuugaaccugggaggcggaggcugcagugagccaagaucgugccacugcacuccagcuugugugaggggggggggggggacucugucuaaaaaaaaaaaauggaaaaagaaaaaaauacuggaugaaauaauacagauuagauaaaacagaaguaaauauaacugaucuaaacacuccaauuaaaaaguagagacaguggauaaaaaagaugccuacuauaugauaucuacaagacaugaacuuuaaauacaggucaacaguaaaagggugggaaaagauaugcaaacaauaaucauaagcuggaauagcuacguuaauaugagacaaaggacaagguuguuaguagaaaugaagaacauuucauaaugacaaaagggugaauucaucaggaagacauaauguuccuaauguguauaaaucuaaccuaaguacaaaauaaaugaagcaaaaacgggcagaacugguaggacaauuagaccaauuugcaauuauaguuggagauuuuuuaacacuguucugucaguaacugauagaacaauugaacagaaaaucagcaaaaauuuaaaagacucgaacaauacuacuaacaagcauuaccuaaugauauuagaccaauccuacacaucuuucuuaaaauauaggaggagaaaacacuacucaauucauuuuaugagaccagcauuauccugacacuaaaaccagaaaaauguuacaagaaaacuauggagcaauauauauauauauauauauauauauauauauauauauauauauauuuuuuuuuugagacggaguuucacucuuguugcccaggcuggagugcaauggcacgaucugggcuuacuguaaccucagccucccagguucaagcaauucuccugucucagccucccgaguagcugggcuuacaggcgcccaccaguacgcccagcugauuuuuauauuuuuaguagagacgggguuucacuguguuggcuaggcugguccugaacuccugaccucagguaauccaccugccucggccucccaaagugcugggauuauaggcgugagcugcuacgccuggccacaauauucuuuuaaauagaauuuuagcaaaucaaacccagcaauauguaaaaaagaucauguauuaugauaauguuaauccuaggaaugcaaguuugguuuaacauuaaaaaauaaagcaaugugauuuaccacauuaagcaaauaaggaguaaaacaauaugaucaucuaaauagauguggaaaaagcauuuggaaaacuuccaauacccauucaucaaacagcuuucaguaaacuaugaguagaagaaacuuucucaaucugauaaaggacaucuguuggaaaccuacggccaauauccuauuucauagugaaagaucaaacacauuccccuaacauagggaacaaugcaaaauugucaaaucucaauauuuauucacuuuuguacugaaaauccuacccggugcaaugaaacaacaaaaggauauagacuggaaagaaacaaguaaaaaaaucucauuauucucagauaaaaugcuugucuagguagacaauucugaggaauauacaaaaaaaguuauuagaacuaacagcaaauuuagcaaggucacagaaggcaaggcugauauaaaagaucaauuauacuuuuauaugccagagagagacacuuagaaaaugaaauuaaugaaauaguaagcuguucaagacuucgcauugaaaaccacaauacguugcugagagaaacugaugagacaaauaaacguauagauacaccauguaaagauagaaauacuaaauaucguuaagauguucuaaugaaccugucuuggccucucaaagugcugggauuacaggcgugcgccaccgcgccuggccaggauuagagaacuuacauuguuuauuucaagacuuaguauaaagauacaacaggccgggagcgauggcucacaccuguaauccuaccaguuuugcaggccgagguggguggaucacaaggucaggagauugagaccauccuggccaacauggugaaacccugucucuacuaaaauacaaaaauuagcuggacaugguggugcgugccuguaaucccagcuacucgggagguugaggcaggagaaucgcuugagccagggagucggagguugcaugagccgagaucgcgccacuguacuccagccuggcaacaaagcaagacucccaucucaacaaaaaaagauacaacaauaaagcaagcaugauauuggcuaaggaaagauauauauagaccaacaaaacaaaaagcccagaaaauagacacacacacacacacacacauaugucaguugcuuuaacaaaagugccaagaaaauucaauugaggaaaaguauaguuuuuuuuuuuucaacaaauggucuuggaaugacuagauauucauuuggaaaauacugacguugacucuucucucacaccauuuauaaacauuaacucgaagugauuaaagaccugauggcaaaugauaaagugauacaacuucuagaagaaagcugaaaaucuucaaaaccuuuggguaggcagacuuuuuagauaggacaaaccaaccacaaacuauaaaaaagauuggggccgggcacgguggcucacaccuauaaucccagcacuuugggaggcugaggcgaguggaucacuugaggucaggaguuggagaccagccuggccaacaugguacaauccugucucuacuaaaaauacaaaaauuagccaggcauggugaugcgugccuguaguuccagcuacucaggaggcugaagcaggagaaucgcuugaacccgggaggcagagauugcagugaacugagaucacgccacugcacuccagccugggcaacagaaagugagacucugucucaaaaaauaauaauaaauaaaaguuacggacuuguuacacuuauagaugcguauuauacuucaauuaaguucauuuaaaaaagcaaaagacagugaggauugggaucuuaaugguaacagggaugucaauaucgaucuacgcaugaggcucaguggcuauccgaggagagucaaauuauuauguagcuguccauggugagaagaaaacacuggaauauuuuagaugcuacagcuuguuaaaucuucugauacauuuuuaguuuuuauuauuuucauugugcaaauuuacgggguacaugagaaaauuuguuacacguauauaaggaauaguggucaagucauaguauuuagggguucaucaaccaaguacaguacauuuuuguuagauauagucauccuacccugcuagcaaacccggaacuuguuccuuuuaucuuucuuacuguauguuugcacccuguaacccacuucucuucauucuccuuccuccuccugcucaacuuucccaaucucuguuacguguuuuucuuucuaccuccauguguguaaaucuuuuagcuccuguguaucagugagaauaugcaauauuugucuuuuugugccuagcuuauuucacuuaaaauaaugaccuccagugauuuucugauaauuuuuauuaugauaacugaaaucagacuggcauuucccuuuucguauuuuuuuuuuuuuuuuuuuuuugagaaaggucucaaucugucaccuagacuggaguacaguggugugaucucagcucacugcaaccucuaccucccaggcucaagcaauucucuugucucaggcucccgaguagcugggauuacaggaaugcgccaccacgccuggcuaacuuuuguauuuuuagagaugggguuucaccauguuggccaggcuggucuugaacuccugaccucaaaugauccaccugccucggccucccgaagugcugggauuacaggcguaagucacugcacccagcauuccuuuucauuuuuuuauaguacgcuauccuggaccauuuuggaugcgaaaggauaagacugaaaaauauccgagggggauaaagaaauguccuggcuauggucacuacuaccuacuuaauuauucugagucuguccagcuuuccacugcuauuuguuuuuuacaagccagcauuaaaaaguagccagguuacauuuacuauauucuuucuuucuuucuuuuuuuuuuuuuuuuuugagacggagucccgcucuuuagcccaggccggauugcaguggcacaaucuuggcucacugcaagcuccgccucccagguucacgccauucuccugccucagccuccugaguagcugggacuacaggcgcccgccacugcgcccggcuaauuuuuuguauuuuuaguagagacgggguuucaccguguuagccaagauggucucgaucuccugaccuugugauccgcccgccucggccucccaaagugcugggauuacaggcgugagccaccgcgcccagcuaauuuuuguauuuuuaguagauaugggguuuugccauguuggcuaggcuggucucgaauuccugaccucaggugaucugcccaccucggccucccaaagugcuaggauaacagaggugagccacugugcccggcuauauuuacuauauuucuucacaucauaugucauaaucuuuaaacagcaaaaugaauaauguaaaaaccuagaaaacuuuuuuuccuagacuacuauguuauugacaacuauuacuuuccauaguugaguagccccauauaagccuccucuagacaucaccuaccuccaaugauagccgaguuucuguugacuccauuucuuauagcuuggccuuguccuggauuauauggaaaauccgcacuggcuguagagaaagaaagagucaagugucagagucaaguauacuauugaucccaaauaauuugauaccuauuucuucaugcaacucuucaacacuuccuguuuucccaaaugaaaucuccauuucagauggacccgucuugccauugucucccacaagaaucacaacagccuccaucccuguuccugcuguuucucuuugcacaaggccuagguaaacacgacuucccacuuggagcaauauuagagaauccuagagcuaccugagcuggccugcucuaguuccacagacagacgaguuuaugcauuugaauauguuucuuacauuugguugaaaucugcuucccauccacuuuuaaccccaugcacaacugguggcauucaauguauuuguagaugagcuuuuuacagcuacaguauuaaaaaguuuaaaaaggaaucauuccuuuaaacuuguauuuuucauggcuguaauaagacacuggcacacuuuaggaauuuguaaggggguaauaauucaaaacaguuaagaauauuaacugccuagugaauuuucuauuucuuucccuauuauaaacguaagaaucaguuguguuaaauuuagguauuucucuaagauaaaacaaauuuuaagcccgguaaaggcaaauagaucccgaaguccaucugcaagucggcagacuaucuucugucauccauaggaccuaauccaacuucagaaacaauucacauuuguuggucuucuguuggagaaguuaagguaaaucuuccaacagaagcaggucaccuuagucuaaagcaagcucuggcuacuggauggcaccaguuaaauguaaaaagaauuuagaaguacuuauuugguacaaugaaauguguacacaccaggcaaacagguuuauguuaugauucagggagaacauugcuacauacuccguuuucuaacacuaauuuauuccugggcuauggacuuccaagauuauccgggauaaugaugaaaagcagguagagcccuuuuuccuccucuucucuuggaaauauggcaaccaaaaagggagauuccagauucuuucaacacaugugauuuaauccuuucucuuuuagacuugauauucuuuuuuuguguguguguggggcgggggcaguguggggaaagggucucacucuguuguccaggcuggagugagugcaguggugugaucuuggcuugcugcaacugcugccuugcaggcucagguguuucuccugccucagccucccaaguagcugggauuacaggcaccugccaccaugccuggcuaauuuuuguauuuuuaguagagacaggguuucaccauguuagccagccuggucucaaacuccugaucucaaguuauccacucacccuggccucccaaaaugcugcaauuacaggcaugagccacugcaccuggccagacuugauauucuuguuuaggaccaggaaaauuauacuuuuuagauagauacguauauauauuccaaauuaucucaacuaucaguugacugaguaaaagcacagacacuaagcaagcuacaaaugaaagugaacuuaacucuuggguauucaaggauuucauauuccccaagucuuuaacugggggaugcaaaagagaccacugaugguuuuugcuuguuuuaacuggcucaauccuuuuuuuuuuuuuuuuuuuuuuaagauuuggucuugcuguguugaccaggcuggagugcaguggcacaaucauggcucacugcagccuggaccucccaggcucaaguguuccuccugccucagacuccugaguagcugggaccacagccaugcacuaucacaccuggcaaauuuuuuuauuuuuuguagagaugggguuucccuauguugcccaagcuggucuugaauuccugggcucaaacgauccucccaccuuggccuuucaaagugcugggauuacaggugugagccaccaugcccggccaauugguccaauccuaaauccaguuagcuaggcagggaaauggggagagccaacauguaguacaguguagucagcuacuuucucaucagcucacuuucccauuucccuucaggauuuucugggguagguaguguggauuaauauucccaaucccaaaugucagcccaagaaugcaaagaucuuucauuuauuaggcuuaucaucagauauaagauuaguccuaaaauuaucccgugggaauaaaacugguuuauauaaaaacauauaauaaaaaccuugaauaaaaaccuuggcuuucuuuuuuaaaccugaaucuucucuucaaauuuauucauuuacuuauucacuaaaucuuuauagaaugccuacuauaugucagacuucuuuccaagugcugaggauauacagugaacaauaaaauagacaaagaauaaaguucuuuagcuaaugagaacuucuugguccgacauggucuguuuauucuacgcauccuugaagaguuugguuuauauagucuuuagauuauauacugaagcauggaugugguuucaguuaugaacuuguccauuuacaguaaauugccugauaagucaugcuacccauaaaccauaagcacaggaagauuugguuaugaauguauacaauucccuggcauaagccacccuucaaagaccaaaagcuauuuuucaggaaugaaaacuugcaccguuacugcccaucuuuuccagaccuuuugacauuauaauuacucuucucuggacacuauuuaguccauauccuucuagaaagucaccaagcuugugaauagucuaguuaaaauuagaacccagguguaggguucguuccaaagucaacaaucuucucuacccugccuuuugaaggcuagaaagggacaaggaguugaaggguugaggaagucccagcuugcagacaguuuggcuuggguugggacuaugggaggaggagcccuuuuaggugaugaggaauuaauuaguuuuguauuggacauauugaguuggaggugcuaauggggcacccagguggagauauuuacuagauauuuggauacuuugugagugagugauauuuccugucuccuuuugauaaacgcagaaauuuccugaccuccuuuuucuuugucuucccuuauccccugccccgucaugaccuucuuucuuucuuuauuuuuugagauggagucucgcugugucccccagguuggagugcaguggcgcgaucucagcucacugcaagcucugccuccuggguucacgccauucuccugccucagccucccgaguagcugggacuacaggcgcccgccaacaugcccggcuaauuuuuuguauuuuuaguagaaacgggguuucaccguguuauccaagauggucucgaucuccugaccucgugaucugccggucuuggccucuuaaagugcugggauuacaggcgugagccaccgcgcccggccgaccuucuuuaaauaauauguaccuucgaaauauauuaaauauagugauaaaaaauuacaaugguaggccaggcacggugaguccaaggcaaguggaucaugaggucaagagaucgagaccauccuggccaacauggugaaaccccgucucuacuaaaaauacaaaaauuagcugggcaugauggcgugcgccuguagucccagcuacucgggaggcugaggcaggagaaucacuugaaccugggaggcagagguugcagugagcugagaucgugccacugcacuccagccuggugacagagcgagacugucucaaaaaaaaaaaaaaaaaaaaaaaaaaaaaaaaauuagcugugcaugguggcacgugccuguagucccagcuacucaggaggcugaagcaggagaauugcuugaaccgcuugaaccugggaggcggagguuguagcgagccgagauugcaccacugcacuccacccuggcgacagagcgagacuccgucucaaaaaaaaaaaaaaaaaaaaaaaaaauuacaaugguaaucugguucccuugagguuacggauaaaaacaguagcagaacauacggagauaguggaaggaguuaccugagaugacgcaaggagaaugacaagagcuagggaggaacauuuaaaaauauuccacgauuguuuuggguguaaaucugaacuccuuggcauagggaagaaagacucccuugagcuggauuucucuccugccccuuccuuccuggggucacuuuuccaacucaacauucuagguauaggugauauggacaggaggcagggaaauacuggguagaagaggguggagucccuggcaaggguuccacacacaaaccugagcccacagcccuaaaugagaaauucacagcccuguuuucccacccaaaugcugcuuuuuccaaaaccagccuggccugccaugccccccaguccuguaaccauaaaaaccccaagcuccacuggcagaggagcagagcaguguggcagaggagagaagagaacaagcggcugaacaucaagaggagaagcagcaucugaauguugaagagguaacuggacaguuggaaagcaguuucgcugaggaugacugaagagaauuaucuucccauuucaucccuuuccagcuccccaucccacugagagccaccuccaucacucaauaaaacugugugaccugauucuuccuggaugccagacaaggaccuggguaccaagagggcaggggguaaaagucugucacccugucuccaaugagcugguuaacacuuagccauccccagacaguaacuguuaaaacagcauuaauuguaacauaccccuagaugcugcuguggggcuggagaccaaaagcguucaccccagcgguggcacccacuugccugugugcucgccgucccgcaaaagguuugagugagcuguacccuguugcaaguccagugaaggggucuagggaacucucccgucucauaggaguuccugaugccuccaguugacacaccuuuucucugccauauggcacucugucuggacaucugguuuacuauccuuuucuuuguccaucagaucuuaccacuuuccugaaaguauccucagcgaccucagacugugugucccuuuucucaaugggaauaaucuuaauucuugugacuucuuacaugacagucauccucuucaagucagagaccaaucuuaaucauguuugcaguuccagugacuaacaaugcaguagcaagggcuaaauggauguucauuggcuggcauaauuaaaaucaguugauuaagagguauguaaacaucgguagcuucuucugauaacaaaaccuucuaugcagguagaauuuugaaagucagaugccuagucucaacuaaauccuuacagugaggcagguuucuuauucuuccuaacaaaggagauggacauauugaauauagaaaauauauuagugacuccuaguccgcuggacuuugguuauuguuagaaaauaacuuguagaaaauccucaggucaggaauccuuauacauuucaagggcaaaaucuuuuguuuguuuagugugagcacuccuauuuuccuggauuuauuuaugcuguaagccugguuguccuaaugcaugugagugcuuacccccuugaggcaaagccauuuuauucuggcgaucaacacaauugcuauuuugauagauacauuuuauugccacugaccuuuccccugggaacaaacauccucuuggaaaugcgcacagagaaaaacggagaccaagaaacaugacugagacauggauaauaaagcucaccuauucuacugcuaacauccacguuccccucacccagcuugcugggagagcugaacaauuuuagugguguuggaguaucaaggaaccuauacuuugggaaacagugaguagguccaaauuuggcguguuaauuuaaaacagacuagcuauaacauucucaagaccagucuuucaucaaauaagcacagacucuauucaacauacuucucuugcggauccccaaaugacacuccauguuaaccaccaaagcauggugccauuccagucugauuuagagucuuauaaaagcccacauauuucugcauauuucccuugcacgugcccuuguguguagucauccguguuccuauauuuguagaccauguuuccauugcaccacucagagauuagcucuccuccccuccuccaccaagcacaggccaggcaggacauauugcuggaggaauugaugaugggagagucuucucccaggaacguacuuaguaaacauccuggcuaaggcuuuagcgcccacacacauaugcacuacuaugcuccucacccaaggagaaguauguuugucuguccuagugaauaaggagagaguaaaguuuuuuuuuuuuuuuaacuacagaagauaaauuuggugguugugguucuuauuuacuaaguuucaaaauauuuaggcucagaaaccaauugcaaacaaaacauauugaagugcauauaaaaauaaauugaaauaucuaacauaaaaccccccaaaaugaaaggcucuggaagcuucagguugucauauaucagagacaaaaaaauuagaucauaucugacaucuccuagagaaaauaucuccauggaaaccacuggaguuucagcaucuaaaguaauaauuugagacacuucaacaaaacugcugcuauuaauuauaauuuaauuuaaauugcaacauuauuuuuacaguggguccgggcgagaugagguaucucugccuuuguucuuagcuucuuuguuuuauuacauuuuauucuguuuucaaaucugaguuauauagcagaaaaugauuguuuuucuuaaauaauguuuuuagccauucacuauugauauuucugaaacagauaugaaaacaaaugguuaucgacuaagaugcugaagauauaagggacauuguuuuauuuuaagagaggaucccugcuaaucacauuuuugggagggagcgauuucucuaagucagcagguuuuuccguaggcagagcauuauguggcauguacugacaugauccugaguuucacauuucucucucuacccuucacuuccuaguuucuaaaaaaaaaguagccagccagcauuuccaauuucaaacaggggaaggugauugugacuuuuuggcuccugacuugaaaaguuaaacaagcuuuacauuuccagcuucuuaaaggaaugagaaaguggcagcugcuuucaugauuguccaagauccagugaccaaaagaggucgagugaagagaaacagaauaaacaaauuugucgucaucggcuauauguuaugauuguuuaaaccaacuuuuauaugaaaggacugagugggcaauugauuccauuguacucccucuuuccaucaguuacuuaguuaacuucugaauugucucaauugccuuucaggaaaaagauuucuuaaugcucucagaguaggcugacauuguacucuuuugucugauuaacgauaaagagguauuuuaauugaaaauagcucauuaggccgggcacaguggcucacgccuguaauccuagcacuuugggaggcugaggcagacagaucaugaggucgggagaucgagaccauccugguuaacacggugaaaccccgucucuacuaaaaauacaaaaaaguagcugggugugguggugggugccuguaguccuagcuacucgggaggcugaggcaggagaauagcaugaacccgggaagcggagauugcagugagccgagauugugccacugcacuccagccugggcaaaagagcaagacuccaucucaaaaaaaaaagaaaaaagaaaaaaauagcucauuauuaauauaugcucagauuuuguauuucauaaaauaaacacgaagguaagguauuugguguccauuuucaugugagauaaaugucuuguuauuucucaggugggcaaauuguuccaguccuaauguuugguuauaauuguuuauaaaucaauggucaaaguuauuguaaaauauugugggcacuuguaaaguauugauugugacagcuggccuuuauagauucuguaguuccacaaccucucuacaguuaaggaggcaaaaaugcagaauggaugauaauuaggugaaagccacaugguuggugggugccagagucgcugcuacgaggacgaggucuuucgacuccucauucaggacucucucauguaucuuacuguaguucucagggugaaccuugaaagucuggaucagagagccucacugccaggagcagcuauccagcuggcccuccacauccacggguuccccaacuguggauucaaccaaacucagaucaaaaauauucgggaaaaaaaguuucagcuguacugaacacguacagauauuuuuuucuugucauuguucccuaaacaauccagcauaacaaaucuuuuuuuuuuuuuugaggcggagucucacucugucgcccaggcuggaguguaguggcacaaucucagcucacugcaaccucugcuuccuggguucaagugauucuccugccucagccuccugaguagcugaaauuacaggcaugcgccaccaugcccggcuaauuuuuguauuuuuaguagagauuggguuucaccauguugguuaggcuggucucgaacuccugaccucgugaucugcuugccucagccucccaaagugcuuggauuacaggcgugagccacugugccuggccaacaacucuuuacauagcauuuauguuguauuagguauuacaaguaaucuacaagagacaauuuaaaguauaugggaggguguguguagguuauauguagguauuuaccacacuauuugcuaucagaaacuugaggaucuguggauuugggugucuuuggggguccuggaaccaauuuccuguaaacacuggggcaggacuggagcacuugguuaacagugccguacggcucuucguugagguuugucgcggcuucuuuuccuuuccgcugcagggaguuuaugaauucaugcugauguuaacaggagugcaagaaggaagaagccccaaaucuaggggaauauaaauucgggaagugccauuuaaaccccggucugaaggaaaacgcuguuucuccugcugcacaguuuccagaaugcgcguggcggcagcagggugccccggaaggggcugucacuuccuaugcaugcagggcucugaaugucagggacaaagggcucugcacuuguguaacugguggguucuucggccuugaaaaaguugcugaaccuccuuaggcuuuuucuucaauuucuaucucagucugagaugccuuugggggagagcacucugauucagaccuuucaaacauuaaggggcauacggaugcccugagcuuugguaaaaaugcugcuucugccugaguuggucucgggugggggaccugggcaucuguauuucuaacaggcucccagagugcuugaauaccugccugacuuucaguugcagaaauuuaauguagaccauuggugacucaggucuucagcugcucguguguguguguguuuuaauuuaaagcagugucugagagggagcugaaauaauuccuucugagaaccuuguccuuuuucccuuggccgaaucauuugugugaauuuaaugauuugccugccagaaugccccacaguucgacuccguuaguucuauuucuuuuuaguguugugaaagcaauaauaggaacacuguguuaauuucagagagaauuauuuacuauuauuuugaauguuggagagggggaguuuauuacaguuuaggaaaaaacagccaaagaguuuaauaaaugguuaucuuaguaugaccuuggauaccuuuccugguucaaagcaaaaauacaaguugaaucucuaaagcaaguuuaucagggaggaaaaauauugggauguuggcauuuagguucuugaugcuauggaugcguuuaaaggcauauaugagagagaacagaugcauuuuaaaauuuucuuuuuagagacagggucuugcuauguugcucaggcugaucuugaacuccuggacucauguagcugggacuauaggcacgugccacugcgccuggcuagacguauuuuuaaaaauacuguaccguggauuuuuuugaaguuuauggauuuguuuuuugacaaaacauucuuacugcugguucugcugcugcaugggugcaaugcgggauacagccagaucaggguggaaagccugaagccauacgggcauauuaugguaugucagacagccucggugacugccucuggcuuuauggaaugcugugucucagauaugggugcucaccaaguuuugugaacacaccugcuauacaggagucucagcuaagagaacuugugguuuccuuauuagcaaagcaguauuagcaagaauugguuguuugcugagucauagaaauagccccaguuucuagggagaggguggcugagaaaauuaugauaguuaaaagaggaaagcaaccaauuauaguaagucaaaaagggauauuuuuaaggacauucucugauguauuucaccuuuccucuuaggcaguggucagggauucgcacaauucauaagaugaaagucuucaggagacccuggaucuauugucuucagacuucugcagagaaacacauccccugggcauuaugcaauuaucaguaagggcuuuggacuuccaugauguauggcuugggagcucagugaaaauaacauuuuaucaccuuaagucuacucaagagaugcgcuucaucauuugugagaauacuuaggcgcauguuauuuuaggacucaagcaaggaugaagggauuccuuuuacucucccucuguggaaauuucuaguaaauucaaaggccauacuuuggcuguggauggacccuuuggaaauggcugaauauuauugaucugcuuugucauccugugucuuucaaaggaguucagugaauaauuaaauauuuuuaaaugcuuuuuaucuucugcuggaaccucgguaucucaacuugcagaagacgcuguuuucagcuuuacacgaugaaugugcuucugugcucuguggaccaguucugccaauaggcaugggauguuuguguuguaacugcuauuucaucaaaaugugagguugauccuuuuuauucuuaaguuuucagaaacuaguauaauacauagaugaggagcguugcugagaacaugguggagucacccagaccacagacagcugaccagauucugucuccacugugcgguuagaaggggggcaugggcaaaccuaaagugcuuuuaaaaauuaauucuacacauauuuuaagucuuuuaugaaugcccaguucggcucuugguuuugaaauacucuuuucgguugcauuagcacaagggaaauuuauaauuccaaucccaagacaauguauuuucuuccaagaaggcugacuucagagaacugaguauaaaagcuccaugcuaaauaugcuuccauuguugucugagcuguucucuucuugaguuaaccugagaucucacaagacaacuaguuuugcuuccugacaggugaaauggcaaauggccaucaaggagaaacugaugaaacaaauuauccuugguuauuaaagcuuccugaugguuccccacaccauuccucccuggugccuggcucacaucauuauaaagauagcgugauaaaguccuggcaugagccguguggcucugucacaguucuucucauucaugucaacggagugugaaaaaauauuuaauuggcucuagcagccuuggggaugauuuauucccugucgaaaaggggaauguggaacaagaaaaagcaaaguguauuuaguagcagggauuucaccaacagguaugcaaauuacauauccuuccagacuucugcauuauauuuaaagggugauagaaaauaguaagacaguucagaauaaagaacuggaauuauauguuuuacuccaaaauuuucauugagaggaaggaauagugggaaaaaaauaacugaaucugaaauauaugcauuuuccacuucauaaugcuagucucugcauacuuuagaguaaggugcuauaaacucaguccccauugcuucacaauccugaugcacaccaggaauccucugggauggggaacaggcauugggauuugugaaaagcuccccaggugacugaugugcagccaggguugugcaccgcacuucuguggccacccagucaguguuugcugagggaaugaauacauuuauuuucucugagcugcauuuuccuuaucuuuaaaauguggcugauaauguccacuuugccuaccacauguggccauuccaggauaaaacaaaaucaugcauuaaagcauuucaacaaauaaaauaguuuacaaauuuaaguuaucacuacuuuugucuguauccuuuccaguuuucuaaaaguuaaaauucccgucaaugauugaaaaucauuuuagcauguuuaaaggggaauuuccaaaacaauucaucuuauuuucuauguuuaaaauaacuguaccccacauucauauggcuauuuauguacaauuacauuucaacauaaagcugauuuuaauuuuuuaaaagucuuucagcguugcucucaggaacaaacucaacagcagaauuaggaaucugcauccgucuuuagaauuucugaauagucuaugcagagcacguggaaucagacaaagaucucaaaggagugaagcaauuuaucauguuuaguuauugguauuuauaaaaggacuuuucucugaaaagcauguggugauguguuaaaaaccucaucaggauaaugcuucugcaacuguagagaucauagcaaggacaugaggugcugauuggccagcagagguggaacuaacauuuccagguggugacugacagagauuccccugugagaauucacaccugggaauucugacaauugucuuuuuaaaugaggccguaaaagaagugauggcggauaauuuagaggguguugugcuccucugagugcuuccauagcugagugauauggugcuguaacagaagcaugauacugaagaauacucaaaaaugcgguacaguaggaagcaucugaaugggggaucgcuggggguaaggaaagacacacaagucaagggauaacacugagcucaacucgccucccuuuucaugggcuacucauagcauuccuguagcacgagcaugacgcaaaaaugaauacugugacuugcuggagucagugguucugccaucaacagagaagucaccauggcaacauguacaaccgcguugccccgcacuuagccagccccacgugacacaggcugacagcugcaaugauuuccaugcacagaccccaggaaaaugcaccuuugagugccaugccagguggggugggggucggaggguggacagcccagggagaagaacgggacagaguccuaaccucccugggguucaaaaucuaucguaggggaugaagggaaagaaagguagaggaaaauuaggaaugaaagaaauucgcggcaggggaaaaaacaaugaccuuggagauaguuccaaagcuguauguuugugccgguuuugcuuuuuuaucacuggaguuucagagaguuaagugauccugguuaagacagaacagaagucuuugaauaaaggcagccccugacacggccaggccuguggagccacuagaaagcagcccgucuacacagaggauggccugugagguguucgaugcugaaggggaauccaacccugcugccagucauguuuagccacuuaagugacguuuugcucuuugauuauuucuucaucauggcugagccuugacagagcgcacccccaacugcuuuucaaaacacaagccugccaagucuauucucucagugaugugggaaggcuuuggcaacuuacgccagccucuaaguucuuuucaggucccuuagcaaaaagucuagugcaagccauuggugucaauuacaucuggagggugcaguccuggaggcggggcuggggcagcagagguguggucagaagagagcauggcuggaguuuaagauuuguugacuucgguucacauucuuauaagaccaugauacacacaccccaccaagaaggaaaauaagagagagagccaaacauucaaauuagaaaguuagaggccagcaaauauaaauuuaaagaagacacgacaguagaaagaaaacaaagaauugacaaauaaaucuaagagcugguucuuugagaaaagaaaaaaaaaaagccacauaaucuaaucaauaaggggggggggucaacagaaacauucaauauaaaaaacacgaaaaagggaauggaaauuaaauuauuaacaaguuucuguucaacuccacaguaaugaguuugaaaaccuagguuaaaugcacgaauuucuagaaaaagauaaaauaacggguauuauccuagaugagaaagaaaaucuaauuagacagauuaucauaaaauaacuugagagaguugucaaagaucugcucccacaagaagcagugggcucaagugguuuuccaggggaaaccuaugaaaucuaccagaggcagugccucaaggcugcuuaucuccuugccacucccaguguguuccagggacccgcugcaucagcagcaccugggagcuuguuggaaaugcagaaucucuaaucccauguuugaccagcugaaucugcauuugcuaauuucccccaggugauucuaagcacauuaaaaucuggaugacacuuaucugaaucauuucgcaacuuggagagagauggagaagacacgcaugguguaacugggcaucaccagguaaugaacuuauacauaaaccuuaaucccaguaaaaauuuuaaacaauuccaauaaaaugauuaaaauucucaaauccacaugggaaaagcaaaugugcaaggaugaacaggaaaauucugggaaaaaaaacucagaaaaaaagggaaauuagcucuaugagccacuaaaugugauaauaaaagcucaaugauaaguacugcaguuugcucccaugucacaaggcaucauaucaauguaauagaccagagaguccaguagggacucagaaaugaagggaauuuagaagaugguaaagguggagaggauggagccucaaccaauggggcuggaacagugggccauuugggaaaaaauaaagugagauuuuuaccuuccaccuuccacccaaauaaauuuccagggaagaaaauacguagaacuuacaaauaaaacacaaaauuauuauaaaaaacauggaauaauuuaaaaaauaaguucuaaauggagaagguaugucacaaaacccaaaagccauaaaacacuuuacauuucaccauguaaaauuuaguaacuuuuacauggaaaaaaaaaucccauaaauucaaaaaaauugagaugaaacaaggaaaacauuaaaaauacuaauuuacuuaauauauuaagaauacuuauaaaucaauaggaaagaauauaaagauauaaauaauuauuggagcaaagaauauaaagagggaguuuauggaaaaauaaauauaaaugauauauaaacauaugcaaagauacuuaacccaacucauaauuaaugaaauacaaacuauaacaagaaaauuuuauuuuucauauagaacagccacauuuaaaagaauaauaugaugcacuguuuuggugaggauguggggaaaagguauucauagauugcuggacugucaaucggauuauaucauuagaggaugguuuguaguaguaucaaaauuaaaaacacacauauccuuugacucaacaaaaucauggauacaaugugauuuucuaugaaaacacuguagaaacugauuuucuaugaaaacacuguagaaacaaaaggugggauacaacuaaaaugaccaggcaaaaauagguaagacuaauaccauaguugauuugagauacauaaaugcgcuugguguuuuugcaggaaaaguggaauuuggaucuuugcaggaaaaugcacauuagcaagcaagggaugauaguuuuucuucacacgauuaagugugaacuguguuggugacugaagagggaaaaagacaaauaacauaauaaaaagacugagugugagagauaaaaaugcauuaaucaugcagucuuagcauaaggagagaaaagggaucuguucagaaauaauucagauguaauuauaagagcaggaaugauuacuuuuaagugcuugcaggugguaaagaaaaccaaugaucagcuuguaguuagguagaaaacagaauagaugauauauguaauuuuaaaaaguucuuuauauccauaacucuuugcacaugaagauauaaaaauauuuuauggccagaugauagaaaggaaacuuggaauauagacagaaaucaacuuagaagucauaacgauggagguaagaggucuucagaaaccaaucuguggccagugguaaaguguccgauguggugacgggaagccugagugaguuccuagcucagugcuggguauacucaagucuaauggggguaugggguuguuacacugagugaucccaagugccaaguuccaucuaguuccuaauauaucugggagaagacccacgugccuaagagggcugguuuucagccacucugccaaccugagugaauccacuggaccagcuuggcaggggauucucaacccuggauucuugacaauccuggccuugguucugggggagguggagaauuggguguuaacucccuucccuccacuccugcuucugaauuuuccaucuccuacccacuucccuguuggaggagcugugagaauuccuggucaaggaccucccagugucagaugcagguuagcguuagggcagagaaccagauaacuuaagguuacaguggaugcugugaauucaccugcuagcaauuuacagaaggacucccagguccuuucuggggugagaugcaccacacaucacauaccaugcaaacuuugcugagaaucuagccuggaccuacuagaaguccuuuaaaauaacuagcuguggccaggcgcaguggcucaugccuguaaucccagcacuuugggaggcugaggcgggcggaucacgaggucaagagaucgagaccauccuggccaacauggugaaaccccgucucuacuaaaaacacaaaaauuagcugggugugguggugcgugccuguagucccagcuacucaggaggccgaggcaguagaauugcuuguaccccggagguggagguugcagugagccgagaucacgccucuacacuccagccuagugacagagcgagacuccaucucaaauaauaauaacaacaacaacuagcugcaaucuuuacaacuagaggaucccuuaggaaaugaaacuuuacaucuuaaaaugcuucaucuauuuuaaugauauuuuaaagaagauccuaggauguggcuuuuggucugacguauucuguaucaaauaucacgaaugugauaaaacacucuaaggcuuaacacaaacgccuuuuaaagcagcuuggugugcaguuuggaguugcuccuuagugcagaaauuuaugggaucagacucuuggauuuauuuuuucugguguuuguuuuguuuuuguauuuuacagaaugugcacugccaucuguggcugucuuccugcuggcaaauccuuuucauuccaagcaaauaagauucccuaaauuagacaaaaaggaagaaacacaacagaguccauaauucugagagguaaaucacggcaauugccuggcauucugugaccuuaaaauaaaccuuaacucagggcuggggguuacuuuuucuaccuuguaacuacuguucuaaaaauauuccuaaggaccauauaaugguuuagaaacaggcuguacuuauuaucaaagagggaaauaacuagaagaaaaaaagauuggauguuuccaauagagcagaauuguuuuaaaucaagucaacuuaaaucauaauguguaagucuuuuguuuaccucaucccccuauaaaaauguguucuuaaagccccaugcuaggcccuagcgcuuggggugaucuuucucuacugcccaguguuucccaaacuccaaucaugugaaaaucaccuucauauuuuucuugacauauacuguaaaauccaaguauuauuuauuuacuuauuuucacaaaauugguuaaauuucuuauuuauauaaaucuauugauaaaacuuuacaucccuacugaguaauucuauugccugugaggcacuaaccagaagccuguucucucuuuauuauaagguaaaauacaaucaugggagagguguuaaaagcgugccagaaccaaauagagacuuucucuuuauaaaaucagaaggacugaaagacaaaugaacaggaaaugacuugcuuuguauguuacacgaggccaugucuauuugcuucccauaauggcgacccccuaucuaggcuacaugcugcacugcuccagaagccagagacugcacuacaaaugacaucuguuauaguugugcagugcacaaccugaccaacauaaaugucccucauuuuagaaaacacugauagagcccaaaggacauuggagagguaacaaauaguguuuguuauagaaguguaacaguaguguuacagaugagaaaaagaaucuuauuacuaaagccagcauaccuuagaaccuauuuucuguuuuuaucauuuacuaugaucucagacaguagaaagacagguaugggagcagaaagaucaccagaccuauggguagaugucuucaauucuaauuuccauucuaacaccaaguuccugcaaaacaaacauccugguauagguaugcaaacauccugguauagguauggauugaguagcccugguuugccaagaucccuuuaaccauaaggccauaugauuccuuacucuucacagcaaggcaccugcuguauuuucagaaaagcacagcccucauuuuaaagcagcaucuuuuucuaucuuucagaguagguuagcagccaauucaaaacacaguaauaauuucacaucuuccucauaaugaggugcuuucacuggagccaccgaguccugccccacacugcaaauuuauuguucauuuguuuguuucaagucugcuuuccaguugcaaacaggcagaucaguucuccucaaguuuagguaaaaacaucuccucugagugagcuuccuuauaaaauggccggagagccuggucucuuugcaagcuugaugguacagccuuuacuauuugugauuuaaccaccuaacggcuuuauuguuuuucauaaaccauguuuugggcaguauuuggguauucaguuuuuucuuuugguaaccuuauuuugaugcacuuaccaaagggacccuucuuucauuuggugagugauucuugaccuuggucacacacuggacacuccuggggagggggguuuacaucacacacaccugugucccuccuauccccccgagggucugauuugguccgucagggguuuaguacuagauauugggauuuuucuuuuuaaaaaauaaccaugaagacccuucagauggcuuccuuucccuuucacucucccaaaggaagagaagagugaucaucagcagcaaaaggcaauugcagagaagcaccaccaagagccagcuucaugcucaggagugaaugcugagccgccuccucgugguuuccggugcuccacauguucagagaaacuucucugguaagaaacuauagaaauggugcauggaaguguuacuagaaaggguuccugauccaaaccccaagagaggguucuuggaucucacgcaagauccaagaauuuagggugcauccauagaguaaagugaaagcaaguuuauuaguguauuaguuuguuuucaugcugcuaauaaacacauaccugagacuggguaauuuauacaggaaagagguuuaauggacucccaguuccacacggcuggcgaggccucacaaucaugguggaaggcaaggaggagcaagucaugucuuacauggauggcagcaggcaaagagagagcuugugcagggaaacuccccuuuauaaaaccaucagaucuugugagacuuauucacugucacgacaacagcauggaaagaccugcccccaugauucaauuaccucccaccaggucccucccacaacacaugggaauucaagaugagauuuggguggggacauagucaaacuguaucaauugggaaaguaaaggaauaaaagaauaggaggagccaagauggcugaauaggaacagcuccagucuacagcucccagcaugagcgacgcagaagaugggugauuucugcauuuccaucugagcuuugaaaagagcagugguucucccagcacgcagcuggagaucugagaaugggcagacugccuccucaagugggucucugaccccugaccccugagcagccuaacugggaggcaccccccaguaggggcagacugacacuucacauggccggguacuccucugagacaaaacuuccagaggaacgaucagauggcagcauucgcaguucacgaaaaaccgcuguucugcaaacaccgcugcagauacccaggcaaacagggucuggaguggaccucuagcaaacuccaacagaccugcagcugaggguccugucuguuagaaggaaaacuaacaaacagaaaggacaaccacaccaaaaacccaucuguacaucaccaucaucaaagaccaaaaguagauaaaaccacaaagauagggaaaaaacagagcagaaaaacuggaaacucuaaaaagcagagcaccucuccuccuccacuauucacaauugcaaagacuuggaaccaacccaaauguccaacaaugauagacuggauuaagaaaauguggcacauauacaccauggacuacugugcagccauaaaaaaugaugaguucauguccuuucuagggacauggaugaaauuggaaaucaucauucucaguaaacuaucgcaaggacaaaaaaccaaacaccgcauguucucacucauaggugggaauugaacaaugagaacacauggacacaggaaggggaacaucacacucuggggacuauugugggguggggggaggggggagggauagcacugggagauauaccuaaugcuagaugaugaguuagugggugcagcguaccagcauggcacauguauacauauguaacuaaccugcacaaugugcacauguacccuaaaacuuaaaguauaauaauaaaacaaaaaggaauaaaagaauagcuacaccacagacagagcagccccaagggcugcugguugcccauuuuuaugguuauuucuugauuauaugcuaaacaagggguggaucauucaugccuccccuuuuuuuaggcccuauaggguaacuuccugacauugcuauggcauuuauaagcugucauggugcugaugggaguguagcagugaggaugaccagaagucaaucucauugccaucuugguuuugaugguuuuagcuggcuucuuuacugcaaccaguuuucaguaggucucagcuuuauuuuacccagccccuauucgagauggaguugcucugguucagacaccucugacagaaguauagucuugacaucaggguuuuaaaaagcuccccagguaguuuuggguuuuaaaaagcuccccagguaguuuuaaagugcuucccagauugagaagcacuauacaagauuagagcuuuuaaauugcagugguaagucaccugggaaccaugcuaaaaaacacgaaugcugauuuagucaguauggggaggggccugagauucugcauuucuaaaaaagcuuccaggagacccauugcugcuuguugaggaauaaacuuccaaggcaccagaugagauaaucuacuuccaaauguccucuagucaagccaggacucacgagcucucauguuauuuucuuuccauccuaacccuacacagacucaaguaccucacguuauuuacagguagaaaggcauuuuuguguauauacuguuuuguuuuuaaauaucugauagcaaggaaucuuauucuagucaaacaugaaauauuaccagaaaagugcaaaaccguaaaguccaaauucagaaugaugaccuuaggcucacgaaaccagagugcaauugcugaugugagggaugcacuuagaacccgaguugguauggaacucauuuuaaacugaagccacuggggauucaauaggugcagaaagaagccuucuuggugcuuccuuuaucugacaaaaagcagagacuucuggaaaaaugaggcugccauaccucccucuuacggguggcuuuuacucccaggaagaugaucaagaaaccuaccguaaguccucucuccagggaaguuuuauggccaugaaugagauacagagaucacucaggccugcaugaacaagcacuaucacaaacucuuuaucucucauuuguucuucuagaaauccaucuguuccuccuauagaggccuuuucccccacugccucuuuucccuacuaagcugggcauauaaguuucuagcuuuaacuacuuacugaguuucuucuuuuucaagcuccuauaugcauauaaauaaggucccccugcccaccuguuaaucugucuuuuaucagcuuaauuugcaggcccccagguacugaacuuaagaggacagaggaaaaguuuuuccucccugacacugagcaaccagaggcugcuguuaaguaaccuucccucauuucuacgucuguccucugccccuuccagccccucaacccacauugucucucauguuccuauucaccuaaaagaggaaaaucauauuauuucaauaaaccucugccuuauaguuuguaaacuguuuucuguuguuuuuuuguuuuguuuugagacagagucuugcaguggcaccaucucagcucagugcaaccucugccucccaaguucaagcgauucuccugccucagccuccugaggagcugggauuacaggcgugcgccaccacgcccagcuaauuuuuguauuuuuaguagagacgggcuuucaccguguuggucaggcuggucucgaacuccugaccucaugauccacccaccucagccucccaaaaugcugggauuacagaugugagccaccgagcccggucaacuguuuucuguccuuguaauugguauaaugacaauugcauuaauacuucaucugcuggacacuggguaagaacucuccaaguguaaguggaaauuuuucugcaaauggaucucauguuacauagcacaggccuaccauaauaucagaauuacagaauuuggauuugaacaucaaauacagauauguucccuauauacauuuucauaaaucaaucaaaagaauccuguaauccuagcacucuguaauccuagcacuuugggaggccuaggcggguggaucaccugagguuaggaguccaagaccaguuuggccaacauggugaaauccugucucuacaaaaauuaagugggcaugauggcgggugccuguaaucccagcuacucaggaggcugaggcaggagaaucgcuuaaacccaggaggcagagguugcaauggugccauuguacuccagcaugggcaacugagugagacucugucugucuccaaaaaaaaaaaaaaaaaaaaaaaaccugucacacucaaagcaugauuuuuuuaaaguaaaggaacaaaaacucuuuggucccuacagucauaucucacagaucuuaacaaacaaguuccuaauuaaguaauaauacauaaaacucauauuggcccaagguaggaucuagauguuuuagaaacuagucuauuggcccugacucagaccacaggugcucacagccucaggcagugggucccuuugacagcggaaggacuccugccuugcaaagaucauucacgguauuugucuacucgggcauuuggaggaauuuaucugagagaucucuguuccucuguggcccugacaugucuuuucuccucuuguauuuucacucuuacuuuucuucuuucagcauuaggaaugcuuuccuuuguucaagccagcccacuguguaaucuuaacaacauucauaaaagggaauucuucauacgugcccuuagcucacagcgccccgcgucaaguucuaggaauccaugugugaggaacaaagaggauuguuucgucuguaaauggguuauucugacaacagggcaauuuuggcuucucucuaagcuucacaaagcuuugcagcacagcccuggcaaggaaucacaaugacaauggcugcacugaagccacacacuccaugugcagggccggaacaugauuaaagcaaucaaaugcacgagguuuagagaaugaacuguuacaaauuacaaguuugcagggggagaggauuuggaagucuuuacucaagguucaagcauuauagcaaauugugucuaauauaauaauauuagauuauuaauauuauuguagcuaaacuuuaacgcuugugauaaaacacgucagauuuaaacacaucacuuuaaauagaauuccaaggguuaggucuuaucuccauuuaggaaguggggaaacugaggaaugagguuaugaaaacugccuaagguuaaucugcuggugagaggcagugauggugcuggaauccaggccuccuagcuguugcuuccugccucaucuucuuccucuuuuuagcuucagcaacaucacauguugccuggagacccacugaauguuggauucggaggucacuuagagguuacacuccccuccccuucuucaccuuaugggugaaaaagcagaggcuugggcaggucacuugaguugcccaaggccaauuuagguggagcuaggaguacgaccuaagucuccugagauacagcuuaauaggcugucucccacccaggguuauguguauacucuuuucauccaauuaauuuuucagccaacagcuacauccuuucauuugagcccugugcuuucaaauuacaugucuucccacucaaagaagugggacuaaauccacagaguuuugcaagcuuaaaggcaccucuuaaagaucuggaagccaccaguauuauucauauaaauacagagccaggagacggaucucuauauugcuuuagguaaaucucuucuuaaauuaaaacacagauuauguuacagcaagucauuaagagucauaagaggcaaaagugagacagugaauugaucaaaucacccacagucauggcgcagacaucaguuuaggcaagucaucauuuaaccuaauugaagaguuaauacuuccuacauucuuuaccuucaacuuauuuauuucuggcccugaguauuucagaugugcuaagugcugcccugagaacuccguacucacaacguuccuuugcccuuucuuaauccuccaaugacauuaccagugagguucuguuauuaaauccauuccauagucccaagagacugagguuuaaagaaaugaagcaaccugccugagguugcugaagacuuuaccugaauccaggugauccaggugccaggggucgguggcggacgacaugggggagagggucagcggcgaggccccgcaguuggacuccaccagcucgcccuggauguggacgugagccgaggcguuugucugccucaaggcggccuugagaggggcgaucugguugaacuggacucuggagaggcaaccagugaauccugggguguuguauuugugaaucucuuggucaauuuucccuguuucuaaaagaaaaaaagaaaugaaaauguuacuugacucaccauaguccagcuguacaacauaccugucuuugaaugcuuguguccaaagcuuacauuuagguuucaguuuaagauguuacauuguuuuggaugaaauauuaaugggucgauaagauuuagggcugcauacuugacuuuaaaggaaccuuguguuaacagaaaauacgguagggugaaaauaagacuauaugugauaaaauacauuucucaguaccuucuggcuacuucagacgcugccgaaacucacaacagugacuugguucugauugauuuuucuccuuaucuuuucugaugcuucccugacccucuuaacaaauugaacaaagcagcccugcucugcccuccuggcaaaauaugguucuguuuuagaucucuuacuuauuuucuucuucagaauucuuuaaaaaaaaaaaaaaaaaaagaacaagaauucuaguagccuguacgugaacaucuccuuucuucaaaauccaauccccuuggaauucugagauuuacagaauccccggcuagugucugauggagguuuuggcagucaggaaacuuucccaacccaaucaaucacaaacaacacaugccuuggugaaucucaccaucuccccacuaccuguaggcucaacaucuucccaaacuaacucagcucagaggugagacugaguagaggcauuuccaagguaacaagugcaauguacccacacguuguuauaccaguuaaaucaauggcccucuguuccaaguuuuagaaacuaacagaaacaaauguugaaagaguccuuaaaugcuuaagagcccuuagcuagugggccaggcggacugaccucagagccuuuuaaccacuacugggaacugugugagaaagauaauuccagcggcagcacugcgauugcucugagcaagugccgcaucaaccccucaugucccugccgacucccugggcucacacaaagauucuuuugccccggcgcugaggcagggugcugugggggacauggauaaagugccuuguucuucuccagcaucucucuacgcuugcuugcccuuugcugaagccguucuguuaucuauugugaaccaguguuaguuuugucuccucuuuuagagcuggguagaaaacuugugacucccgcuccauuucauagggucccugacaguuuucgcaacuuugaggagggcagguuucccuaugacaccacagaaaaucaauuguuucaaagccguaucugucugcggggucucaauuuaacauggagucuacacuucuuaaagagcugucuuccccuugguaucuccuucugagguggccucaagggagagagccuggggcacgggguuccgaugguggaacagggagagaaaccacggguggcagcagaggcucccgggcccaggccuguggggcugugagcauuggcagaagcguccacugagcagccagaagcuggggcuggauggcaggaaugagcccuggcaaauggccugcucucacuuuuccauucucuuugggccucuuucacucucuucuuuagcuuucuccuuucugugccuucucccuauuggggaaaauucccaguguuucaacuguuguuucuuuccuguaaggcagcagggucacaaaaaggaggauucugaugcccuggagaacagaaccaguacuuccaaaaccggaguguguuccacaucuaguugaugugccucuuuccuagagacccuuggcugggaccaauuccccugggggggggccaaugugcaguaaguagaugcucuggaguuugcaggaccugaugguuccaacucagggccaugugauaauaauauugauacaaugguagagaaagguggcagagaaaaucuaggcagaaaggggcgggucccugucaaacccucacccucaagccagaaacugcagcccaaagugagaacuuacaucccuguuuuccagcucaaauguugccuuuuccaaaaccacccaugggccugcccccugacauccugugccuauaaaaaccccauacucagcuggcagagagaagagaagcagcuggacguuggugacuaugguuagacauuggagagaagcagcuucacuucagagggacagcuugacacguaacaucagagaagaaucuggccagagauggcuggacuucaggagaagauuaccuucccucuccauccccuuuucaacuucccuuccugcugagagccacuuucaucggcaauaaaaauccccuacauuugucauccuucaauuugugugaugucauuucuccuggaugugggacaagagcucggaugcugcuaguguggcuacaaaaggcugucacacuugcccuuuguacucacuggcagaaggcagccagcuuacgugaaaagccacugagcuguugauacuuaggcugucuggggacagcagaacuaaaagcacuguaacaugcccucuggggcuucagggguugcaggcaccaccccuagaugcugccacggagccugcacagaguucacuccuguuggcgcucaaaagcgcucacccuggcuccugcacccacucacccgcgugcuuaccccugcaagggguggagcacaguggguccaagugaguggcguuugcuccuggcaguaccuaaguggcuggcugguuucagcauucaugcacuccaguuccugccucauucacaugcgugcuuccucccaugaggaguugaaagcugugggcuggguaauugagggcaccccuguugcaagucccacaaagcggucagggaagcauccugcuucaauauuagagcacagaccaagggcaguacaugauggggggcacugugcuuaguacuuauuaugcaguaucccauuaagucuccugguaacccucugagcuaaauaggauuacccgccaagugacagaugagggaaacgaggcuuagagaaguuaaggcuuugccaaugaauaaacauuuauguuucauauaaaaaaaaaagaagucaaauauuuugcaucagucucaauuucucuuugaaaaauagacuauauuguuuuauauucauguagacuuuugauauuucuagucagggaccccauagaaacgguagagugagguuuucagaaaaaauguaaaugguuguuaaaacugcuuugagauuguguuucauuagcggcugagccaacaauuugauuuucaaaaauguggugaacugaugucaaaucuucauuagcaucauugauagcaccacaaaguuauagaaaugccugucuggaauaagauuccauauuucuuaagaacaucuacaaaugacaguauagcuaucacuuuuuugaauuuauuacaaguaaaguauguuacucuauaauugauuagacuggucucuacugaaaccaaauauuaaaauaucauuuacuguaagaaacaacguucugccuggaggugucuuggguaagguguuauuugugggggaaacuugcuuuaaaaaugcaaauuuuagaaaugcaguacaaucacuuuaaaaugagauucucaaguggcaaucaguacguuaaugucuuauauucauaacgauauggauuacagaaaauaguucacuuaaaacacugacacaauuccggguaauacguuaaaaugaaaugcucaugacaguccuuuuaaggaaaugcagcaacuccauuugcgaugcauuagcaugcuuucccgcuccuuguucaguuacugaaugccaagugagaggcgggaguguugugagaaaugaaagagaaaagggcaccugagcaggaaacacugggagaauaaagccagcuccacggaggacagagcugugcuuggggccucguguacaugcuugagcuccuuuucagcgauuggauaagcauuuauuuauuuggacagggauuuauuuauuuauuauuuaugagacagggucuuacucugucauccaggcuggagugcaaggcacaaucucagcucacugcagccucaaccucccgggcucaagcaauccucccaccucagccucuuugaguagcuggaaccacacucgugugcuaccaugcccgacuaauuuuuuuuuuuaguauuuuuuuguagaggcgggguuuuguuauguuacccagguuggucccaaacaacuaggcucaagcgauccacccaccucggccucccagagugcugggauuauaggcaugagccacugugcccagccuggauaagcauuuagaugugacuucucaaaggagauuucuucuuuuccuuugagauuauuuaaaugcaccuauaucuucuucuuguguauuccaugggaucuauucaccagaugauuuuuguuagguuuuauaucuuauaguuuucuaucaauguuccuuuuuggggagggcgaugugauauuaugagauacaaagaaucacugucaacuucauuuucuacuuuuuaugaaacaggcagaagauuuuagggcaucagugagacuuaauuuaagacuuuugauaaguauguacugugugcuccccagugugcuagggauuguggaagucacccuucauagaaucuguggggucaacacagauggccaaaccugguuccagcccugacacagcauaugguugcucugcagagacuguaguacaacuggccccaaagcacugccuaccauucuguuccuucccucuguucuggggugaaguaugucgcacugguggcacugggggucuuuagguaauucacagacugggagcuaaauaacauccagucuuauuccuuccccgauucccuuucaauuucucagagucucaggccggcucaguguggggcuggacuaucuuuauuauggugccaauacuugcuauuuucccuuuuuaacaaagagaggucagaccucagaccuggaugcuucggugggcaacagugcugaguuucauuauauuuuuauauuacguauuuuuagcaccaccguaucgugacagcaagcgguacuggcauuucauuucaugguaguauugcaaaauuucucuuuaacauaaacuuuuuaacauaaauuuauuuaaguaaaaauagugaguccauuuaaaggaaaauguuaaguaaacaacaguaaaggaggccacuagaaaugguaaaaaugucaucagaaauggcaaaaaucgugacauugguccucaaaugacucuuguuuggggaacauuguuguggaggaguuugacgucucucuaagucccuggauguucugccuuagagccucuguacuauucagguguaauccacccucuccccucacacuuaguaccagucacuauccaucacuuuagaacaccagagacccccgcugaguggggcuuccuccuggauucugcucccggcucuaccuaacuggaccagguguguuccugcucucuucggaugggccagaggcccgcaacugugccuuuccuagaauuaaaguuuucuugacagcugggacuaaaugucacuucucuuuguguucccccaaaauaaugccuuggacaaaguaaucaccagugacuguaggaaugaauauacagaugcuuuucaacguauaaugggguuaccuccccauacacccaucguaaggugggaauauuguaaaucaaaaaugcauuaaauacacguaaccuacugaacaucauagcauagcccagccuaccuuaaacauacucagaacacuuacauuagucuacaguucaguaaagucaucuaacacaccuauuuuauaauaaaguguugaaaguggaaaacagaaugguuguauggguauucaaaguacgguuucuacugaacgcauaucacuuuugaaccaugguaaaguugaaaacuucuaaguggaaccauaagucagggacggucuaugacugaaaccaucuauucagcagucugucauucauaguuuggugugugggaggggaucaaguacuauggaaauuagaacaaucauaguuagcuauagucaaaguuuguuuuucagcuucauaguguaaacaggugcagaacauaaccaggaaagaggagggggaggucuucagcguauucaggaauucagcaguguauucagaaccaguagaucauuauauguuauuucuagcaguacuauuaccugaaaaucuguccgucucauuaaaaauggauuugucuuucaaaacguuguuguauugcucuaaaacugacacccagaggaacugauaaauuucucuucuaugaaggaaggcaggacuuaacacugaacacucauugcuguauaaacccuccacaggccucacacguagaacagugguucgacgguaccuuguggaauaaguagaaagucgguuugaaaucacugccugggugguuuuaaauacuccuuggaaaaucagacugaaguacaacaggugaguggucaccugauguacacuugaaaacauggccaggcacugcugggccagcaccugaagcucccaguggcucccagugucagggcuggucaucugggccucuuggagagagagaaauagaauuugcauugaucggguaggauuccguuuuuccauucuagucccauuuggccguaggugaaugaacgggagucuaaaugguuaguggaauaaaucaaugggaaguaaccauaacaacaacaaaaagccaagagcauucaucuaaaaaaagcaacauaaaauccgauaagccucauuccucaguucgaacgugaucaaaugguaaacaucaggcagggcauggaaaugcuggcaucuagguucccugucagcuccugcucuaacagaaugcaguuuuugaucagugaugucuugcucaucagcugccuuuccaaagaggcacagccagaauuaaaucuggauccauaauugauguauacgauuagguacugugacauuuuauucaucccuuaaauaaagacaugaaugaaauuucauuguauuuauuagaugcuuuucucucuuaugaagaaauaugcaggacuaaaauaugcagguguaauuuaaauaguucuugaccuaugaaaugcacuaacucaauuaugcagaggcagaaugcugggagaagcagaaucauuuuuccuucuagugucucuaccacauuuugaauuuuaauuauuuuuagagacagggucucacugucagccaggcaggaaugcagcggugugaucauaggccucgcuguacccuugaaccccugggcucaagugauccuuucaccuuagccuccuaaguaccugggacuacaggcgcacaccaccaugacuggcuuguuuuuaaaaauuuucuguagauacagggucucauuauguugcccaggcuggucucgaacuccuggcuucaagcaauccuaucccccucagccucccaaagugcuggcguuauagaugggagccacugcaccuggccucugcugcauuuuaacucauaaaucuuuuucuaaggacugauaacacaaaacuggauuuuuucuuuccagagucaacaauaaaaagaaaugucuucauagagcccacugcacuauuuugcaaaaagaugaaguauuacauuuuuauuuguaucaauuuaucacagcuccugagcuuuuggggauacuaaauagguugaaauugucacucacguuucuuuuuuucuuuuuuuuuuugagauggagucuugcucuguuacccaggcuggagugcaguggcgcaaucucggcucacugcaaccuccaccucccagguucaagcaauucucugcaucagccucccgaauagcugagauuacaggcgcccgccaccaugucuggcuaauuuuuuuuuuuuuguauuuuuaguagagaggggguuucaccaucuuggccagguuggucuugaacuccugaccucgugauccaccugccucggccucccaaaguguugggccuggugucauucgcauuucuaaaaucuagacugaaaacaaaaaacuuaugauugcuaguuaaucuuagaauauaguuguaauggccgggcaugguggcuuacgccuguaaucccagcacuuugggaggccgaggcagguggaucacgaggucaggaguuugagaccagccuggccaacauggugaaaccccaucucuacuaaagauacaaaaaauuagcugggcguggugguggacgccuguaaucccagcuacucgggaggcugaggcaagagaaucacuugaaccugggaggcagagguugcagugagccgagaucacggcauugcgcucaagccugggaaacagggcaagacucugucucaaaaaaaauuguauauauauaauauacuauauauauauaaaaauauauauauuuauauuuuauauuuauaguuuauauauuuauauaguuguauauauacauauauguaacuauauauaguuuuauauauaguauaacauacauauauacauaacuauacauauauaguuguaauuacacaguaccaaaaacauugacacaaaagagaauuuaugaucccuuaaauguuucccaaacaccagacauuuggaauggguaggagcacacaucugauauguggauuuuccacuucuuuccuggauguuucaaguugucagauguaagauagaaagccuggaaggugcuggugccccauuccucagccucaggugcccugucacauggcaugauuuuuuagggcuaagaauaacaagcucugcugaaaguaacaagaccuuucagaauaauggauguaccugucacucaaaccacagagcugggugcuaugauuuacuucaugggaaaucaggucugauuugacuucuucgaaucccaguaaauugaagcuauauguccuggcuauuugcugcugggaaacagaacacuaaugugcguccugaguuucucaugagcugggaaugaacagaccugcuucuuacucauuggaauguuuccacuuuugcauuuuaucuugauagcagcagaaauagaauccuguguacgaaauuaccaacugaaauguaguacagaaaaauaauuuaucucugugugugcuccgcuucugcuaaaauguuuuuuuggcuuuggagaaccacguuaaacucuagccaacaccauacaaaaaaaugagcuucaguuuucaagcuuuuccuuaauuccucuccaagccacugguagguaugccggccaagacuagcagagggucauuugaaacuaacucuggacagcaggagaauuugcgacaauggggaaaaaaggguagaaagguguugaccucauacauuucacaagcagcauaacaaaguguaggcuaggaaaaguguguuagcaaauuuuuguauuuccagauaaugucaaguugaaugauucaguaaaacagaaaguaguucacuuuuuauuuuucuuccuuuguucucaguuguauuauaauuccuaucccagaaggccucuaaagcuaucuuacccaagagaagaaaaaaaaauccuuugaggacuaagaucgcaugaaugcauaaacaucacgaaauggaccugagguagggauugaaagcgaugguuuccccagggccaugagccagucaagcacacgaagaaacugagagggagaacuguuucuggaaaguguauuggaugguucccuuaacugacgcuccaugucacauaauuaacacaagaaaaaauuagaaucucgggaccuugccauauaaaaugauguucagaaaacagagccuaaugcuuugaggcugaacuugaagcuccaguggaucaucacaaaauuuaaaccauacgaucgcaaccacccuggaugccaccaagggacacaguccggagacccacugggaggccuuuggauacuucuuccugucaacaccuauucucacugcugaaccccuaaagccaguuccuuuauuuucagauugggguaauagccuccuaggugggagagcacugagagaggccaucuaaauuucagcaaagcauuuuaguaaguuucucaugacauuuuuguggucaagacaaauagauauggucucauuguaauauguuugaguaguacagucaggcaccacauaaugaugcuuuggucaaggaugaaccacauguaggaggguggucccaggagauuauaauggagcugaaauuuuucuauugccuggcauuuaucauaaugugcuuuuuaucauuauuuuagaguauacuucuuuuuuguuguuguuguuuuuugagacugagucucgcucugucguccaggcuggagugcaguggcacaaucugagcuaccacaacuuccaccuacuggguucaagcgauucuugugccucagccucccaaguagcugggauuauaggcacccgccaccacaccuggcuaauuuuuguauuuuuaguagagacgggguuucaccacguuggccaggcuggucucgaacuccugaccucaugaucugcuugccucagccucccaaaguccugggauuacaggugugagccacugcaccuggccuacuuuuuuuuuauuuuuuauuuuuaaaaaggguaauuguacaacagccucaggcagguccuucaggagcuauuccagaagaaggcauuguuaucacaggagaugacagcuccaugugugucacugccccugaagaccucccagugugacaaggugugcagguggaagacagugguauugaugauccucacccuguggaggccaaagcaaaugugugcauuuguguccuaguuuucaauaaaaaagucuuaaaaguuaaaaacaaauuuuuaaauagcaaaaucuuauagaauacgcauauaaaaagaaauauuuuuuacagcuguauaauguguuuguguuuuaaucuaaguguuagacaaaaauaugaaaaagugaaaaaguuugaaaacauuaagaagucuauaaaguuagaaaagguacaguaugcuaagguuaauuuauuuuauuuauuuauuuauuuugagauggagucuuccucugcugaccaggauggagugcaugcaguggcacaaucucggcucacgguaaccucugccuccuggguucaagcaauucuccugccucagccucccgaguagcugggauuacaggcauaugccaccacaccaggcuaauuuuuguauuuuuaguagagacgggguuucaccauguugaucaggcugguuuuuaacuccugaccucaaguggucuacccuccucugccucccaaagugcugggauuacagacaugaaccacugcacccagcugguuaauuuauuauuaaagaaagaaaauuguaaaagguaaauuuaauguggccaaaguguccagugcuuauaaaaucuacaguaguauaauguccuaggccuucauauucacuuaccacccacucacucauccagagcaacuuccaguccugccaagcuucauuccuguuagguguccuauauagggguaccaauuuuuacuuuuauuuuuuauuuauuuuuuuugagacggagucuuguucuguccccaggcuggagugcaguggugugauauugacucacugcaaccuccaacucccagguucacgcgaugcuccugccucagccucccgaguagcugggacuacaggcacacaccaccacacccagcuaauuuuuuuuguauuuuuacuagagacgggguuucaccaugcuggccaggcuggucucgaucuccugaccuugugauccgccugccucggccucccaaagugccgggauuacaggcaugagccaccacgcccagccaauuuuuaucuuuuauaucauauuuuuaccauacuuugucuauguuuagugaacaaauaccguuguguuaccguugccuacaguauugagugcaguggcgugcugcacaugucugcagccugggagcaaugggcuguagcacagagccuggguguguagaaggcugcaccuucuggguuuguguaagugcacucugugguauucgcauaaugaugaaauugcuuaaugacacucuucucagaacguaucccugucguucagugaugcaugagaguauuuuaaagguagauuaaucaugagaugaacagugguggaauuugauaaauagguagaaauuggcuucaaggagaauuuuaguggugauuccaagccuacauuuaaucauuuuauuaacuuggauaaagacaucaauggcacauugaugaaugugccauauggcauuuaguaaaaagggauggcuccacucaagaggacauuaucgugagccaaagggacuccgagaggcugaaaugauuucccuagauauaacuaaauacaguuuagcagaaacgaauaaccaauuucuauauuuggaaaugccaucgugccuucccccaccccaaucaccuucaauaccaaauuguauaggacacaccugguaacugcacguagccuccucucccccuccuuuguugggacaauggggcugauagaagaaaacuggauuuuuuuuuccaguuuuguuuuccagcaaccccucaggacucugguauuuuuguuaauuauuugggauuuaggaauuaagagugagaccugacugagucaugaaaaggauggagucuauauuccaauuuagaaagugguuucugagaccauccccugggguggucagcauaccccagagaggugaucaguucuggacagagcaucuugagcaggaaagcaauaauaaaccgggguguguuuugaggauggcaccaugcuugagacggugucaugugaagcagacuggaaggaacuguggaugcugaauguggggaagagaagacucuagaagcacaccgucacugccuucagguguuggaaaggccggcaccagggagaaggcugagacuuguucuguggggcauuaauggaaggaugcucaacuggaucuuauacugaaagcaaauaugagaucaagucugccaggguagguguggagaaaguggcccuguaagccaaggggcuauugaguucaauccuggaugucauuccagcugguggggugcgguggaaacaccagggaagggcagggguagggggggaccagccaugcaggggagaaggcaaguccucagaccccuguucuguguggcacugugcggaagaggggaaggcugccucacuucacccugugugccaguccuuuaucuaacuaaaucuccacagaaaauccacaagaugggguugaaugaccuuuuguuauccagaaaagaaacagccugaggaguaaagucaccugacugaggucacucugcuagaagguggggcagggauucagcccccggugcugucccugacucucuuucugcguggagggauucaggcucagccuccaggaaccggagaccagagcucccuaucugggacccagccacugagacgucaggucacaaagauggauagaaccagaggcacuggggagccggagagcuuuggaaaugggcaucuuuauguccuucugccucagucuagagcugagauuugugaaagggccaaaucagggguaggaagagggugcaguguauccuccgaggugggaggaggccgggccauuugaccauaucuuucucuucagaguucacuguucccaaagacacauuauaugucauccauuuuuauauaaauggugaguucccaaaugggauuuaaagacagccuagcaaaucuuuacaucccuuggaacuuaaaacaaagcuuuuccuucacagaauucuaaucucucuugaauaagaggcuacgaaacugagggacauuauaauaaccuucauuuaaaauuagauucuggauguucuggugacuuagcugaaaacagcucaaaucagcgaaaaccuuuacaaagacuuuucgaaaguuggaagacauaucuguacacacagggcguagagccggacuuggccaguaugugccuucugccuccuccuggcaaugcuuaccccuuauuacuguuauuucugagacgugaauguuuucucauagugaauguagcaguaauaguaauaauaauaauaauaauaauaauaauaauaauaaugauaaagaacagcaacauuucucacaaacccauuuccugaguauuagcagauuugcuacugggccuugguuccccuuagaucuuggcuuaaaugaaugcuuaauaaugauaacagaggcugggugccaugucuuauguugguaaucccagcacuuuggaucacuugaggccaggaguucgagaccauccuggccaacauggcgaaacccugucucuacuaacaaugcaaaaauuagccagguguaguggcacaaauuagccggguguaguggcacaaauuagccagguguaguggcacaccccuguaauuccagcuacuugggagguuggggcaugagaauggcuugaaccugggaggcggagguugcagugagccaagaucacagcacugcguuccagccugggcaauagaggcacucugucacaaaagacaaaaaaaaaaaaaaaaaaaaaaaaaaaaaagggauucaauuuuaauuaaaaaaaauauaaaaauauaaugguaacagcuaaagauucuugggguuauuaccauguauuagauguaugcuuagcauuugaaacacaaugucuuauuaauguuugugagagaagagagacagacccucucauauuguuuuauauuguucuauaaucagaaaaggaaagagaagcgaaacuaaaggcagguagcccagugccuaggaaccagacccgaaaccaggccugggcccgccugaccuaagccugguaguuaaaauucgaccccugaccuagcaacugauguuaucuauagacuccagacauuguauagaaagacacugugaaacuuccuggucuguucugucucagucugaccaccggugcaugcagccccugucacauacccccugcuugcucaauagaucacgacccucucacacggaacccccuuagaguugugagcccuuaaaagggacaggaauugcucacucggguagcuuggcucuugagacaggagucuugccgaugcucccggcugaauaaaccucuuccuucuuuaacuuggugucugaguuuugucugcaauucguccugcuacaucugcagcaccuugcuauggcugguacaauuuuggacccauucugauugucgcucacuguagugaaguaacuugcccagaaucacaugagcuaggaagugccagugcauaaaaccaggaaauuugcccccaaaacucaugcucuuaaccaucacucuaccaguuaagacauuauccagaugccuggagaccaggggaggccucagcugggagcuacuucuagaaaguuaagaacugccuggggcucugcagaacucucccugcauuugcagauuauacuuaauaccuaacucaguuguagccgccagcaacccccaccccucaacuugcagauaauccacuuuaacugaagaugugucccccugcgaauugguaauuacuccuuguggcacugucagagcuauucaaaggauaagagacaaggaagaacaaagcuaaucugagccaggcacugaagcugcagucgucucuuagacaccuaaagggagugacuuccauggcucagaugugguguagagggcuguugauuuucauuuuacuuuuaacaaaagaugaggggcucuaucugaaauguuugcuugggggaucuuaauuuucagcucugacaaugcucgcugugugcuuauuuucucagcugggcacauucucuaguccuaucauuaccgugacucuuuuaacugucuguacauguugaggggacuuccaucuacacuucaggaggugcaaauuacaguggcuguggcaccucgaagaaaauacauuuucucgguaugagcagucauuuucucuuggugacauguugcguacuuuguuucagaacagaugagagcuuaaaauauuuuauggggcgaucgcauuaaucucgccucuaaaauauguuaucaugacucuuaggcaucuugggggaaaugaaucugccuagaaaauaugguuuucuggauaacaagagaucuaguucuuuuggcaugagcccauuucaguauuuccagcugaauaucugucuagaaugcuuuuuuaaggcaaagcagacgccaaaucagggucaugugaugacuuucacaggcccuaggcacuuuugcuuucaagguuuucuuccuccauuaaaaaaaaaucaaaaguaauauuuuaggacuguguugguauaaagaugaauauaaugauauuauguauuaacauauuauauauuagaacauuuuuccuuugacuuaacaguucauuuuuuucuucugauuuuaaauguuauuagaacacuuuugugggucccuggaaguacugugggccuacugaaccccauggauauguuggccccugccaaacauaugugaugguuuuucuuuucuuuuauuuuuuuuuugagacagagucuuguucugucaccaggcuggagugcaguggcuucaucuuggcucacugcaaucucugcuucccagguucaaucgauucuccugccucagccuccugaguagcugggacuacaggcaugcaccaccgcgcccagcuaauuuuuguauuuuuaguagagacagggcuucaccauguuggccagaguggucucaaucucuucaccucgugauccgccuuccugggccucccaaaguguugggacuacaggcgugagccaccgcgcacagcugugaugguuuuucuuaauggcuugaagcuuggcugggaauauuguuuugccaugcuauggagacagcuggaaguagcccuggauuugcauuuuugaagaagggccugaaguugccuuuuuuuuuuggggucauuuuccucugucuuagacagguggugaaaacucugcuacugacucuacagcaugguugccuuucugcaaaaguaucuggaaaucacaaacugcaugauggccucuuacuccuggaaaucaucuuuguuaucucuaccagcauucuuuaauuugugagcaauuuuaaaaguaaaauaguuauugucuucaaaagauucuauuucuuuagccgugaugcuaucugccauucguauaaguucuuuucaacauguggucuugggcaaggauccauggaaaaauuguggacuuaauuuuauagaaagagugaaauaaaagucuuacacagaucaacuuuguuauggaaucccauucauuuaucacccacacaaggaauuauugaguaucuauuguaugccagguggugaggauucaauagugaaaaagaguuucuaccuucaaggacuacauaauuuaaucaauauugcuaauucugacauuaugcuugacagauauguauacauaauguauacauacauacauauauacauguacacauacauauauacauguacacauauacacacauauauacaugcauacacauauacaccuauauacaugcauacacauguacaccuauauacaugcauacacauacauguauacaugcacacacauacaugcauacaugcauacacauacaugcauacaugcauacacauacaugcauacaugcauacacauacauguauacaugcacacacauacaugcauacaugcauacacacacaugcauacaugcauacacacacaugcauacaugcauacacacaugcauacaugcauacacacauguauacaugcauacacacauguauacaugcauacacgcauguauacaugcauacacgcauguauacaugcauacacgcauguauacaugcauacacauacauguauacaugcauacacauacauguauacaugcauacacaugcauguauacaugcauacacaugcauguauacaugcauacacaugcauguauacaugcauacacauacauguauacacguauacacauacauguauacauguauacacauacauauauacacguauacauauauauaaaaguauacauauauacauauauauacaucucaaguauauaugagauggagucucacucuuuugcccaggcuggaguacaauggugcgaucuugguucacugcaaccucugccucccagguucaagugauucuccuguugcagccuccuaaguagcugggauuacaggcacauucuaccaugccuggcuaauuuuuguauuuuuaguagagacgcgguuucaucauguuggccaagcuggucucgaacugcugaccucagggagucugcccaccuuggucucccaaagugcugggauuacaggcaugagccaccacgcccagccugcuagacaguaauauuauuuuuugacugaauuaauaagugaaagacaaaaaagcuacuuuuuucaggaugagcucaaaaacuaguugagcaauaagcaaaaugucuguccuuugcuuaaagaaagccucgugcucugaaaugauauuuuaccaagaaaauaaagcaggagaagggagagagugagacggggagaugcuacucuagguagcaggagcagggaaggccacucugaggagauuacauuugagcucugagccaggugaaaguguguccggaacugguggguucuuggucucacugacuucaagaaugaagccgcggacccucgcggugacuguuacagcucuuaagguggcgcgucuggagucagucccuucugauguucagauguguucggaguuucuuccuucugguggguucguggucuugcuggcugaggagugaagcugcagaccuucgcggugaguguuacagcucauaaaagcagcguggacccaaagggcgagcaguagcaagauuuauugcaaagagugaaagaacaaagcuuccaaaguguggaagaggacccgagcggguugccaaugcuggcucgggcagccugcuuuuauucucuuaucuggccccacccacauccugcugauugguagagcccuguggccuguuuugucagggcacugauuggugcguuuacaaucccugagcuagauacaaagguucuccacauccccaucagauuaguuagauacagaguuuccacacacagguucuccaaggccccaccagagcagcuagauacagagugucgauuggugcauucacaaaccuugagcuaaacacagggugcugauugguguauuuacaaaccuugagcuagauacagagugccgauugguguauuuacaauccuugagcuauacauaaaaguucuccacguccucaccagagcagcuagauacagagugucgauuggugcacucacaaaccuugagcuaaacacagggugcugauugauguauuuacaaaccuugagcuagauauagagucccgauugguguauuuacaaucccugagcuagauauaaagacucuccauguccccaccagacucaggagcccagcuggcuucaccuaguggaucccgcacuggggcugcagguggagcugcccgccaguccugcaccgugcgcucacauuccucagcccuuggguggucgaugggacugggcgcuguggagcaggggguggcgcucgucggggaggcucgggccgcacaggagcccauggagugggugggaggcucaggcauggcgggcugcaggucccgagcccugccccaugggaaggcagccaaggcccggcgagaaaucgagcgcagcgccggugggccggcacugcugggggacccaguacacccuccgcagccacuggcccgggugcuaagucccccauugcccggggccagcagggcuggcuggcugcucagaguguggggcccaccaagcccacgcccacccggaacuccagcuggcccgcacgcagccccaguucccgcucgugccucucccuccacaccucccugcaagcugagggagugggcuccagccuuggccagcccagaaaggggcucccacagugcagugggggacugaagggcuccucaaaugccaccaaagugagagcccaggcaggggaggugccgagagcaagcgagggcucugaggacugccagcacgcugucaccucucaaaaggaacccaaggaaaaaagcauuccagauagaaggaacagugauugcaaagcccuaaggaaacacacguacagagguuccuccagcaugaaggggcuacaucccaguaaacccaucguacguuuuugagcucacccugcaaaagcaguccuuuugucuuucacuuauuaauucagccacuaauucagucaaaaaauaauauuacugucuuguauauugucagaauaaaagugcauuuaauacacucaacuuaccaaacacacccuaccuuaaaugugcucagaacacuuacauuagccuacaauugggcaaaaucaucuaaugcaaaaccuauuuuauaauagaauguugaggccgugcgugguggcucacgccuguaaucccggcacuuagggaggccgaggcaggcggaucacaugagguugggaguuugagaccagccaggccaacauggagaaaccccgucucuacuaaaaaaauacaaaauuagccaggugugguggcacaugccugugaucccagcuacucgggaggcugaggcaggagaaucgcuugaacccaggagguggagguugcagugagcugagaucacaccacugcacuccagccugggcaacaaaaagcgaaacuccguuuaaaaaaaaaauagcauguugaauaucugaugcaaucuauugaauacuguagggaaaaugaaaagagugguuguauggguacucaaaggacgguuucuacugaauggguauugcuuuugcaccaugguaaaguaaaaauguuguaaguugcaccaucauaaguuggagaccaucuguguauguauucuggcuucccuuuaaacguugaaacauggggcuggagugagaguggauccuccuugccaaagcauagacuguuugcuuucaagcuuccuauuagcagcauugaauuuggcacacgaguaguaagucccccuguuaagagagccacacuugucuguuggauggggcuuagguagugcugugcuccccugcagccugcacgcaguacagaugcaggaagaaugggagauggcuagcacuaugcccuuuaauaagccacggcagaacaucccccaaccucagcaccucagcgccacaaggguggccaccagaccagcauagccaccacagcaaagaccuguaaggauccuauuacagguugaguugugugccccaaaaagcuaugucaaauuaccugugagugugaccuuuuuauggaaagacaguuuuugcagaugugguugauacuguuuggcucuguguccccacccaaaucucaccuugaacuguaauccccacaugucaagggagggaccuggggggacguaauugaaucaugggggugguuucccccaugcuguucucgugauagugaguucucaugagaucugauggguuuuguuuuuuguuuuuuuuuuuagauggagucucccucuauugcccaggcuagagucaaucuuagcucacugcaaccucugccuccuagguucaagugauucuccuaccucagccucccaaguagcugagacuacaggcacgcacuaccaugcccagcuaguuuuuuuguauuuuuaguagagacagguuucacuguauuggcuaggcuggucucgaaccccuaacuucaugaucugcucgccuuggccucccaaagugcugggauuacaggcgugcugggauuacaggcgugagccaccgugcccggccgaucugaugguuuuauaagcgucuggcauuuccccugcuggcacucauucucucucuccugccgcccugugaagaguugccuucugccaugauuguauguuuccugaggacuccccagccaugcagaacugugagucaauuaaaccucuuuucuuuacaaauuacccagucuugggcauuucuucauagcagcgugagaacggacuaauacaauggucgaguuaagaugaggucaucuuuaguuaagguaagcccuaacccagugacuguuguccuuauaaaaagagaagacgcagacacacacacagggagaaaggcagguggagacacaggcagagaguaaaauuaugcuucuacaagcccagaaaaaccaaggucuuccaguaacgaucagaagcuggaagagaagaacaguucccccucugaguccccaagaggacccaccccuacugacacccugauuucagagcucugggcuccggaacugugagaggauaaaucuguauugcuguaagccacccaguuugugguacuuuguuaugacagccuaggagaugaagacagacccugaagacugcguguaaucccgggccccuugacacucuggaaaggagauaugaaggcagagagauugaguauuugccucagagagacugaauucaccuaaaagaaacacuuuuuaaaugagagacuuaguugacuuuaagugcaagcuucaaucuccccucaacccaaaccaagaacauagaaauggaugccucagaacaagaugagacccgauauagaaaauuaaaacaacucuaggcugggcaugguggcucaugccuguaaucccagcauuuugagagguugaggugggugaucaccugagguuaggaguucaagaccagccuggucaacauggugaaaccccgucucuacuaaaaauacaaaaauuagcuggguaugguggugggugccuguaaucccagcuaccugggaggcugaggcaggagaucacuugaaucuggggggcagagguugcagugagccaagaucacgccacugcacuccagccugggcaacaagagagaaacugucucaaaaaaaaaaaagaaaaagaaaaaaaagaaagaaaagcgacucuaacaccuucaucuuuuuacucaucugaauuuaguccauaaauauuuuagcccuuuacaaauuaauaaaaauaauuuuuucccacaaguacuggaacacagaaagggaucauucuggcuuuuucuggugucacuucuguaaguuuggggcuccacagcaugcacuaccuaaaugccuaauuaagaucuuuauaccacuuuaaaaucuuacacuuuuaaguuuuuaaaaguguuuacuuuugaguuuaaaaaucuuacaaagaaguugaucgcacaguuacaaggguuuacugauauuccucacguuccauuuccaauuccgucuccauuuccuauuucagaguuagcauuuuucugagguuggugagggcuguguuucaaaacuuuucauuuggagaagcaauuuccuucguugcuucacaccuguucucuuuucuucaugccuguucucuucaccacucaauugcuugguaaccucugaguuccuucuucuucuccuucuuccacuccuuucccuaaagaguuugcaugucccgaagguuuaauuuuaguugcagaauauguucuuggucuaggugaggccuggaauccauguguuuauuucggagcagucagcuaggaguuguugcuuguuguaucauuugucacugccuugcuguuuagcuuauucuuaugcucuaaauuaaaugugagcccccuucccuuucaguccagccaacccauggcugccaaucugcaguuuuugccauguucuaaagggguuuauggacucuuguagaaacugcagaaauaaagauaacuucuucucgagauccccucuguuagaaaauuuuauuguauuuuucacaucuggagaaaaguccucaauuuguaggaucaaaccacaaaugguuuaaaguaauaaugaaucaaaagguauugugaaugcaccugaauaucccaaacuaaacaucugaaacuaacgacugugauuuccuauguaucccagggcagugagaaauauuuucuccgcagcuagugaaauucaagaacgcuucucucuuuacccugcuguuaaaauuuauacagcaaaagagacagugugagacaauuaaaaaaauuuccugaaaguuuaauaaguugaaacuguccuacugaguauguuuucugaauggcuuuccaaaagaagacauuuuucuuaaaggaagcuugcagagacucugaaauauuccaucucucuagcaauguaacuggcugcaccuugaauuucuaaauucugacaaugacccauaggcuaaaggcacacauacaaagaaugacuaugucacacggaugccacucuggauauaagagcagaaucuccagcucucccuacaaaaaggcaaaacaaugucuucaaauuuaguauacaaaauacaucuccgaauugaaaagugugcuuauuuauauuuaagaagggaggcuuugccuauauugcaacuguagcaaguacuaguuauguguugcuuagugauggggauacacucugugaaaugagucuuguuaggcaacuuuguuauugugggaacgucacagaaugcacuuccacaaaccuagauggcagagccuaccacccacuuaggcuauaugguaaggucuaugguuccuagguuacaaaucuguagagcauguuauuguacucaauacuguaggcaauuguaacgcaaugguaguauuuguguaucuacagguaguuaaacagaaaagguacaguaaaaguaaccauauuauaaucucauaggaccaccacuguacacacagucugugguugacugaaucguccuuacacagcacaugacuguauuucggaagagcuaaggaguccucaugcuuuucucaaccuuccucaccaaucacacaggaaaaaaaaguaacugaugucuuaagugcacauuuuaugcagggcccuaggcugagcaauuuacauucauuaacuucuuuaauuuuuguagcuccucugugaaauaggugcuauuauuaucuucuuucucauuuuacagaggaaacaggccuggagaaguuaaauacuuuaacccuucuguuacucugcuccuaacugcuuuauucuaaugcauuccugauuacgcgcuugaaagcagaauaucuaaaggcugaauaacagauguauuaaaagggaggccuguucuauuuccagaaaguuaaacaaaagcauaggaccccuaauugcgguuucuacaggugcuaccucucucuagcccagacaacaugguaaguggaugagaccucaccaggcucccagcgggugaacaggcaggccagccauccucacucacccaaaagccaucccuucucaugcaaucuccacauucucaaaugcucccgucucccauuucccucaagccagccucauuuccagucugagaguucuugccauggucucauggcugcccgccaucuugccuucuuccccccauuucauccuccaccuggcccucagggggauguuucugaaacugcguaggauccucucauucugcuucagugacuaucucuaguagaaagcacaggcgccucgaaaugaugaacaagucucuuugugcucugacccacccugcuucucccagcccccuggcuguguguucccucagacacucccucagccagugauacgaccaccuugaacaccccuaggcugaaccaggcacgcuccuuuuggccucuccaguguagucaggaguaauagggccugcuacaguuauaugaucacagguuuuucucccugacuagauggaagcuucucaaagaaggugccauauuuucuugucuugugucuucaucacauaguguagggccuggaaccugggccccacaggucaggaguaaaugagcauguguuuuuccuaguuacacaacuuugugcuuguuugaauacuuguuuugaauuuucugcauacaaacauacacaugcuaacuauaaaguaaucauuuugauuccauaugcauauauuaagucacacuuccuaugugugcauacaagaauuuaguuggaaucagaaauuuuauuaguaugcucuauacaaaaggcccugugcuuggcacugugaggcacagagaaacaguuauacuacaauacccugcaggaucucauagucaagaauaaacacugaccgaggcaaaauacagaaggcuaugaugcacagucacaugaaggacauccagaggagagagcuauggaucuagauuggggcacaggaucaagggaagccugugggugucagugccaacugaacugaucauugaacgggggcuacaauuugcaaagagaaggcugaugggagagggagaugggccuuucacaaaaccaagaaaucaaugagcaugugugguguauuagucuguucucaugcugcuaauaaagacauaaccaagacuggguaauuuauaaaggaaagagguuuaauggacucacaguuccacauggcuggggaggccucacaaucauaggcaaaggcaaaggaggaacaaaaucacaucuuacaugguggcaggcaagagagcucaugcaggggaacuccccuuuauaaaaccaucagaucucaugagacucauuuacuaucacaacagcacaggaaagacccacccccaugauucaauuacgucccacugggucccucccaugacaugugggaauuaugggagcuacaauucaagaugagauuuggguggggacacagucaaaccauaucaugggguaacagcaaaguacuagggauggauauuggauaaagcuggaaaggucuccuacaguauauaucacgcagggccucacgcuucaaaucaguuuacacuugauuuguuaagcacuggagcaucuuggaagaggaaggguuuuuuuuuuuguuuuuuuguuuuuuuaauggugacgaaaacaacauaaaauuuucgaucaugggacaauuuuaaucagagaugagugagauugaagcgaagugucaagccaggagacuuacagcugucuugagugaugggguaagggucugacugaggugauggcagaagggauggaaaggugaggacucaggagagacuuuauaaaugagcauacuucuaaaaccugguuuucucuuuguccauguuuggcaaauagaaggaaaugcugacaaaugucaggaaaauacaucaggagaauuaauguaauauaggacacugcugguuuaguaggcuacaaacucuggagcuuucucaagggagcucucuugcuucagccuucaccucuuggaucuggcucaagcaggaggucagccaagaggcguccagcucucaggagcaggagccacggcuuuccacaucuauuauucguuuugacgacgacacucucaguggcugacacugucugugaguucauggacugaagaagacuuuguaagucagagcacacauggcauuuuuuauauaacacccuucucuuaauuuccaguccuuuaugguggauuuuuuuuaagagugaguuaaaagguugugugcugagcaaaaugggaaaaaaagugcagauugaaggaaaucaaugcugugucuuuuuuuuauauuuuaaaaccauguuuuauggaacauagaagcaaaucuucaguaauaacuaugugaugauuucuuuuuaauuauuuuaagcugugucuuaaauaggaaaauuuuuaaaaguugugaauaccaauaaaaugcaagugucauuauagucuauguguguguaaccauaugugcacagaauugucuuuucacaauaaaauaagaauacuagaagguacuuauuuuauuacagaugaggaagccagggcuuaguucuguuaggauacuuguccuggggcuuagagauggcagaaccagugcuaccaauacgcagcgcuggcucucagacaccuagguucccagagcuacaaaaaauggauguugacugaugaugggaauaaagcacaugauguggcuuuccuuugugauacagacagaccuuugcuggauucugcuguccuuuaacuguacagucuauuacuuuguuuucaaaguaaaauuuuucucacaaaaggugauagauaugacuauggcuacauccauguugauucacaguucaagggaacaagagauggauucacacgugucagccgcugcguacuguuggugcucacuuaugggaacgccauucugaccuaggucauauuauacauuuuagguucagagaguccuugaauaacugggagcagacugguaaacagagauuaacaagcuucuuucccaguaaaggugauguacugggugggauuauauugaguaaguaacagacauuaaguguuuggagcuaaccuggcaaacuauuauaacacagaauggaagacagaaaaaaacaggcaguugaaauaauuuuauaauuaaaucuguuaaugcaauuaauacugaucgaccauagugggggucugggcaaugaguguccacaaagagcagcugggggcuuacuccggaggcugaggcaggagaauggcgugaaccugggaggcggagcuuguagugagccgagaucgcaccacugcacuccagccugggcgacagagcaagacuccgucucaaaaaaaaaaaaaaaaaaaaaaaaaaaaaaaaagcagcuggcggcugaugcaugaaguggauuuccuuuauuuggauucuguaagucaggaaucacuaugauuaacccuaaggauaauaauagcaacaucugcuaaauuucugccuuccagugaguaccuggaugcaggaugcuuuccacacaucucauguaaagccaagcuuuccauuguuuaaucaauuuugagaguuuuggguuuggauugcuuuugucauugacacucaggccuccaaaucaguguguggcugggaucuccauguuggccagagccagagucccgccacgagcccaggguggggugugugcuagggucuguccccaggcaugcucaggaagguaaguucuugcuagccaggugggcuggccauucuaggggcuugagguggggguggaaagaaagaaacauaaaaagaaaguuggguuauuuucagaauguauucauuucugacuuuggaaaagugguuaaaaaaaaaaaaagaaagccuuuuagggaaguugucccagggaagggagaugucuuaagaaacagagaggaagugcuuccucccggucgcccccucacccucucaggaccaagaccccucuucuuuugagcuccugaggacagguccuggggagacaggagauggguguggagggaggaggcaggcagucccugaaguccgagugggucuccgcugucacaccuaugugcuggauuggaacagcagccuaagggcuccccaaaaugauuucugggccauuucagaaauguguccaaaucccaauggaauuagaaauuuggucauuucaacaacuuuucuaaggaaacaguucaaagaauauugccuugauuaucaggaggaaccagaaaaaugugacagaaaagaaauacuuggaacuaagauaugcuacaaaauauuuaaugcuaguauuugcacaacaggcuuaacaccagacuuguuuucugguuuacaaaaaaaaaaaaaaaaaaaaaaaaaaauuaaucguuucguauuucucagcaccugcuaagacuugcuaccaaagcuuuggguuuaucgaguuuuuaaauuguacaggcaguuaugugcuguaacaccuugcuguucugaggugugcauuucuuuuaucucaaaauagcacaaaguuaggguuaaaaguuaauuuccuggccagacuuuagucccaguauaggaaacguucgaugauaauagcucuguuccauucugaguguacucaaaugagaauccucgguaauaaaaccagaagcagacaccaaaaacuuauuaauggaauauaaaauuggaauuuuugguuuacuuuugacuuuuugaaucaacuucauugagguauaauuuguaccccaaaaauguacuuauuuuaaaugccuaguuugaugaguuuugccaaauacauguaucuguaucauagccaucucaacuaagauguagaacauuuaaauuggaaguuugcacacauuuccuuuuuguuuccugauacuugugugugcgugugugugugugugaaaacucacuccugaaaaugaaaauacuuaaaagaaacuuucacccuaccaaaaggcucuugauaauaauucugagauuuuuaguauuacugucacuuguauaagaaaauguguagaccaagauagcauugugcuuaaaauccaaucagacaaugauaauauguagaggagguuuugccacaguaaagcuugcuuuguuuuuuuaagaucccugcagagacaaaagggaguguuuuauggacaacgaggcagcaugcugcccucgaguuccagguuuuggggggaaugaaucauuccagaauccauacuuuugcauaauccaguaugaacccaugccgauguggaagugcaucugcaguauccaguaaaauccucacugcuuccuccucuuuuguuuccuucuaucucccauccacagcauucugagggggaacacuucagugggcauucucagaggaaccacaaauuaccuuaagguugugaaaaugguccccaaacaauugccggggccccgccuguugaccuuggagcaggcugccggggcuccaggacccagggcugucucuaggaucuugagcaacacuggcauucacagugcauacuacugucuugaaacuucaaaacauuucagcaaacgugaguuauaaucucucaaaaucacuuuaccaucgucaucuggccaguccuguuuggaagacaagguaacugauggaaucacuugagguacaggccaggggacuuuggggaaagguaaagaagggaacuuguucuaagggaggugcuggcaaaggaggccaaaagguaaaugugugauucaggagaaagcaucccaucaaggauacccccucacggugcauggugagaguggcggcuuccaguccuggcuuccugccuugauucugcaacuguccaaaguugaacuugggcaagccacagccccccauacuccuaccaucaguuucuccaccugcagcacaaggguugaauccaugagcucagagggccuccagcucuaaccuccugggagacugagccugccccugcccagggcucuagcuugacaggcacuuucaugugcuuucuauauuccuaaguuaaggguccccacaaauauaaccagguccaauuuggcggcacauucacauuggcugguuucacgucuaucuuuuauaggauacaauuccuuaaaccugcucauccaguaaguuguccacgcaaaggcugucccuguauuuuagaaagaggugcaugaacauucagucuuuacucauugucucuuuaaacaguuaauacucuaaagcuacaauuauaugaugucucagugucugaguccaccuugccuugcuccuuaagaucacagcuuccuaaaugaucuuccauuuccacuuuugcccuucugucauccauccuccacucauccauccuccacucagcagccagaguguucuuguaaaaacauaaaucagaccaugucacuucacuacuuaaaacccuucagcggcauccagcugcucuuggaauaaaacgcaauauccuaucaugaucuacauggucccgaaugaccugccuaccacacacuuaucugauuccaucuccuuuggagaagauacgcacaaauucuggauauuaugccucuacauagggaagaggccgucucuuccccucuccccuucugaauggccgggaaguaggugugauggcaggaguggagaagccuucuuggaccaugagguaggggucacauauugagaaugccagauuguagcacagcagagucugggucccaaaauauugcagagcuaucucaucaguccugaacuguccacccaugcuauuaagugacagaaaaauaaauauccaucuugcuuaaaccccugugagucucgguuucuauuuuuuuuuuuuuuuugugagacagagucucacucuguugcccaggcuggagugcagaggcgugaucucggcucacugcaaccuccggcuccuggguucaagugauucuccugccauagccuccugaguaggugggauugcaggcacacaccaccacgcccagcuaauuuuuguauuuuuaguagagaugggguuucaccauguuggucaggcuggucuugaacuccugaccucgugaucugcccaccucggccucccaaaguacugggauuacagggaugagccacugugccuggccuggguuucucuauuauagcagccaacaggguacuaaacaaugcaccacacuuuccuuagggcucuguccucgcuguucccacucccugggaugcauuuccccagcuccucucauagcugcuuuguuauacuuccagccuccugcuuaagugccguguccuugaggaggccuuaccugaccaacuuaaccaaguuggucauaucucuccacugaacucuagcaguggccuccccacuagccucccuaccuccacucauggucuucccaccauccaucauccacagaggccaaaaccuugauacgugauaaguugccuuaucaggccuuaccugaccaacuuaucacguauuaaacugugauaaucuuguuugcccauuugucaugcuuguuuugcccacgaauaagaagcccccugaaggcagcagccugaccucucucgcucgcuuguaucucuccagcaccuggaacagugccuggugugcacuggagggcccaguaaguauuuaugaaaugaaugaacaaguguaggcacaaucagcaggauccccauuucaaguucuuuuuuugguucuuggaucugggacaaaagggcuggggacaccucacaguucagaggacucuucugagaugacuuagcaaaucaucuggagaauacagaucucaauccacagcauuugcugcucacagagggauuugaaagaacagcuugucuaccaaggccgauuuaaugaaaccacgaaauauaugacugcaacaagaacgcuuacaagaaauaaacucgaucuguugccugguaucccucuaauaacuaaugauauaacuacgaaagguugguucugaacauaaaacaaccucggaaaggaauucaacugaagugcacuuugugguuacaaacaccuagugucagagacaguauuaucgaccccauugaaaauaaugacuuauugcaaguaaccacaaaucagcugacuaguugaauggauauuacacauuguuuacuacgcaugaccucaaaaaaucauuagauccauacuaggaggauuaagaggacuuacuacucaugaaucccuucuuucugcaaaccucauauccucaugcaagaaugagaagagcugucauuugggaauuagagaaccagccuggaguccuugccugcccuguauuugcggcuguagacagaaauuccuuaaucccuuugagugucaguuucaaccauaaauugggaauuugagccucucucuuccacauuccccacaccgaauacauccgcagauagucuuagcugugccucccaaauacaucuucaaucugcccauuuuuguaccuucaauuauguucucauuaaagccaccauaucucuccacuaaacuccagcaguggccucccugcuagccucccugccuccacucauggucuccccaccauccaucauccacagaggccaaaaugauacaucaaagcccuccacugaccucccaucaacucauaauaaacuucaaaccccuugcccuuggccugugaggcccucucgcuaaauuggccacugccuccucuaugaccucagcuucuacuuuucuccuccccauucauucuauuuaucaagguuuccuucuguucagguaaaugccggccuugucugaccucagggucuuugguccugcuauaccaaacuuguucaacccauggccugcaggcuuuaugcgguccaggauggcuuuguaaacaaaaauuuguaaacuuucuuaaaacaucaugagauuuuggccuggcgcgguggcucacgccuguaaucccagcacuuugggaggcugagacgggcggaucacgaggucaggagaucgagaccauccugucuaacgcagugaaaccccaucucuacuaaaaauacaaaaaauuagccgggcauggugacgggugccuguagucccagcuacucgggagacugaggcaggagaauggcgugaaccugggaggcaaagcuugcagugagccgagauagcgccacugcacuccagcccgggcgacagagugagacucugucucaaaaaaaaaaaagagagauuuuuuuugcaauuuuuaaagcucauuagcuaccguuaguguuaguguguuuuacguguggcccaaaacaauucuucuuccaauguggcccaggaaagccgaaagguuggacacuccuauuauaccuuuaacuggaacccccugucuuuagaucugguuccuucaaauccacucuagagaucucacuuccucccuugaucacucucuaucauacuaccauuuuuuucaucguauuuaacaaugacuuaaauuauugauguauuuguuuguucuuguuugcuguuuuauuuauuuauuuuuuucucaccagcaagucagcuccauaaaagcaggggcuucgaaucuuucuucccuggccuaucuauccccagcacccagcacaaugcuggaugaauuaagauuaaaaauaauaucuauuuccaggggcuggugugaggcuugaauguaaaaaaugcuuuguggaggggucauacaauuguuggauuuuaucaaucauuuuaugugucuguaauuagaaaagauuauauugcuguuuacuaauauaggucagaagaaaugaaaagucucgcauccgauuagguagugaaucugcccaaaaucugugugauugaagcuguucauacauacugagaugaaaucacucgcugucuuguaagcaucuauuaucuacucugcuucaggggguguggcugggguaugaaagacagaugccuggucucuuugccuugacggugcuuacaaacaaaugaaugacgugugccugagccgcuuuggccuugggaucucuagagcauucaucaccuaugauauucuucaagagcuggcugugcccacgcugucaccucguccuccgugagggccuggccucucucauagggcgaugagcuccauaaacacaaacuauauuuuccauauuuauguuaaguugcccaagguagacuggaaggcacccagcagggauguggaauuaaacugaaugauggguuauugggcaauauauauuuuuaaauauguccuugcaaaaauauccacuaauaaugcaggaaacuaucuuacuuuguauuggaagaaaauguacgauuugcuuauaaugugguccccuccaacacaaagauaaggcuuuauggauuuacucuugacugcuuucuaaaagcacguccagguugucuggaacccaucacacccucugauggggcccacucagacccaguggcuugaaucaaugagacggauggguggccgggagcagagcucucuuugucugaucccucugaccagagaaacaguguuagacuucaagagcuuagggaagagggggaagaacuacuagcuggaaaaacaaacaaacuuucagauaaaacuagccaaagagucuugcaagaaaacguaagagagagauuucugaaguucacccagacacagacgcacugaguaagguagaaaaaaaaagaaaguuggggaugaguuugaauugacgagaacuacaggauguuugcagcaagcagcuuagagcuguaaagauuuaaugcaacuccagcuguaaagauuuaaugccuggcuuguuccagggggauucuggcuggguaucuuuguauccaucgcccaccaccaacaagcagacauguuuguuuccagugcuuucugcuuucuccugcuuuucucuauguuggucucugagcuucucucauuucucccccgauucacuacauagaauggcucuuauuucugauauguguuuuguaauguuuucaggacacuaaaauuauuuaacucuauauucacuguaauacccuagauaauauaauuuuggcucugaaaggccuaauuuauuaucuuggugugacuuugacagccaaacaaucaaauaacuggucacaugaguaaaaaaaaggucaaagagauguugguuuaggugacaccgauggggggcauauaugguaggaauaccguguguuuacuguucugggguuucauucuuguuguauggucuugggugcuuccaucugcuuuccaaguaacucggguuagcuuauuuguaauugugcccucaucacucauuuaauuaucccugaaagcauuacugggcaguuuauuaccauucugccuuagauaguugguuuuuuguuuucucuuuuuuuuuuuuuugagacggagucucacucugucacccaggcugaaguguaguggugcaaucucagcucacuguaaucuccacuucccggguucaggcgauucuccugccucagccucccaaguagcugggauuacaggcacccaccaccaugccuggcuaauuuuuguauuuuuaguagagacgggguuucaccauguuggccaggcuggucucaaacuccugaccucaggugauccuccagccucggccucccaaagugcugggauuacaggcgugagccacugcgccuggccagguaguuaauuuucucucuuugcugucuuugggagggaaacugagugaagcacuauuggguuugcuguuguuucugugaaacccgaaaccuguaaguuaaagguaaccaucuaguauuauugcaucuuucuaaguauuagguuggugcaaaaguaauugugguuuuaaccauuaauuuuuuuuuuuuuuuuuuuuuuuuuaaagauggaguuucacucuuguugcccaggcuggagugcaauggcucggucuuggcuaacugcaaccuccgccucccagguucaagcaauucuccugccucagccucccagguagcugggauuauaggugccugccaccacaccuggcuaauuuuuguauuuuuaguagagaugggguuucaccauguuggccgggcuggucucgaacuccugaccucaggugauccgccugccuuggccucccaaagugcugggauuaaaggcaugagccaccgcacccggccuaagcauuacuuucaauggcaaaaaucgcaaucauuacugcaccaacuuaauagaaaauuguucccuggaaacaauacuuuuuuccuaaaaaauguacuuuuaaucacaaauguguuacggguaaucauaauuuucuuauauuucacauuuaaaaaagaaacuaaaucuaauuuucacguauucugaaaauguuaaaaugcuaaauaaguguagaaaacagaaagcgggaauaucuuauaaaaacauauccaaguugcauuuuuaaauuguucuucccauuuuuugaaguaagaugcgcuugccugauacucagaguucagguucugcucuggaccucagggaccccaggaucagagcacgacuguaaaaggaugaaggggucuccaucuauaaauucacaacgcagagggugacacuggcgcucagggggugugccaagugccaagucuaucaaacuccaaccugcagaaagggcugguugauagggaaaggggaacauugaagagggaugggagggaauuacuuaaugggcaaaaacaacagagauuccaaagcccagcaaauuucaaagcacuuucauauaggaguugcuaagccugcuaaguacuauuuacaucaaaugucacaccaagaaaaaaaaaucagucagaacaaauaaaaauacggaaguuuagaacagauaagaauguuagacuuggaaagacaaagaacaaagacaauugaagauccaacccaaagccaggaucccucuuaagagcuggccucugccccacaguuguccaguuucucuuuaaauaucuagugacggccgggcacgguggcucacgccuguaaucccagcacuuugggaggccgagaugggcgaaucacgaggucagggguucgagaccagccuggccaacauagcgaaaccccaucucuucuaaaauaguagaguaaaauaguaaaaauacaaaaaaugagucgggcaugguggcgggugccuguagucccagcuacucaggaggcugaggcaggagaauugcuugaaccugggaggcagagguugcagugagcugagauugcgucacuguacuccagccugggugacagagcaaggcucugucucaaaaaauaaacaaacaaacaaacaaacaaauaaaaauagaaucuagugacagcgcucaguauucguccagaugcuguggguuauaggcuucuggcccugggcucccaucauucuccguaccuugaaugaaagucugccccccaggacccagagguucuaacuuagcacucagcacacacaugcccgucuccuccaugugaaccccgcagagaguuaaagauggguccccaccucccuaaguccccucuccuucaggcuaaacgucccaauuccugcugcuguucugagugacccuccacuggccacacucgggcuugguaauguccaccucaccauguggcccuccuaacugauaacauucgaagaauuuccagccauggcuccaccacucggggacuguguugcagcccuagagucgcccagcucauggcuaaaucgcggcauggacugugcugcccucuuaggucuccuuuauuuugaauuuguguaauugauuuuuugaaccuaaaugcaugagcuuauauuuaaccuugauacuuucauuuuauugguuuuggcuuagauuuauacgcacuuaaaaaaugauaacuugcauuuaauuauaauucuucaauuaucaaagugcuuucacauaugcugcugauguacauuuugauccccuuauuuaccaugccagcucugccuccucacuuucuaucaucugcaaauuagauuagcaggaaugacaacaauugucacugauagacauauugaauggacggcaaggaacaaaagacccagcccugugaaaugccucccuagauucauaccacauuccaagcaagggggcagagagcaggcaacuacaggacugcuugugugaauaagaucauugcagagaauaaaaugugcaaagaugaaaaauaaaacagcaugagggaauaggaaaugauggggcaaggugcuuuuauagaggaggugauuggagaaggacucugagcagggacuggagugaaugggggagcacacaguguaccccagagacccggacacacaugaauucaucaaucgauugacuuccugcaguuccaaagauaauuucaggcaaucaauuuuugacucgguuuugcucuccauauuaucaacuaagucagaauuugcuucugagccacaaacacugaacaccuaauacaaugcuugacacugaauaaacaccuaaauaaauaucuguggaguaagugaaaaaaucugcuaggagagacugagucaaaggcucugcuaaaaucaagaaaugcugugugaagaccaucugacaaaguuucauaagguuugccccggacaacgcucucacccaaggcacuccuagggguaucauuagauugugaucaauuggcuguagcccagucaugggagcccucaggcuacaugcaguugcuggcauauaaacuacaauuccaggcugaucagaggcaacacugaauuacgaaucucuaaccucaagugguccccauuucaccaguuucagaaccuauauauaaaagagauauaugguucacaugggauggcuugauuccggggaacucauguuggauuaugcaaaucacacgauucuccucuaaauucucacauaucaccuauuuaguaaucuaguccagaauuuugucaaucauccuuuugccagucuacgcuuuucuuggaaacuacuuuuuuaaaugaguauuuuugaaaguugacauuuucuugucucuguuuuucagcaccucuccagauugacaaagucuccugacaauuacugaucagucacaucuacaaauguuuguagcauucugaggugugacuuaucuacaucuugggaaauacauuucugcaauuaauuaauuacugauuaauggagcaacuacagaaaauauucaaaucgaagaaaggaagguggacaagggaaaggauggaaagaugaguaugacccaguccuguacugaagaugaacagacuggacgucgaaacauaaauaaaauacauugacaaaugcugagacgaccuagucugagaagcacuguacugugggcugguaucaaggcuuagugggcaccgggacgggagccacuuuugccugggaaaauaaggucacugagcauuggaggacaaauagaguuugugauguguugugggacaugucacagaugccucauggcuauaagauaaaagugcucugcuggggagacuggcugagguagugguuacgaaauugggaacagagaguggagggccaagcuaaacagcggggaccucagacacuucauuggauaaacccagcgguuaagucccuacagguucucaagcagggagugcuguggcccacaauggaacuuucccuuuguggaguauuaauugaagaugagaguguguggggcuggagccuggaggcucucugcuucucaccuuuuccagauaaaguuuucuucugcacuuugaaaacccuuucuuguuggaaggcaacuucccauuguaaagaaacucuggcugguguccucuaagcacauuuacuuuggagagguguaggauuagcauuuucacugaaauaguuuuuguuucuaaaagggcuuacuuuaagugguuaaaaccuccuuuuucccucaagccauugcacaauaucgaucacaguauuuguucauuuagcagaucuuuucuuccuguggccacaaugaaggucaguguugagcuuuaaugcagucccuguccaaaugaugaucaauuucaaaggaauaagaaauaaaaauugagcuagcaguauuaaaaaaugaauuuugacuaugauuauucguaaaagcagugcaaucaugggaggccuugugcauguaugcacagauauaccaagauuuuagaaugaaaaguggaugacaauggaggcuguucccaaaacccucugaaguuuacacagccaugccuuaacaagaaguacagaaagaacacuuacaggauacauuagaaugagaaaauacuaaauauuaaggcauuuuuuuuuaaaguugagaaguguuggcuuucaugcuagccucucacuuucaaaucaauaccuuggacuauacagaaauaaauucgaggccaguuuucaggaauacagauuuuaaaaugaugaaaguggcagaauggucaucauuucugacucuuuauugaggacaaaaauuucacauuuguauuauccuguuggaagccugguggcgagucuguuuugaagacaugauaaaccaccgcagcagagaguagaagggccacugggaaggccucuccaugggagacccuucucaacacguaaauagcucugggcuugguugauucugacaagaagaaauuaaagacauaaaacacucuucucuuucagaugcguuggcuaagccucugcuccaucaauucccuacucuccucucagcuccacagggcacaacacaaaccucgggaagagauucccuuuucugggggucacuagucacucuccuuugccuucuuuccaugcaucucaccuucucacuaaauuagagacugggucaaauguggaguaugguuucugggaagucauugcuuauuggcaguguaugaagguuuaacauaauuucaaugcauuuugccuaaaguguuauagacccuuucacuagugagagaacaucaaagccacgcuaauuuauuuaaaauuugucuugagcucagacauccgggaaugugaaaguuagaacauuucuauacuacuaagguaguauagaaagaccaugagcuuaggggucagaccaaccuggcuucugcuccccaccuuagaaggugagugacauugggcuaguaacuucaccuuucugaagccuccguuuucugaucuguaaaauggggauaauguuagguaacgccuaaaaauugauggggacaauaucaauacuuaauaguuaauuauuauaguuaauaguaagcaauagacuuuugaguaaugguugcuauuauugguucuauuaccaacuuucagcagccuugggauuuaaauaacagccagcaacuacacagaaaacagucuuuuaacacacuauuacggauuagaacuagguaguauagcucagcuacugauuaaaaaaaaaauuaaaaaaaaaagaaauccucugaaucgauuaaaugcagugaacuuccaaagugcacauuucaaaugaauaagugugggcuggcaagaggcacaguaccauuacaguagaagcggaaagaacgugaggaaugaggcuuucccaaguuagaccugugguaguucaggucuugacgggccaccuugguguuucuucacaaucagcgcuaagugcauagcauaugugcauggaauuccuggaucagcagucgcugugggucagaauccagaucuuggccuugcagacccguucagaagaaacaaaggcugucuagaccucccguuugugaaauaaacuugacuugcacuagaagagcuccaaggguccuuguaacauuacaaauaauuucauaauucucuguuucuggaaaaaguaaagacgggccuggagaggcgguaauuacacuuucuguucucucuuagucucucucaucccauuaaacacagccuagaucagguggagacgccucucaauaaauacuaugaaagaauccacgcuuuccuaauuguuuggcuucuuaaucaaaagaagagcuuccuuucaauuguuaaugaugcaaaucaauaggguauguggaagaaaugacaccuauucagaaagcugugaacgucugaagugcuaauggugaugauuagguauuaugcaaagaaaaagcgagaaucaauucuauucuccacacacugccagugggacucagucccuacggggagaggagcaaguccagaacugucugccaaauaugagggugaaauauuaaagccaccuucauggauaaccaaacacuaugcugaguuucaaaaggggaaaaccaaacaagcaauuugaugcuauuuuuacuccuuagggacaaaggcaaacugaacaggaccgacuuuaaauguaacguaaugauucaaggaaccuauaugcuuuaucuucccucgggauguuaauuauucuguuuaagggcuaauuuguuuugcaggagugugaaagcacgcuccguuuuggugauacuuuucagauacuuuuggggugugucuacuuacagaaagcauuaccuacuaguauuguuacugauuaguaucuauaauguuauaacaacuacuaauuuguucuaaauuaaaaaggaaguccccuucuuuaaacaagucucaaaaauuuuauagcaugccagaauauuaagaugcuccugaaaagugugggauuuaacuguuaacauuuaacaguucacaccauguaaaucucagcuuugccuacacacacacacacacacacacacacacacacacacugcacgaaggagcacucucagauucuccucguuuuccuuuacuugcuccccgugcagugacccuguggaguagacuugguagugcuucgaaugcaaacccaaacgcugugauuuacuccccaaagaacccccgaccuugcagagagaagaucaagaaucggaaauuuuuugaccaaaagcgcugcuugcagagguguuaaaauccaguuacagugccccgcucaucacccggacgcucucuccgccgccucccgcgcuccccgggcuggagcagcgcacccuugcaacacuugcaccgggaggcagcuccaugugggagccagcccgcgcgcaauacuugccucuucccgccagccccgguucaggugugccccucgcuuugugaugcagguggcuuucccacuggccgggucagacuucagaacccccgaggaccguccuuugucggccggcagcccgagucccggcgggcagcuuugaguccaccgcucucgggaucaaaccccgcaccacugaaaggcaggugaggggaggacgcaaaacccgggguggagcgcuaggcugcggcggcggaucugacuguacugggagagccacacaaaaguauccaaggaaaagccaauaucuggacuggaguuuuaaaaaacguaauuguacuugcauccucccacccgugggcaauacacacagcacaagagugggucuuuuuuuuuuuuucgauguuugggcuuugagccuccugguguaucugcguuaagcaccuuugauacuguugaccuacaaggagggcucugagagcccggacugcggggaagaaaguuuuuuuacacuucgugucuuacuuacacuacgcuuguuguggauggcauuaauaacgggauuagcauggaaaggguuacugugcuugaugcuauuggcagagagagagacacagagacugggucaauagggauuauuucugaauggaacaucugauacucugggaucugggaaaaaauauaauguuuucugauuuuccugucgggguucuacugcuguguggccuccuucacucucagagcacagguuacguccuguguaauacucaguuucugauggugguuuuuucuucuuccaccuccccuuucucuuccccuucuccuccuucuccgucuucuucucucacucccuccucugcucuuuuuugagaagccuuaaaucccacacuuuucaggagcaucuuaauauucuggcaugcuacaaaaucaaguauuuuucuuuuuaucuuuauguugcuucucaaagaaagggaagacaguagugauaggaaagagcagaaaaugcuuauugagguccaggcaguagcagcugaagccuuuagcaaaauaaaccuugcucugccuccugguucaucagcaguaacucaccccccccucacccccccacgccccaauuacugggcaauauaagagauaggaauuugcaaaggauaguggguaagaggcuaggucgggguggggggagggaagaguuuguccaugggagagaaaauuaggaagcuguaacuugacuuucguaaagcgcucuguucuucugucuuuuccaaaugaaggacaacaggaagagccugcuucaucuggauuuucuaauagacacagguucugcaaaaaggaucaugaugcacagaaugacacacuucaaaucagauuauaggugucagaaaccaaaaaauuaagucaccauagccagcccuuacucuaauaauuguuuaaauacaugaucuuucuaaaugcucacaucagcauauuguaugucuccauuuauauaacaugacauuguggaaaaggcaaacugucgggacagaaaucagauaaguggcucucaggggcuggaaguacaggaugagggggacaacaaaggauguaagggaaaucuggggguaauggauugcuuuguguguugauuauggugguggcuaccugaauauauuuguuugucaaaacucauaacucuacuuaauauaaaauaguggauuuuaucguauguaaauuuaagaaacauucuguagccauaauaaagauuaaacuaaucaaguuuaaggacauuuaaaaagucccccugacccauugcucuuucaucuaagaagguacaauagggaaugugauuaagagcuuacucacuguggagacaccacagacauaaggcuuagaauuuaacagagaagugucccgaaaguccaauguacagcauauacucugcauggcgcagggccaagagcuggcuagaaauacauaaaaacccauuccuuuuucacucuccacaguggugaguagagauuucugugcaagagguuagaaguagcugguaacaaagcucuaaaguggagagacuggcaagacgcagaugagaaggguuggaucuuggacaaaguagcagagggaaaugccugcugauucugagaagaucaaacaaaaagaaugugacugaaagcagugguucccaaaccucguuucacaucgaaaucaccugauucucgcuagauccagggcugucagggaaucugacggugaaggagcuuccugggugauuguuuucagcugccuagggccagggcuugucauaggagagaaggaaaguccucccggcucagggaggaggcuccuugugggcaggcgggucagggcaucaggauaagagggagcugcuuggaugugcagggggagggcuuucuugggaggcuggagcgaugccucucacagacucagggagcagagagggagggggagcagcaggggccuccucagcuuuaguggggugucugcugcaccguuagggaggaauggggggaaaugugaagugucccccguguugauaucacuagcaccuugcucugugccugggcauuguggccaaucgauaaauauuucgggaaugaaugaauaaaugauugccacuccauuaggcaccuuccuauauauguugccuaauuucacaauuacagcuaccccugggagagagacuguuauccuuuguagacagggcaucuucaaugcucagagaagugaaguaaccuacccaucguuucacaguuagcaaaugcaauggauauuuuagcaaagaaugagcagagauaagccugcccugguagguuucuuuccacacuauugggauucugacaauggacuugaguguuucauauuugaaaacauaugaaagauugaucucuucaugaaugauuacauuuuaaggucaaaaccaguaaguuucaaauguuuccuaaggaaugugucuauuuuugauauaaguucuauggcauuaaauuauuuaauaauggcucuagacugggggacagagggaaacuagaucgcauuuucuuggcuccgccaguuguuaaaaugacuacuuguucuggaauguaccuuuuaguuuuggcuuuuuuuuuuuucuuuuucaucaaccaaacaggaaguguagguuagacaggagccagucaguacucacaggcuucccacuggaaaucucuuuuuaaaagcaaccgaaacuuuuuuuuuuuaaaagaccaucaccacugcuacugauuaguaaaagaugacucugagaagcauaucaacugcuauauauuuucagccuuccuccuuuuuuuaacuauuuguauuuuuccuuccauauuucucuagaugaaacuagauaaaacuauaucauuucauuauaucacuauuuguauuaaauaaggacuagaauuaaggugcuaucuugcauaaaauuauauuuauaugcuuagcuauuaaauucaaaccccaaaucuaugaaauaagauagaaccaaucaaagacaauucugacacuggauucaaauccagcauaaauguucuucaaguuuuuguagaaugaaugaauaaaugaaucuaguucuguaaugagaggcaguuacuuaaaccaaacaauguagucauggcuggauauguagauauuggggcaggaagacagacauaaauuccucugggcaagaagggaaggagaaugagggaggugggugaccuuccuccuaagccuuuuaguuucaacagcuucaugaaagauaugggaauuucaagccaggagaacugagcacuaauuuguuaaaguugugaaaaaaaacguacaauauuuaaaccuggagaauacuauaguugaauauaucaaaaaggcuaaggcaauguuaaguaaauaaaaaucuagaaaguuuagcaaauugucucuaaauucaaaugugagucagcagacggagaugaagggccaaugaaauguauuaggaggcagcuuucucccgcauuucuuuuaggggaugauuagcuggggagcaggcugaagauggauaccagccaucacauuucaguucuugcgguuacugaugucugccuaaucuuccuucucuugacacguaauuauaagcuagguguauaucugauacagcaguuggucucacuccugccuagugucugggagucucuugucucugcuaggugugcuaucacagcugcguuaaucaguugauguggaguagcagagccugaggaagucaccucccugcuggaggugugggcagugauuggcagcacucagcaacagcaggagacucccaucaugagaaaacccccaucacagucugcucaaucccugcaaucacuccuagaggcuguguguucuuuucaaaggcauggcaggccuggauuucauugucuuuucccuuuaugaguugagguauuagagaggagaccugcugugggauuagaguggguuggccucucuuugccucugacaucaucuugagccacgggagcucuuuccuucuuggacuuucccaugggguuugcugagucuugcugccguguuaauuauauuuucccuugguuggcagaauacaaaucagcuuagucaugcuucuauuuccuccagacacaauacagcugagagggaauuuggcuaagugcagacacaaagaccaggcgccuggcuccaggugccucaucuuccccgucuuugagugguuccaccucaaacacagacucaaggacaaagagucauugguaggaucugcaaacacugcccucuaaaauuagagucuugauaucaugaaaguagguuuccccuggcugugucuuuucaggaggccccuucucuccacucucccaaagucucccccaaugauugcuggaguucccccaggcaggccuuugcaugggcagcccuccccucugguacaaagcacuugcuaaucucucucuucuuggguaucauggcaguggcagugcuucuggggccuggcaaaggugugcaggcccuggugcuccaugcuggggcagggugcuuucugcggucacaacuaaagcagcuagugcagccugugguuccugcacaaccagauggggcuauuucucauagcuacagaacuguggguccaccagcaugcacuggcucucucugaccuggaaaaaccccuuuuccuaacuuuucuaguguuucuuaccaagguccauggugccagccacugcuccauugucuugccaaguuauuguguagcaaauuuagauuuuugcuuauagccugcuuuuccaaagucuuaaucacuacaugguaggccacccgauugacugucaccaggcugcaccuaaaacccaugcugccuucagccccgagagugaacugugcuucucuugccucuguccucccuugagugaauuccuucccaagagacccugggaucccucaugaaaacagccuccucgaacccaaaaccuuccuagccccagacaugccugaauuccaggucagacacaacucagaucaaacuagacucucugauaaaagaacguaagucaugcugcugccauucauuaggauggggauguacaacaucuucuggaagucacuagaacugcuguugugggucauuagucccauuaugaugaaaauuacacaaacucuagcaaucacuugucacgcuaagaauaacugaaaacucuucaaggaugggaagacugaugucauggggaaaguucuggagcagaaaucaggauguccuuagccacuaaucagugacaggaguugugcaagucagauuauuucuugaggcuccaguguccucacuuguagaacauccaacacuggcauuccuugcuguaccucaaggccugggaagucggauaaacauacauuuuugcacagcacagaaagagccucuccaggaguugagaccugacuucguggcaucucuucugacugcagugaaucuuucucuguuagggucaauauuuuuacaacugucucuacaugaaucccuuucccaguagucuggugaacucagugacauuguugaacugaauuucugggauucagguggacuccaccaauguagcugauacugugugagguuuucuaucauuucugguagccuuucguagugauggcaugagguuaccucaugccuuucuauucaaauuucagcaguaggaaaagaaccaaaauguuccauaaaguccucccagucaauuaacuucaccuaaaaaaugaguguuuuuuuuuuccuuuccugagauggaaucugaucugucacccaggauggagcacagucgcgcaaucucggcucaccgcaaccucugccucccagguucaagugauucucccaccucagccucccgaguagcugggauuacaggcgugugccaccaugccuggcuaauuuuuguauuuuuaguagagacgggguuuugccaugucggccaggcuggucucgaacuccugaccucaggugauccaccuaccuuguccucccaaaguguugggauuacgggggugagccaccguuuccagccugaaaaaaugaguguuuugauguuuuuguauaaacaucccugugauggacaucucucuccauacagcuauguuuggaggagcagggcuguuaagaguggcaggggaggaguccacugaaaucugaaaaaaaaucuuugggcaacauagugauaaaggauaugucaucauguuuauugugguaguacucacacuagaaaggauaaucuuacaaaguugcucauaggagguucugugauccuauuuuauacuugguuuaggcucuguuucuuuuuuugcagauuuauaguaaaaugauuacauugacaagcuguucuacauccacccuccccguuuccagcguggagcccugaagcaucguucaaaaaaggacaaacagccugagaggcagauaaauggauggccugguguaauuuuaaaucacaugaaugauguugcuucucucucuuccccuggagaaccucuuuccaugucugacugacgauaaugugugaaauuuuucuuacuuagcagggagaauuaguuuguuuuaguauccagaacacagcacuguauuuggcuacuagcuaaguccaauuuuuaauauauuaccaugcauaaacauggugggaguucagaagggccacgcucugggucaagauuuuuauaaaauaagcugaggcucaauucauuuuucucaaaacgcuggaggccccugcccuugccaagcccaagauccuuucucucugaacugcucauucacagucaauucucccucuaacuaugaguaaagcaucacaucauauccuauuauccuaagaauaaaauaggaagguggaacacacagaaaccagaauuucaugucauaagcaaauaaagcauacauggcuuuaauauacaucuauucaaugcucuacaauaguuucacaguuuaaaaauaauuauaggaauuaugauuuuugcucuguugugccaaauguuuauagguuuuuuuuuuuuuuuuguccgcucaguuugucaugauuuuaccagguaaaaugugaucucuuuguauaucuauuuuaaaacauaaaggcccuggauuugacaaaacgaugacagcaauuucuuuagcuccuccagcaccucaugaaccaccauccaaugcuucccuggucugggaggaaagaagugagagcagaggguggugcugcaucuggaaaugugaucaaaauggugaaaggugcucgugaggcaggcaggcagcuccauuuucucccuccugcccucucacacaacuuaccgaacgugaucaugugcagggcaguguguaguaguuguugggggaauucguagcuacuggggguuuuagacaaagaggaggccauucuauccauccacuccaucuguccauuccauccauccaauccauccguccguuccauccauccacuccauccauccaauccauccguccacuccauccauccacuccauccguccauuccauccauccacuccauccauccacuccauccguccauuccauccauccacuccauccaucgacuccauccguccauuccauccauccauuccauccauccauuccauccauccacuccauccguccauuccauccauccacuccauccguccauccauuccauccauccauccauccaucaacuccaucuguccauuccauccguccacuccaucuauccauccauccauccauccauuccauacguccacuccauccaucccauccauccauuccauccauccacuccauccguccacuccauccacuccaucccuccacuccauccauccauuccauccguccauuccauccguccauuccaugcguccacuccauccauccacuccauccauccacuccauccguccacuccauccauccauccauuccauccaucuguuccauccauccacuccauccauccauuccauccauccacuccauccguccauccauuccauccauccauuccauccguccauuccaucuguccacuccauccauccauccacccaucccauccauugacuccaucuguccauuccauccguccacuccaucuauccauccauccacuccauccaucccauccguccauuccauccauccacuccauccaucuguccauuccauccauucauuccaugcguucauuccauccaucuacucuauccauccacucuauccauccacuccauccaauuccauccguccauuccauccauccacuccauccguccauuccauccauccauuccauccagccacuccauccguccauccauuccauccauccauucuauccguccauuccaucuguccacuccacuccauccauccauccauccauuccauccaucaacuccaucuguccauuccauccguccacuccauccauccauccauccauccauucccuccauccacuucacccacuccauccguccacuccauccacuccaucuacuccauccauccauccauccauuccauccguccacuccguccguccacuccauguguccauuccauccguccacuucauccguccacuccauccauccacuccauccauccacucuauccauccgugcacuccaucuauccauuccauccauccacuccauccauccacuccauccauccauccacuccauccguccacuucauccauccacuccaucccucugcuccacccgucugcuccauccguccacuccauccaucuguccacuccaucccuccacucuauccguccacuccaucuauccauccauuccaucuguccacuccauccauccauuccaucuguucacucuauccaucugcuccaucugucugcuccauccauccacuccauugauccauuacauccauccguccacuccaucgauccauuccauccauccauuccauccauccauuccauccauccacuccauccacccauuccaucuguccacuccauccguccacuccauccauccacuccauccauccauucuacccauccacuccauccauccacuccaucuauccauccauuccauguguccacuccaucccuccauuccauccauacauuccuuccaugucuuucauccauuugugucucaaucuguauuugcuggauagcuuuguggggcaggcaugcugcuggcuggggagggugggggccucagucaauaagcccaacaggccagacggggguaagggccugcacuggggaagugaugguggcaguggggagcucuggggcaggcccuggcccggggggugugcaucagggaaagcuucgagggugaagagauaucuccucacuugaaggaugaaucagaguuggucaggcauaaggcuggauaaagaacgucccugucauuaaaaucaacauacucaaggguucagaucugugagggagaaugaucccagcacugacugucacuguugauauuuuugacccuugggacuauugaucagaaaaaaccuaccaggagccucuccucaagaccuuccccuuccaauccuuuccagguccccuugguugcuaauagcacagcacuggccucguaacucaaauccuggggccaucuucagccucuguccuguguuccuauuauacugugacccacagcccgcacauuuguuccuucuguuccugcacuguucucaggucuuccccauccuccuaguagaagacuguccccagcccgccaccaugccuuguccacagggggcuguccgugacugucagaggaaugaacaaacagugaaugugccugagccaccggggacuucuugauggucugaacuucauucuaggcauuuucuugagccucugaugccucuggaguguuucuuccucucuucuaaucuagaccauauaaaaauggaguuuaacuuuuuagccgacuagcaaauaacauagcaauggccacuggaagcuuucagcaauuuucagaaacaccagagaauccccaaggucagacagaaucugugguccuggggagccugcuggguguccugguccaggggucagaguccguugcagacagggagggggccagcagccccaggcagcagcauggagaacacagugagggagaaguggcuugaacugaauucccugggaugguuugggccuuuuuuuuuuuuuuuuuuuuuuuuccagacagagucuugcucugucgcuuaggcuggaguacaguggcacaaucucggcucacugcaagcuccgccucccagauucaagcaauucuccugccucaaccuccugaguagcugggauuacaggugugcgccaccaugcccggcuaauuuuuguauuuuuaguagagaugggguuucaccauuucaccauguuggucaggcuggucucaaacuccugaacuugugauccacccgccucggccucccacagugcugggauuacaggugugagccaccgcgcccagcuuguuugggucuuucuagggagaaugacccugggacaggugccuggagcacuugaauaaacugucugugacccagcccugauuugaggguggaugugaguucugugaaccucaaugcugguuccauaacccaggucuugagaaaacccucccuacaaguucauggccccaaggccuauugaacaccaagagauggaaucuacagacagacaacagcuuggccauaugcgacaacagcacgcugacccacaaucugcagcagacauuccaggaagcuggccccaaaugaucaauugauaccagauucccuaauuuugucccugcugccaacuuuaggccaaccagagggagccaaauauaauccccucaccaaucacacaggaugccuccugugucaggcagcccuccuccagcuuucccgggccaacaagcuccagccccggcacaccccagccuuccccucucuccaccugaaagcuuucccacuccccgcuugccucagagucucugccaggcacaagugacgauggcugacucucuugcuacagcaagcucugaauaaauagccucugcguguucucaucuggguggucuuuauuuccacacuugugccuuagagguuuccucagagcuccuggaauaagaugcugauggaagucaggguucugggagauaugccauuccuucacaacuuuccaaggcccuaacuaccuuugucaaaacagaaaccaguguccucagguggacauuuuaccuguaaacucuggaucaaggucagaagauccaugugaguggauccaguguggagaugauuaggucuccaugagaaaggggugggggcggugcagggcaguggggggaucugugauccagagaccagauucucuaauucugcuguaauccuugaguuuccaggcaauagaaacccauagauuuucaaaaguaauaaauacaaaauauucuacccaaguuaggagcaauuugcaagacagugagugucuauuauaauacgguucuaggagacacauaaucccacuuugugguuugggguagugguaacaacaccugugacucaggugucuggaauuugaaguuggguaauaugucuuugucacuauuuacaugagggugugauuugacuggccauggaacagaggaauaaggaggcaauuuacaacaggguuuuuacaaaacaagguguguucaauagcacuugauaguugcauucucuaaguacauggugguaauaguaacaaguucagugaggauguuggaaagggagcaugccaagaggaggcugcuggcaaacagcaaaacucagggagaagucguccagcacuugagcugaauuuugaaaugcuaaaauaauuguccuuggaaaucaacaggcaaagguacaucaugucggagcuacacuuaucacaggguagaugguggcacauagacucaggcguccaccagggucaguccccugcaggccagucuagcugcccacgggccacugcagcagccccugggagcagugaggccacccuucucuguggguucauucuuuucagugguagguauuucacuccuucguguaaucugcuaggugguugggaugcagcaacguccacaagaaacuggaugcugccaggaugagaaagccacugcgagcccguugcaaaccuggcucuuccagaggggagcacguguaugagcagaaggaagcugccuuguuuaccugggugugaacaccaaaacuguggcccacaucugccuuaaaucaacacagcccuacagagguucuucauuccauuugcucuauuuuuuuuuuuuuuuugagacggggucucgcucugucgcucaggcuggagagcaguggcacgaucucggcucacugcaagcuccaucucccugauucacgccauucuccugccucagccucccgaguagcugggacuacaggugcccaccaccaugcccggcuaauuuuuguauuuuuaguagagacgggguuucaccguguuggccaagauggucucgaucuccugaccucaugauccgcccgccuuggccuccgaaagugcugggauuacaggcgugagccaccaugcccggcccauuugcucuauuuauuuucuuuccugaagagcugcuuccccguuucaaauccuuucaagaagagacuagauuaggaaugcugguuaguuugguccagaaucaugggagugaggagugagauggcaagauggaagggcagaugguaacgaagagagaccccaaaaggaugaguagaauuacauauagaaagcaaugucuguuuuauugcagaggacagaucauggaaaccauacacaaugaaaaaacaucaggacccauaaccgagaggccagacucuaagauccagcuucccucuggaugauggaaaagauccccaaagaugguccugagcgccaagcucucccaaagcaucucaaagacagggucaaaguaauggaauuaguauaacauuucucauuguuggcuguacauuacaaucacccagagaacuuaaugaaaaaaaaaaaccuguuugcauagguccauugaaacaggcucucuugggugcacuugggugucugcagguuuuuaaaagcuccccacguggcaguaauuugcaguaaggguugagagucuccagguuggagaaagacaacagguaaguccaaaaacagaaggagguacuggaggguauuucaccuggggcaugcucagucagucaguagaaguuuacuagcagacacauggcaucaugguagagccguccaugaaccucucucuuuccccuuccacgcugugcuccuugggccuggggaaggaaauagccucccugaaguucuuggcuguguggaggaggguagaugccugaaaauaacuggggugcuaugagguaggagaaagaggagcuggcugcugggaaggcacccaccagcuucugcuaugugcuagcagauugacuaaucaugaaguuuccccaacuugcuaguuuaaaaaguucuauguuuacaugauacuaccuaaaaauaaaucuauugguuuggggucauggcugggcuggagacgcagacauauggcagauagugccuuuggccaucuccugugcaacucucugaauuagaugcugaaaugguuuucuauuggaacugagaguagcuugcauggacaagauucuccuuuauuuacuucuggagacauucuccuaggagggaagaacagcaccagauggucuuuguuaguugugacucacguucuuaaguuagacaaacaaaugaaguuaaaaacuagguggguucuggaaucucagauuaaaucuaugcuuuuccaucugaaggucacacaaggauaggucuuuaucaucuacucuuagauguuuuucuuacacuguuuuucuuacaaaacuacuuuuauaaacaggcacugaggccauaaacgugaaaagaugcuuaaauuuguauuuaaggagauucuauauuacugcuuucaaggcuuuagaaucuuauacaauagaaaagacaaaaaucuguccauuuauuuuacaagaauggccuugcuugagaucuggcuugccauuggcuagcauauagaauuugcuauguauguuaaaaagcugauucuguaaaccgagguaauuaaucaguuugacacagauauuuucaaugguuucaacacaacucaaaaguaagcguuguggauuuuuaaccuucugcucugccugauuagaauggguauggcuucucaacagucuuaaauauucugcuuauaaaucaguucauucauucaauacauguccuaugugucugacacuguuaugggugcuggguaucuagcauaguacaaaacagacccaaaucccuacucuuuuuuuuuuuuugagauggagucuuacucugucacccaagcuggagugcaguggcacgaucuuggcucauugcaaccacaucccagguucaagugauucuccugccucagccuccuggguagcugggauuacaggcacccgccaccaugcccagcuaauuuuuguauuuuuaauagagaugggguuuugccauguuggccaggcuggucucgaacuccugaccucaaaugacccaaccgccuuggccuccuaaaguguugagauuacaggcaugagccgcugcgcccgaccucagaucccuacucucuugaaauuacauucuggugggaggagaagggccacaaacaauuuggugaaaugcauagaaugcuuugaaaaugugaguuauggagaagaauaagucagggaagagggauagggcaucaugcagugggauuugcaauuaaaaacaguggucaaggaaggccaggagaaggugacaguugaguaaagcuguaugaugacuuuccagggggugcccaggccccuuugcuccugcuccucugccacuuuguggguucuugccuauguaugaugccugggacacaucaccuucauuuggaaaauuaaaugggguuucagaggccaggugugguggcucaugucuguaauccuagcacuuuggggggccgaaguggguggaucaccugaggucaggaguucgagaccagccuggccaacauggcaaaaccccgucuuuacuaaaaauacaaaaaauuaguggagugugguggugugcaccuauaaucccagcuacucgggaggcugaggcaggagaaucacuugaacccaggagguggagguugcagugagccgagauuguaccacugcacuccagccugggcaagagugaaacuccgucucaaaaaaaaaaaaaaaaaaaaaauggggcuucagagacaagucucacucaguuugagaaacaggcaggccggaaagguugacccacagacagcagagaggggagugccucuucacgccuccucccucuucacaguuccagugguuuauuuuacuguccucuaauuucugacccacaaauguuaguguuuucaagaguucacauuuauauagcagacacagauggugacuauuagauuuuaguaaaguggauugaaaacuauucacauacaauugaggaagaagcaagcuguccaacggaguuagauguaaugggaugauucaucuauggacaaagaagaggaacucaagaaaagggcccaaaugucaggaauucaauucaauuucucuaacauuaaccagacacucuauacggguucagcaaagugaaaaguaggcauggugggaaaaugaggcaaacaauuaaaaaaaaaaaguguacuaccucuuagaaucaugcacaaaauacguuuguuaaaaaguaauguaagaaauccuaaaacuuuaaguauaaaaaaaaaagaauaaaccuaaaucacaaucugaaaaaaaaaaaaaaaaaaaaaaaaaaaagaaauccauaauugggaagccauauggcacagaagaaggaccauggauuuuuaagccagucgguucugggucugaaccacuauuaugacugucacuugcuagcuaugugaacuuggacuaguuauuuaaccuuuaugaaccucgguuucuucucacguaaaaugggggugauaggacaggauugucuggauaagagguaacauagguaaagcaucuaacaacagcaccagguauuauggugauuauaacaauagugauguauuuauuauucuuagucaaaugaaugccacuaagaauuugauuuauaagacucagagauggcagagaucugaaugauuuggcacauuuuuggggcgauuucaggaagaggacaaauuucaaccugggcuuugaaggauggauagauuuuagaaaaagagaaugaugaggggaaguggggaaagguagucccugaaugaaacuuagaagugaggaaaaaauuugaaaaaaaaaaaaaaccccaaaaaacaacaaaacaaaacaaaacaaaacuacuuauuuaggcaagagcuuggagaacggcuugaauggaggucuuugaaguaggaaaggagaaauaagguuggauaaacugauauauaaccagauuguggauagcucaaaagaauguuagauguaaacauauugcagcaaaaaauuaacuccuugaucacagacaaaacuauuaacuuuuugauccuagacgugcccaaguacaacuuuaagagagggcuauuucuuuagcauccaguuuuaguuauauuaaaauccacuuacaaaaguuauccuagagagguuagauauaagcauauacauguuuacaucuagaaguauauuucuauuuuauaacaaaaauuugguagcuuauggcugccaugcucuagcgggaauauuucuuauuacacuuguuucucgaguuucccucagaguguacgagagugugaaaugccuagcguggcagagggaguagaccaauguagguuggcauaugguuacaaggcuuaggcuuucuuucuugaugguuccucccaaauuuuaagaauuuacaguucuuggcugggugcgguggcucacgccuauaauacuagcacuuugggaggccaaggugggcggauccccugagguuaggaguucgagagcagccuggccgacauggugaaaccuccauuucuacuaaaaauacaaaaaauuagccagacgcaguggugugcgccuguaaucccagcuaguuggggugggggagggggacgggugcugaggcaugagaaucucuugaaccugggagguggagguugcagugagcugagaucacgccauugcacuccacacucuagccugggugacagagcgagaauccgucucagaaaaaaaaaaaaaaagaagaauuuauaguucuaagaaccucagcuagaauucuuuugcaguucauaugugauuacauauuuuuucuuuccucugucucuuuccucucuucuuuuacuccagaguaaugugccuagaaggagacagugcaucgaagcaaguuuacucucagcaugucaagaaaacauuaaaauauuauuugccugaugauugcauuggacacauuuugugaaauacaugaaucccuccuaccugggaugucaagagacugcucuuuugcugggagaauggacugaucuuuugcaucagcucaacgcugcuuuuggggagccauuuuggauacaauauauguauugcuuccuuuaaaugggaaauaaccauggucugucaacaaauaaucuuguuugauaaaucugacccagauggugugcuagguugcaaaaccgucuucuucugcuuuggaaaaacucagcucugucccuccaucccucccucugccaccagccucuguccacccccaagcccagcucccugauggcaacaguauaaccacugaggcugaaucagagccaaacccuuucccugcugcuuugaagguuuuuuugugcuggauuuagaauccuacacucaacacauugguuggaauuccugauuuccuucugcaaagucuccugccuuccucacuguacuccacuguuugaaaaaaaaauucaacaucucuccacugccuaccaaauaaaagucuaaauuccuuaaccugguucuucguggcuucacggucuaaccccacuacucuccuucacguguaccaucuauagccacacuugcuacuuggggcuauuucuaguauuugcauauguuuccugggucucucuggccaggcgcuccucucauuauuagaagaaaccucucuuuacucugaaagcguauguaucacaugaacugccaauuuaccagucucuccacucauugacgaauagccuacauugacaaguaguaucuuggaucauuaagucuucaggaauaguuuauaaugcaaucaaaagcauuuuaaggagguuaaaacuauuccuucuuacuuuccacuggguauucaauuaauuuuuuucaucuuucuuaguuuagauugucaguguuuuaaugacagucagcaugucuguuucaccuuuguugucaccacagggucuagcacaggugggguggaauagugggaaccuaaaaauucuuuguuggcugggugugguggcucacgccuguaaucccagcacuuuggaaggcggaggcgggcggaucaccugaggucaggaguuugagaccagccuggccaacaugaugaaaccccaucucuacuaaaaauacaaaaauuagccggguaugguggugcaugcuuguaaucccagcuacuuggguggcugaggcaugagaaucacuugaacccaggaggcggagggugccaugaguggagauugagccacugcacuccaaccugggugaccuauggagaccccaucucaaaaaaaaaaaaaaaaaaaaaaaaagaaaaaaaaauucuuuguuaggucucagcucuccacccuggaucuaccacuaacugccacugcccauaguccagugccaaagagaagaaaaaaacaggcaaacaaaaaauucuacagagaaugagacugacauauucugcaagaucugacuauagccuccuaaacccuagugauuggugacacggcccaggcaggaaacuguacaucagcccugggaggguagcacagccaucagcaacucgaaugcagccauauuggccuagaaagcuuuggggcagaaguuggggaauuaaggcaaugugguucccuucuccauaugaaaaggaaaugcgcucauuaaaauacauaaucacaagaaugcaguucuaccuagcagaguggucugcaaucuuuuuggcaccagggaccagucuugcagaagacagcuuuuccguggacuaggggaguaggggaugguuuugggaugauucaagcacauugcauuuauuaugcacuuuauuucuauuauuauuauuacauuguaauauauaaugaaauaacuauacaacuuacuauaaugcagaaucaaggggagcccugagcuuguuauccugcaacuagauggucccaucucaggggugaugggagauacugacagaucaucaagcauuagauucucauaaggagugugcaaccuagaucccucgcaugcacaguacacaaucggguuugugcuccuaugagaaucuaguguugcugccgagcugacagaagguggagcucaggugguaaugcgagccauggggagcaguuguaaacacauaugaagcuucaauugcgugucugccauucaccuccugcuguguggccugguuccuaacaggccacgguagguguccauggcccuagguuggugaccccugaccuagcagacugauuguauucacaagguuuuuaagaugaugaaauaaaccuuggaguagugaaaaaacaaagaguuuugauaucuuaauaauuuuuauauugaaaaauuauaaaaauuucccucaaauucacuuuuaugauaaagauauaggaucacaauaugaugaucuuuucuaugagauguuagucacaaucuauuuugccagaauaaaauauacaagagucuucaugaaauauaaagggaaaaguacuuaauuacagaguguauuuuccaggcaucauuacugucuagcauauuauuaaacacaaaguugacucaaucgauaugcuuucuuaucuauguuaauagcugauuuaucagucacuccacucauggacaaauggccuacauugacaaagaguaucuuaggucauaaauucuucaggaauagcuuguaaugcaaucaaaagcagugcuucauggggaaguuguuaaacuuucaggagaagagguuguaauuccuuucccaauguuuugauuacugauaacuuugaaaauguaggccagaauugguaagcugaguuaauaggagagcagguuuauuccuuugaucuguucuuuucugaccaucauuccauugcagagaaagagagcgguguuccucuuuucucucugcccucucauaauaaauccccuugucacauggagauugaaacucaagagccgguugguuguagaaucuugaugaguuuguagcuccuaauggagggaaauauguaauuauccauucggaccacgaaacucauuugcaaagguuaacaguguuccuacaauuuacaugccaugccaccugcuuuguuaaaagcaugccuaauuugaaugcuuuuggguaggugggacuauccagguuccaagcuguccaaacaccuagugagaaacaccaaaaccaguuuaggaaguuuuuggcccuuugggauucacugaacaaucaaucugacucauaccuugcuugcuuuuuguuuucucagaugcccccagauaguagcucuucccuuccucuuguuuacugccuauuuauuaggcaaaaaaaucacacacgcuucacagauguguuaugcucauuaacacccaucauaugcacauugaagggugugaacauucgcauugcuaaugaaaugagaauggcgagaggcagggcaagccaagcaggcgacagccgggugacuucucugcagggggcgguuugauggauguggauugugagccaacuagcucagguaucuuucacaguaacugaugggccugcaagaaacucuccugauucuaagaucuaggcucuaucagaggcagauccucaagaguaguaggcaucccagccaaccucccaagaaaagcauuccaaaaggagaagggucugaaugagacuuugaugaaagggccaucucuccgggauaaagaagcaugcuugccaccaccuuggaggaagauggauuuagaaaugagcucagggcagggccgggcacggaggcucacgccuguaaucccagcacuuugggaggccgaguuaggcggaucacgaggucaggagauugagaccauggugaauccccgucucuacuaaaaauacaaaaaauuagccgggcguggugccuguaguuccagcuacucaggaggcugaggcaggacaauggcaugaacccgggaggcggagcuugcagugagccgagaucgcaccacugcacuucagccugggcgaaagagcaagacuccgucuaaaaaaaaaaaagaaaugagcucagggcaaccaagaccuuaucuacuguuacagcaaacuugugcugugaacucuaggaggugugaaucccacgugggcucuaacauugcuuugauacuaagaucaguaacaggacugcaguuuacuuuaauaagacugguccuuuuuuaauuaaaaauauuuuuuuggagacuggagucuugcuguccugcccaggcugaucuugaacuccuggccucaaguagcccucccaucucagccuuccaaagcauuaggauuacaggcaugagccucagcacuuggccugauucuugauuucuaguaugcuuccucaaaagaauaauaccaugaauuuuuuuuuuuugagauggaguuucauucuuguugcccaggcugaagugcaauggcaugaucucagcccauugcaaacucugccuccuggguucaaguaauucuccugccucagucucccgaguagcugggauuacuggcaugugccaccacgccuggcuaauucuguauuuuuuguagagacagaguuucaccauguuggucaggauggucucaaacuccugaccucaggugaucugcccaccucggccucccaaagugcugggauuacaggcgagagccacugugccuggcuggcaucauacuuuuuaaauugcugcuucuuuacugucaggcagggggauggcaucuaucauuaugcaaauacauuugggaccuauggaguuuuuaaugaccccguggggcuucagaaaaaauacagauugccaaaugaggcugaacuauuccagauaaauggauugggaauggcagcuccacauuguuuauuuguuuauuugcugucuuaaagugaauugucuuuucucgcugagucuuuaauaauauauacacuggugccuccagagagagcuauuugggaucuuugguucccugcaaaaugagaucgcaauaggauuuuugacuucucacaucuuucuauuuaucugcccucuugccaauaugcaucuagcugccuguucuuacugugauugauauuuuuacuucuauuccuucuagaacauucuacuaauuuguguuggaucuugcaagggcuaggaaaccaguuaaugauuucuauuagaacuuugcauaaaauagguguaaauaaggccugugcggguauuauuugugccuaccuaguuuucucccucugagauccucacauccccauuaggcaccacguaaauauauaauuccuuccuagagucuggugccaauuaugacugugggcaguagggauuuaccuugcugauggucaugcucugaaucugacacagucuuccugcagucuuggcagccagcuucccauuucuuuuuuuuuuaauauauuuuuauuauacuuuaaguucuaagguacaugugcacaacgugcagguuuguuacauauguauacaugugcuauguuggugugcugcacccauuaacuugucauuuacauuagguauaucuccuaaugcuauuccuccccccaugaagccagcuucccauuuuuaaucccaguugcucuauguagauuguuaaccucucccuuauucugaaaaccccuggguguucaggacuggguuccugccauguucuugccaucuauuuuuuuucccucuaucuuuuuuuccuucccuaacaaugaauauucucuuugacuuaagaaggaugcucaggagagagcaaucaguacuaaguccggcaaaaaguaggaucucagcauguguuuguuaaaugaaagcauaaauaauauauaugaauauacuccagccuagacauuacucucagaagcuguacauuguugaaagaacacauuuugucuuaaccauagguguuuauauaaaaaagucuguagggaauuuggucaagugguaggcaaagcaggacuuauaaaacccaagcacauuuaugaaaaccaaaauuuccaagaauguggcuuuaucaaggcauucucauuaggcuagaaagguaacugauagguuuaaaauaucaacaaagauauaauccauaaauguuucugauuauuuauuccugcuacuauucugucuauaaccagagcaauuaacaacauuuuugucaggccucugagcccaagcuaagccaucauuuccugugaccugcauguacacauccagauggccgguuccugccuuaacucaugacauuccacuacaaaagaagugaaaauggccuguuccugccuuaacugaugacauuaucuugugaaauuccuucuccuggcucauccuggcucaaaagcuccccuacugagcacccugugacccccacuccugcccgccagagaacaaccccccuuugacuguaauuuuccuuuaccuacccaaaucuuauaaaacggccucaccccuaucucccuuugcugacucucuuuuuggacucagccugccugcacccaggugaaauaaacagccuuguugcucacacaaagccuguuugguggucucuucacauggacgcaagugaaauuuggugcugugacucgaaucaggggaucuuccuuaggagaucaauccccuguccuccugcucuuuggucugugagaaagauccaccuacgaccucugguccucagaccaaccagcccaaggaacaucucaccaauuuuaaauccaguaagcggccucuuuuuacucucuucuccaaccucucucacuaucccucaaccucuuucuccuuucaaucuuggugccacacuucaaucucucccuucucuuaauuucaguuccuuuccuuuucugguagagacgaaggagacacguuuuaucuguggacccaaaacuccggcaccggucacggacuggggaagacagucuucccuugguguuuaaucacauggggacgccugccugauuauucacccacauuucagaggcaucugaccacacggggacgccugccuugguccuucacccuuaguggcaaguaccgcuuuucuggagggcaagaacccccuaaccccuucucuccaugucucuaccccuucucugcuuuucuggggggcaagaaccccccaacuccuucuccuucacccucagcggcaaguaccgcuuuucuagggggcaagaaccccccgaccccuucucuccaugucucuacuugcucuuuucucugggcuugccuccuucacuaugggcaagcuuccacccuccauucccccuucuucucccuuagccuguguucuuaaaaaccuaaaaccucuucaacucacaccugaccuaaaaccuaaaugccuuauuuucuucugcaaugccgcuugaccccaguacaaacuugacagugguuccaaauagccagaaaauggcacuuucaauuuuuccauccuacaagaucuaaauaauucuugucauaaaauaggcaaauggucugaggugccugacauccaggcacucuuuuacacaucggucccucccuagucucuguucccaaugcaacuugucccaaaucuuccuucuuucccucccaccuguccccuuagucccaaccccaagugucgcugagucuuucuaaucuuccuuuucuacagacccaucugaccucuccccuccuugccaggucgagcuagguuccaauucuuccucagccuccacuccuccacccuacaauccuuuuaucaucuccccuccucacacccaguccggcuuacaguuucguucagugacaagcucuccccaaccugcccagcaauuuccucuuaaaaagguggcuggagcuaaaggcauagucaagguuaaugcuccuuuuccuuaucccaaaucagauagcauuuaggcucuuuuucaucaaauauaaaaacccaguccaguucauggcuuguuuggcagcaacccugagacgcuuuauagcccuagacccuaaaaggucaaaaggccgucuuauucucaauauacauuuuauuacccaaucugcucccgacauuaaauaaacuccaaaaauuaaauuccggugcucagaccccacaacaggacuuaauuaaccuugccuucaagguguacaauaauagaguagaggcagccaaguagcaauguauuucugaguugcaauuccuugccuccacugugagacaaaccccagccauaucuccagcacacaagaacuccaaacgccugaacugcagcugccagggauuccuccagaaccuucucccccgggagcuugcuacaagugcuggaaaucuggccacugggccaaggaaugcccgcagcccaggauuccuccuaagccaugucccaucugugcgggaccccacugaaaaucggacuguucaacucaccuggcagccacucccagagccccuggaacucuggccuaaggcucucugacuccuucccagaucuucuuggcuuaguggcugaagacggacgcugcccgaucaccucggaagcccccuagacuaucacggaugccgaucuucugguaauucucacaguggagagcaagucuguccccuucuuaaucaauauggaggcuacccacuccacauuaccuucuuuucaagggccuguuucccuugccuccguaacuguuguggguauugauggccaggcuucuaaaccucuuaaaacuccccaacucuggugccaacuuagacaauacucuuuuaagcacuccuuuuuaguuauccccaaccugcccaguucccuuauuaggccgagacacuuuaacuaaauuaucugcuucccugacuauuccugggcuacagccacaccucauugccaccuuuucccccaguucaacgccuccuucacaucccccccacuuguaucuccccaccuuaacccacaaguauaggacaccacuacucccuccuuagcgaccgaucaugcaccccuuaccaucccauuaaaaccuaaucacccuuacccccucaaugccaauaucccaucccacagcaugcuuuaaaaggauuaaagucuguuaucacuugccuguuacagcauggccuuuuaaagccuauaaacuccccuuacaauucccccauuuuaccuguccuaaaaccagacaaggcuuacagguuaguucaggaucugcgccuuaucaaccaaauuguuuugccuauccacccuguggugccaaacccauauacucuccuauccucaauacuucccuccacaacccauuauucuguucuggaucucaaacaugcuuucuuuacuauuccuuugcacccuucaucccagccucucuuugcuuucacuuggacugacccucacacccaucaggcucagcaaauuaccugggcuguacugccgcaaggcuucacagacagcucccauuacuucagucaagcccaaauuucuuccucaucuguuaccugucucagcauaauuaucauaaaaacacacgugcuuucccugcugaucgugucuggcuaaucucccaaaccccaaucccuucuacaaaacaacaauuccuuuccuuccuaggcaugguuagugcggucagaauucuuacacaagagccgggacagcacccuguagccuuucuguccaaacaacuaugaccuuacuguuuuagccuagcccucaugucugcaugcagcugcugccacugcuuuaauacuuuuagaggcccaaaaaaucacaaacuguguuaaacucacugucuacaguucucauaacuuccaagaucuauuuucuuucucccaccugaugcauauacuuucugcuccccggcuccuucagguguacucacucuuuguugaaucucccacaauuaccauuguuccuggcccagacuucaauccggccucacacaguauuccagauaccacaccugaccccuaugacuguaucucucugauccacuugacauucaccccauuuccccguauuuccuucuuuccuguuccucacccugaacacacuugguuuauugauggcaguuccaccaggccuaaucgccacacaccagcaaaggcaggcuaugcuauaguacaagccacuagccugccucuuagaaccucucauuuucuuuccaucguggaaaucuauccucaaggaaguaacuucuuccaucugcuauucugcuacucuucagggauuauucaggcccccucccuucccuacacaucaagcucgaggauuugcccccgcccaggacuggcaacucuuaacucccucuuagaguggauagaugaucuuugcuggcaggggacccuccaguacuuucacccugacgaaguucuauucuuuacuuuuauacucacuuuuauucucauucccauuccucugccacccucuaccucuccccagcuaucuccaccacgcuaucaaccuuacucauucucuccuagccguuucuaaucccuccuuagcaaacaaccacuggcuuugcauuucccuuucuuccagggccuacacaguuguccccaccuuacaugcagacuaggcaacaccuccugucucccuacaccuccagacuuccuuuaacagcccucacuuuuacccuccugaagaacucauuuacuuucuagacagguccagcaagaccuccccagacauuucacaucagcaagcugccacccuccuccacacuuacuugaaaaaccuuucuccuuauaucaacucuacuccccccauauuuagaccucucacaacacaaacuacuauuccuguggccgcuccuuuauguaucucucagcaaagaccuacuggaauucccuuagguaaucuuucaccuucucgauguuccuuuacucuucaucuccaaagcccucuucuuguuuacuuauacccagccccgaaaauaacagugaaagguugcucguagauacucaacguuuucucacacaccauguaaaucgaaccucccccucuacgcaguuacuucaucaauccccauuacaaccucugacggcugccacccuagcuggauaccuaggagucuggguacaagacaccccuuucagcacugcuucucuuuacuuugcaucuccaguuuugccucgcacaaggucucuucgucuguggauccucuaccuacaugugucuaccugcuaauuggacaggcacaugcacacuagucuuccuuacccccaaaauucaauuugcaaauaggaccgaagagcucccuguuccccucaugacaccgacacgacaaaaaagaguuauuccacuaauucccuugcuugucgguuuaggacuuucugccucuacuauugcucucgguacuggaauagcaggcauuucaaccucugucacgaccuuccguagccucucuaaugacuucucugcuagcaucacagacauaucacaaacuuuaucaguccuccaggcccaaguugacucuuuagcugcaguuguccuccaaaaccgcugaggccuugacuuacucacugcugaaaaaggaggacucuguauauucuuaaaugaagaguguuguuuuuaccuaaaucaaucuggccugguguaugacaacauaaaaaacucaaggauagagcccaaaaacuugccaaccaaguaaguaauuaugcugaacccccuuggacacucucuaguuagauguccuagguccucccaauucuuagucuuuuaauaccuguuuuucuccuucucuuauuccguauaguuuuucaauuuauacaaaaucguauccaggccaucaccaauaauucuacacuacaaauguuucuucuaacaaccccacaauaucaccccuuaccacaaaaucuuccuucagcuuaaucucucccacucuagguucccaugccgccccuaaucccgcucgaagcagcccuaagaaacaucgcccauuaucucuccauaccaccccccaaaauuuuugccgucccaacacuuuaccacuauuucauuuuauuuuucuuacuaauauaagaagacaggaaugucaggccucugagcccaaggcuaagccaucauauccccugugaccugcacguauacauccagauggccgguuccugccuuaacucaugacauuccaccacaaaagaagugaaaauggccuguucaugccuuaacugaugacauuaucgugugaaauuccuucuccuggcucauccuggcucaaaagcuccccuacugagcacccugugacccccacuccugccaccagcgaauaaccccccuuugacuguaauuuuccuuuacuuacccgaaucuuauaaaauggccccaccccaucucccuuugcugacucucuuuuuggacucagcccgccugcacccaggugaaauaaacagccuuguugcucacacaaagccuguuugguggucucuucacacagacgugagugaaaauuuucaucucgacugaaggcuuugguucaaauaaaaugaguucccaauugcaagccuaaaggcaaaggaaacaauguuguucaggcaugaaucacugugaaggucauugugugugacaguuguguagggggcuggaugugaacuacauacaauagucuuaucauucaacaaacaaaugugcuuaaagaaucaaugcacuuaaacucauuacugcaauguuucccuguauagagaagaauuccucuagaaaaucuaggcuuuguggagauuccucaagaaucuagaaccagaaauaccauuugacccagcaaucccauuacuggcuauauacccaaaggauuauaagucauucuacuauaaagacacaugcacauguauguuuauugcggcacuauucacaauagcaaagaguuggaaccaacccaaaugcccaucaaugauagaauggauaaagaaaauguggcacauauacaccauggaacacuaugcagccauaaaaaaggaugaguucacguccuuugcagggacuuggaugaagcuggaaaccaucauucucagcaaacuaacccaagaacagaaaaccaaacacugcauguucucacucacaggugggagcugaacaaugagaacacauggacauagggagggggacaucacacaccggggccuauuggggggugggagggcuaggggagggauagcauuaggagaaauaccuaauguagaugacagguugauggguacagcaaaccaccauggcacguguauaccuauguaacaaaacugcacguuccguacauguaccccagaacuuaaaguauaauaaauaaauaaauaaauaaauaaauaaauaaauaaauacauaaauagguuaaaauggaaaaaaauaaaaucuaggcuuuuaaacuagauuucaaacuucuaaaauuggaucuacuuuuuaaaaaaugccaauuuaaaaauggcacagauguguagguacauucguucuuagccauggauacggacaaaucauugguuaagcuuucuguaguuguugagaauacaguugauuaugaaguuucucuuaaacucuuuguuuuuuuccaaguuuucugcagugaacauguauuaauguuauaauuguaauuauauuuacauauaauuauauguaauccuaugacauauaauucauacacaacuauauauaauuuuauauucucuccagagcauuucuucuuaaagcaagaagaaaauucacugcgugggaggaaaaaccuaguauuaaaacaugaaauucauuuuaauacuaagggaccucacuauuugaaaaaaauuacuuguaaauuucuuagcugaucaauuaauucuuuugaaaagcaaauuggaaauuaugccaugacuccagcuuuaauaagucaagaauauugugaaaugaguguuuaguauauucuuuuuuuugagacagggucucacucugucaaacagguuagagugcaguggugugaucucagcucacugcaaccuccaucucccaggcucaagcaauucuccugccucagcauccccauuagcugggacuacaggugugugccacgaugccugggcaauuuuuguguuuuuuuuguagagauggguggguuuugucauguugcccaggcugaucucaaacuccggaacucaggugaucugcccaccuccgccucccaaauugcugggauuaccggcaugcgcuaccaugcccagucucuauguauauucuucacauuuuuucuaaaauagaagugcugaaggauucccauuaaagaugguggauugagcaccuacauuuaccacugcuucuucauaaagcccgugaaaaggggaaugaaguguuaagauauacgaagguguaagaacaaaucaugaggcaggggaugauaacaaccuuuuuagagcugaaaaacagcagaaccaucuuaaguggcagcauauccaaggacagaugcuugcacugagguggagagugcugagaaguagcccgguuggcacugcaaagccgcccauuauuugugcaguugauggcaagaguuuccacuggauauguguguuuaugugaagcuaaaaacagaagaacucacuggaagcucgugaagaacauuuauauccccagaucccuaccccaggcaucuguccuccccucacucuggcagaagaggaacgauguauucucugggaaggacacagagacucucaguuggaggacucuaggcauaggacggcaggggcucuguacugaaaacagggaucuucagucaacauuuacacacugaaucuugaaccucgcaguccucuuccuucuuagcugugagaacagugacagccaggugucuacccuccaggcaacagggcagaaaauucuucucuggagcuuucaaucagcccaagacaaaaaucucagugaugcaacaucaggggcuucccgaugaaacaacucagccacugaagcccacgggugacaggccccauuugugugcacagaacuuucagucauauuuguagugccucaaucuuaaaugugggugucagcuaaaggggaaccaggcauuugaggacaugucucaaacacaggagaagaaaaaagaaaaacaaacgaaaauacacauauacacacacacacacacacaccaaccaaccaaccaaagaaagcuacuugaaggaaaaagaggcugaguaggaaaagaaacacuugggagaaaaccgucauuaauaccuucugagagauaacauauugcuuucaugaaaugagaacagaugauuuaaaaaaaggaacauucaaagaacaaaaaauagagcucuuggaaauucagaacauaaaaaaagaagugaaaaacucaaugagaguuuaugaaauguaaauuugagaacauuguucagagaauaggggaaacaacagccaaagaaauugaacaaaugaaagaaaauauaagaaaauaacagaucaguccauggggucugauagcugaauaacaaauucugggaagagagaacaggaaaugaaagaagaaauugucccccaaaaucuauuccuagaguucaagaacggcuuuccagauuaaaaggccccauguguguuccaacagaaagagucaaaauagacccacaucaaauaauauucaugagauuucagaaaacaaagaagaauaagaaccuaaaaucuuccagagagaaaaacaccgaguucaaauaaagaauugagaaugaaaauggcauugaauuucuugagagcaauacuauugacaauagacaaauuccuucaaacuugugaagggaaauaauuucuaaaugagaauucuguauucagucugauuucaauuaagcaugagggagaauaaagacauuuucagacuugcaauguuucagaaaaugugauucccguucauucuuucucaggaagcuacagaaggauggcuccauuuuuaaaaaagggacuagaucaacaaagagaaagucauggaagccggguaggagggggaucucaugccauccggaggcccagguuaucuaugaugauggagaagagagaugcaaggauggugauacggcuuggcucugugucccccccgcaaaucucaccuugaauuguaaucccaugugucaggggaggguccuggugggagaugauuggaucaugggggcggauuucucccuugcuguucucaugauagugugaguggguucucaagagaucugaugguuuaaaaguauguggcagaucccagcucacucgcuuucuccugcuuugcagagguaagacaugcuuacuuccccuucaccuucugcugugauuauaaguuuccugaggcgucuuagccagacuuccuguuaacccugcagaacugcgagucaauuaaaccucuuuucuucauaaauuacccagucucauguaguucuuuauagcagaaggaagacagacuaauacagaugcccaaggccuauccagccagaaugcucugggguagaaguuuccaagaaaaugaaauggugaguuccucuuauauuggcugcaauauguugagggaagauuuuaaaauugagagagagcuugaguuucaauucauaauuaguucacaaaaaauuaagcaaaugaagaaaacaauauaaugauuaaggaaaacaaaauaguguguaggaaaggaaacuuuuuuuuuuuuuuuuuuuuuuuuuuuuuugagacagggccuuggucuuucacccaggcuggagugcaguguugcuaucauagcucgcugcagucuccaauuccugggcucaagugauccucccacuucagccucccaaguagcugggacuacaggugugcaccauaauaccaaguuaaugucuuuuuuuuuuuuuuuuguagagacaggaucucacacuauguugcccagguugaucuugaacuccuggccucaagcaaucccucaccugugccucccaaagcacugggauuauaggaaugaaccaccaugccuggcuggaaacacagcucuauuauaugguucaguuaugaaaagcaugaugauguaaacacugcauacggaucuauccaaagccaguaaaccauccuauuggaagggugaagguaaaggaaaaacauggaggggaggaggccauggaggagaguuguuggcugugaaagagccuaauccucaucuuccauagucaggagucaccuaacagugacugacuaaaaacagaaacucaaggaguagccuaggagacgguaaaggacagcccacugugcagccaccuguguuuguagauaaaguuuuuucagcacccagcuacacccacucauuuacauauugcccacagcugcuuuugugcuacaacagcagaggugaguaacugcaacagagacucuauggcucucaaagccuaaaauacucauuguuuugcucuuuacaggaaaagucugcugaccccucaaguagcaggugaauauauuuagagaauuaaagacaaaugccaaaggaaaaaaaaaucuugaaaauuggaugguuguuuauccuaauaagccauauagaacuauuugacacuuuaaacaagaugauuuuauuacuuugauaaaaauaaaagcuaaguaaaaaagaaguguuaauauguauuaucagaggcagcagacauuuuuuuccaggacgauaacaaaguauaaaaacaaagcaccucccuucuuugauguguuccuuuuuucgauguuuggacaauuucuuugcuuacaaucuaauuuccuguuuugaaccuaucaaguuuccucucuuuuggcuuuuuuauuuuuaguuuugguuaaaaaccaaggcaggaagcaagaagucaagcauaagguuuuaaaugacuucucuucuacccucugaauguaucuagagggagggagguugcagauuuguagauucccaggcaauccacaacuucaaagaguucgcuaaacagauuuuauucacuuaaccaaaaguaaucucaaauuuucuucaaacuucaacuuauuuaucuuaaaaggaugcaguggagacucacauuccacccagugacaacuuuccuuccuaauguaaucuugaaauggaaaagcauccauaauuaaucuggaagugggcugucuuagccauuaaacacguuuccaauuuagacuugggcuuugucccagcaaucugaaaggucauuuucuauccacggcuucaagauaauucccaauuaggacaauaaggacaauuuccagaaaaugagcuuuucuuaauacgugcaaugucugauaauuuauugauauuaucauccagacgugaugguaaauauuucuauucuggggucugggaugcgaaaaagaaggagccauucucacuauugcauucucagcuuaguauguaugaccuuauucagcagaaauuucagcugcaacacggccaagcuuauaggccccgagggacuuauguacuagcagagcuugaagcugagucagcuggccagggcccaagcuccuaagagaggaugcgcccuuccagcucucauggcguguuggcuguccaccuacccgucucugccuggcuaugucacuucaguauguucagcaggugcuuacugagcaccuucuaugugcuuagcucugcaugaccccugugaacaaaaccaaucuaccuugcauucucuaccuggaagaugaaccacuuccauuuaugagcucaaggaaauccuucgucuucaggaucaaguuaaauuucaggagugggaauauuuguucuauuaguauuuucaggauguaugggacccaguuaccaugguguauuaguccauuuucacacugcuauaaagaaauacccaaggcucaugccuguaauccaagugcuuugggaggccaaggugggcagaucuccugagagaucaggaucaacuauggccaacaugugaaacucugccucuacuaaaaauacaaaaauuagccagacacaguaguaggcgccuguaauccaagcuacucaggaagcugaggcaggagaauugcuugaaccugggaggcagagguugcagugagccgagauccugccacugcacuccagccugggugacagagagagacucaaucucaaaaaaaaaaaaaaaaaaaaaaagaauaaucgagacugaguaauuuauaaaggaaagagguuuaauugauucacaguuccacauggcuggggaggucucaugaaacuuacaaucauggggaaggggaaguaggcaggcgagagaagcgaaagcuaagggagaagagccccuuauaaaaccaucagaucuugugagaacucacucacuauccugagaacagcgcggggcaaaccacccucaugauccaaccaucucccaccagguccccccuugacacauggggauuacaguucgagaugagauuuggguggggacacagagucaaaccacaucacauggcauaggggauauuggggacacaggaggaaugggugcagcuuugggaggcugaaaaagggcagggcaagggagaaggaggcacagauacuucagugugagcuuuaauauucaugugguucuaggguucaugcauuagacuuuucauuucauguuccucuccccuaaccaaguucagcccuucugggucuuaauguacaucuaaacuuuugcaacauuacccuggcuggucucauugccaguagaagcucaguucuuuaacucauuauauacccuacugcuagguagauuuucuuacacauccuuuguacauuccucagccugcuagaugagccaccaccacuaagaaaguggccuucacaagggcagguucggggccugucacugcuggaguccagcauccagcagugaccuggcagcaggaaucuuaugugucuguugccuggaaggcaaagagaaucauggaguuuuccagcaggaagagcaagaucagcuaggcugugcuuccgucuuguaaaggagcuagccuuggugucauacagcaggaacugaggucccagugauuauucaaggcuauagggccaguuuguggauaggccaggugucucguccauccacucucuuccauucagagucccucaaagucacccauggguccuccucaaugcuucacuuugacgcagaagccuucuaccaccaacaggcucaucuucuugcuguucuacggacccccugguguggugaagccugcucaccuuuguuaaggccaucccacuggcacagauccacauccgagcuacauacuucuugaagugggcaugguccaguucuaucuccacaaagcuguccuccagauuucugcucuaucccuucucaagggaauacauauuccuuuuuaaaaaaucacuaauuggguacuuaaaacauuaacuagaaguauuuuacauuuuauuacugcauuucaucucuccaacuugcugcuaaaccccaugaggacagaggggauguuuagacacacagacuugcagaguugaaugcauccuuggaguccaucuguuucuacacauuuauuucacagauaaugucacugaggcacagaggaaggaaauggcuugcccauagucuuuuuuuuuuuuaugcaguaaaauguaccuaacauaaaauggacauuuuaaccuauauauauauauauauuuuuuuuuuuuuuuagacggagucucgccuugucacccaggcugaagugaaguggcaugaucuuggcuaacuacaaccuccgcaucccggguuccagugauucuccugccucagccuccugaguagcugggauuacaggcgcaugccaccaugcccagccaauuuuuguauuuuuaguacagacgcgguuucaccauguuagucaggcuggucucaaacuccugaccucgugauccacccaccucggccucccaaagugcugggauuacaggugugagccaccaugccuggcccauuuuaaccuacuuuuaaauguacaagucaguggcauuaaguguauucacauuguugugcaccaucaccaccacccaucucuggaaauucuuugucuugcaaaauugaaacucuauacccauuaaacaacaacuccccauugucccuccucccagccccuggcagucaccaucugacuuucugugucuaugauuucaacuccucuaaguaucucauagaaauggaaucauacaguauuuguccuuuuguaacuggcuuauuucccuuaacacaauguuaagguucacccauguuguacguauagaccacauuuuguuuaucuguccaucuauggacacuugguucuuuccaccuuuuugcuauugugaauaaugcugcuaugaacauugguguacaaauagccuagggucuuuuagugacuuuuuuuuuuuuuuuuccugcuuagccuaguguuccucacaggguggaaacucagugaaaaaaaaaaaauuguuaugauuauaaucuuagcuagccccuuaaucuuauugagaaaagaagauuuaagccaugaaacaaaagacuauccuuucuguaauauaguucauaugcugaugcucuccaaaugcaaucaacauuuaaucauaacauauaacgaguaugaaaguaugaauuuucuuuuuacacauguauuuaucuucucacuuguauuucuacauauauuccagagaggaggaaauaugauucaggacuuuguuucucucuaacauaagguugucccuuaagaauccuugguaaagggccuaucaugaaaccauaaggcuuuuaagaauccaaugucaaggauuuucuuugacaaaaucuccuuuagcaucucuccugcuggguuagagaaagagaacaauucagcaaaaacacuaggagcagcuuucccuuuuccauuuccauacgcccuuucucuguagauguguguccuugaaaauccguuaucccuguucaacucucucaaggugaauucaaggacagaggccucuuacuaugagcauuaacuuuaguggacaguuuuuuaccuccuuacacaagccuauauucagcaucaaaucaauuccuuuggcaguuauuauuauuuaguguuagcucuccaaagugacuuuaaaucucuuuucuuaguuaagagaaauggaaaaaucuuucucugccaguugcucacagugauuucuguauuaucaggagcuuauuaagcuaaaaagccuacugggcaaagacuaaucaucauuuuaugcauuucuagagcacauuacacuuuucaaauuguaccuuacauccaauauuucuuuuggucugugaaacaauuagguugggaaaauaaggcugaguuaauuauuaggccaguggaaugaggcggagcugaggcccgagggaagcaaaguguggagggucacacagcagcgaucacuacaguggcuagucagaaaaaaaucguugacuguuaucugugugcccuuggaaacaaccuagaaacacguggucauuggaggugcauccuguccugugcagaaucgcgccugccuggccugagcuggcucugcccagccuuccuggcucaucagaacuuucucugguccaggcgaaaugcccuccucuaguuucugaugcaacacaccuuuucccagcucuguuuccuuuucuuuucuucaccuggcuacuucuacucauucuuuaaaaaauauuuuuaaaaaguuggggccgggugugguggcucacaucuguaauaccagcauuuugggaggcugaggagggcacaucacaaggucgggagauugagaccauucuggcuaacacggugaagcccugucucuacuaaaaauacaaaacauuagccaggcguggucgugggcgccuguagucccagcuacucaggaggcugaggugggagaaaggcgugaaccugggaggcagagauuguggugagcugagaucgugccacugcacuccagccuaggcgacagagcaagacuccaucucaaaaaaaaagaaaaaaaaaaaaaguuggccaggugccaugacuuacuuuaggagaccacaguggguggaucacuugagcccaggaguucgagaccagccauagacaacuuagugagaccccaucuuuacaaaaaauacaaaaauuagcaagguguaguggugugugccuguagucccaguuacuugggaggcugaggugggaggaucaccugagcugaggagguugaggcuucaggcugcaguaagccaugauuguaccacucgacuccagccugggugacagagugagacccugucuaaaaaauauauauauauguauauaugucugugugugaugguuaauauucagugucaacuugauuguauuguuccaauccuuggaacuugguuggauguaaaguauuguuccugggugugucugugaggguguugccaaaggaaauuagcauuugagucagugggcugggagaggcagacccacccucaaucugggugggcaccaucuaaucagcugccaguguggcuagaauaaagcagggaggagaagauggaaaaaauuagaaagauaguucuugaaggauggucaggaaucauuaccaucuucuaugcucugcccucccguugccccagccuagaagcauuuucaacccuuuaggcugacuuaaaaacguaucuccaaaugauguggugacauugcaauuucaugacauguuuuuaggcauuaucuauucacuuaccaauacggaugaugaugaguuagcuucuacucuccuccccaccauccacuagcaccauccaacuacccuucuaaaauaggcagguuggacuuggaguuagaucacaauuugguuuuuauaggauuaaggucacauaugauuaagaccacguaaaugccauuuagggcuaagucauuauuguuuccuacaguuacuuuucuuuuccuguaguuuuucuuuuugcugaguuuuauuuacuuuaaauuuguuucauuuuccuuuggugaucguguuuuuguguccuccuucaauccuuaauugagaaugagaaagaaaagcagcucuugagcguggggagcuguuugggaacucacagccaggccaugugugcuucuguuuggggugauccauuucacagaacucaacaucagacaaggucauuccgugaccuucauggggaaaggcaaagaagaggucacuccaugagacaugucucagcacugaaaaaagaaaacuggccagaacacgaaaaugauccaacauaccccuucucagccuaauacacaucauuucuacuucuuuaccaacuacagcuguuuuucucuacugucuucaagauaaaaaaaaauuaagauauucaaucacagaauuaccugcuuccugacaguauccaaucuagaacaaaccccuacuuuuuuuaacucuccccaaaucaccuacugaaaaccgaauagcacuuucuagcacccucuuuccagcauccucuuacugagaugccucuaugguucuccauaaugagcaaucucccaugaugcaaugagugaagaaucccacauuuguucuacuacaggugggcuccuaguggucaguggcuguaauuaaucucugcauuugaagauccaucaauauucaucugugagcccuacagucuuggaugggaacccuccacucaccaauuuuagugugcuuauuugagacccuuugugucucuagcugucugauguaaccacacugcccgugcuaggagaaguucaugcugaacugagcuuccauauucugcugagguccuuccacuuuagguguuuuuccuuccuuccuuccuuccuuccuuccuuccuuccuuccuuuucucuaucucccucucuuuuuuuuucuuccccuaggaauaagguuaccagugacuuuuugguuaucugaucugauuuuuauuguucuuuggugauacuguuuaccagucuacagauauauguuccuauggacugucugcuuguacagugucuugaguguucuuuaucucuaaaacaaaaggucucuagggagacaaugagcauaagccagguaagucaguucuugagcuggcucaggggccuaggaguucagaaguucuccuacaaucaacauucuuugaauaaacuuugacuugggucaugauuucgaacccuuagaagaacuuuuucgucggucuuguucuuuuccugagagcugcuuuguuuagauuaggcuucuugaaaucagaagggauugucugacccuggaaugggcuuuggccaaguccugacgaaaguaggcugcacgggcaccaucgugugggaggaucuauugcagugcucauagugucugauccauccuaaaacugggcauuuucuaugaaacaaauaccugcuuucucacaucaccuuaacugacaugcuugugucuuuaacuggcagaauuucacgggauaauuuuuuuuuuuuuuuuuuuuuuugagacagagucuugcucuguuucccaggcugaagugcagcagcgugaucuuggcucacugcgaacuccacccccgggugcaagcaauucucaugccucagccucccgaguagcugggacuacaggcguaugccacuaugccuggauaauuuuuuguauuuuaguagagauggugggcggggggggucucacuguguugcccaggcuggucucaaacuccugaucucaggcaaucugcccaccucagugcuaggauuacagaugugagcuaccaugccuagccaauuucacaggauaauuuugaacugcaguggcuauuuuggggaccuuuuugacaugaacaagauuguucauuugaguggugccugagaacaaaaauuggagaaagcuucaugaagagauaccugucuugcaaucuaaaaagagagaguuuuuggcucauuguaaaugcuguuuucuacauuucuguucuuugaggauuaauaaagucuggcuuuuaaacauguuacuugauaagaauuucaaggcccaaauaauuguuuauaccagcuguaagaguuaucuuuugcauguauauaugucacaguggguuuuccugaaucuaaacauuuagugccucuucuugcagagggaagacccuugcuuuuuacagcgauaaugucuuaagugucugaaggugggucccuaucacugcuuuuuuuucuauuccuuuccuccucuuuuauccucuuuugggaagcuuuaaaaauuaauugaggccgggcgcguuggcucaugucuggaaucccagcacuuugggaggccgaggcggauggaucacgaggucaggagauggagaccauccuggcuaacacggugaaacccugucucuacuaaaaauacaaaaaauuagccaggcgcgguggcgggcaccgguagucccagcuacucgggaggcugaggcaggagaauggggugaacccgggaggcggagcuugcagugagccgagacugcgccacagcacucccgccugggcgacagagcgagacuccgucucaaaaaaaaaaaaaauugauuaaaauauucacucuaucauuaugagugcacauuaggaauaucuguaccauauuaguagucaaaaaugucuaaaaggaaaaauauuaagcugugcuucuuuuguagcccuuguuacuauaguuacaagauaagaagaaaaccuuaguucaagauagaagaagagccuugagcacgacuuagggucuuuacaauuucauuuaucauauaaaaauaauaucagaauaauacuuugguuuguacgagaccaaugauaaauuucuuaucauuuaaguuccuaaauuuccuacauuguuuuuauaaguggaucaucacaaauuuuauaacuuguuuaaaauguauacacauacauacauauaauuauagucaauuaaaugaaaagguaauggauuuuuaaaagaauuaaguuuuguaaaauuuuuaagugcugggugucaggauucauuauguuugcaaaaauugugauuucucgauccuuaacuaacuuuaagaccuuagacaaauggugaaguuaauuaguuaauaaucuuugaaaccuagacaauuucaagagugaaacagaugcaaaauaaaugcugguugguaacacaauuuuaacuuacccugaauucuuagaauggcaauagauuaauaaaauaugcaaauacuuuuggaugauauaauauauauauguuuauuuuugccaccucaaguauguuaaaaugguauaaaauuaguguucguaaggaaaagagauucauaaaaguuuuuuguuuuuugucuucuaguguucucuuaugucuggacaagagaaguuagcugcuuuaaugaaauacaguaauauacaaaguugaucauacuagguacaauaauuuuagugaucaauacacaaauagacaagaaaguggacugauuuuuugauuauuuuaaaaguuauuauaguuaaucacaauggcaaagugugucuuuaaguaacacaaagcguugcuccuucacccuaaagagggaaggauuauagguuugcacagaauucuccaauuuuugauuaauucaaaauuguuauagagcucuuuuguuuuccaaaacugauaacuagaaagugaguuuauuucuuaaguuagccguacauaaaacuaacaaugcuuaguuauuauuucgagguuaauuauauguaagcuuaguaauguuuaauuacauagaugcuuagagaguauauucugaaugaaugaauaaaggacaauacaauaacauuucugugacuuacagacaauuugaugccuuucuugcagagaugggugccagcgugccuucugagaauggagagguuauaauauaauauuggccacagaugaguagccuguucagggcucgaggcauggcauacacauagaauaggaaacaccgccugcuuuuuccuuccaucugugaaccaaaggguuuagauucuuuuuuuuuuuuuuuuuuuuuuuuuuuugagauggagccucgcucugcugcccaggcuggaaugcaguggugcaaugcaaucucggcuuauugcagccucugccucccggguucaagcgguucuccugccucagccucccgaguagcugcgauuauaguaaugcgccaccaugacuggcuaauuuccauauuuuuaguagaaaugagguuucaccauguuggcuaggcuugucuugaacuccugaccucaagugaugugccugccucgaccucccaaagugcugggauuacagaugugagccacugugcccggggguuuuggauucuaaagcugaaacuugaaagcauagggaauguugacacaaccuucaauccuguccaagacaugacuucuccucuuuuaccaaaaucuagguguuuuaauaaugugucagggauaagaagaugaaaaauguuagauggaaauccucauccaucuugcuaguaacacuuuguacuuuuggaugaaucacuauacuuuaauuuugggggauuauaucccaaagguuaauacaacauuucugagacuggcuacagaccaauuccuaacccauuuccuuguuuguccucaauuuguugaauagcuuugacuauugacuuaccgugcccaauucuuuacaucuauuaccauuaauccgaaaacaagccuguaaaacugagagacauauccauauaccagaagucaucuuacuagugaggcaguugauuugcaagucaaaccaagucauaucuaacuuuaauacugcagauuuuuugguugcuauuucaugcuaccuucagugucucacacacaaaaaauaccaugcuuguguuugugugaguguaugcgugaauguccaggaaugcauguauugaggugguggugaagaguuacaaagaaaaagaaagcauuagaacaauuuaauucaaauucauuuagcagauuuuggucauuuauuuuauuuuauuuuauuuauuuuuugucaaucacgaugucuauacaacugcgcugugcucccucaaaaaaucucuacucacaccauaauuuaacacugggaaaaauuuuacucauaugcaaauaaagaagaaaaauuugccgguguagauggcucaggcaauuauagccaucugcuacuugucaggccaacauguuucaucugcugcaugguucagaucaacuaaggagggcaucccaguguagggcagaggaaguugcugagaccagauguugggguggaggggauggaugggaagcagcuagauuguguucucugguccucauucuaguguuugggcugcaagugguggccagggucccugcagcauccuuggguucacgagccaucucuccuuuaggugagaccgaaucuccccaaccuccccagugaagagucucaugaaagguagaguaauaccaguggcuaaccugagcuugcuaacuacugucuuuucccuuccccaggcuuaagauacucagccucuuuuucucuuaggaaacaguuguuuuuguccccuaagcucugcugguggcuucagcaugcuacacacuguaacucuagcaugcuuuguuuucaucacuacaaacauuuuuaaucagaggcacguguuuucaucaguuaaaacccaucagcuuuaaccucuuugggauuucacaugaaauguagaacuugcagaaauugguauuuucuacauuacguccauaauuaaucugaauaucugaacuggcuuaaaaaugaaaacucuauuaguuuuauccuaauccacagcguucaauaagcuucacuuuaccugaauggcuuaaugugguacucuucccuuuguccuccugggcaagaagagagaaaaaucuuccuucucaacucucuuauacauagaauuuggaaaacuuccuuugugaaaaccugucuuuuacaaaaaacagaacaaaacaaaacaaaacaaaaaaaccuuugcuuuugggguuuccugguucuagcuagugcugaucugggacauguuuuuuuucuuuacuccuagggcuaaaauaugaaauguuaacauuccugcugcuguguuugccucaccacccagcaccacuccauggaaaccaacagaaugaaaugaaauuaaucaucgcuucuucugagaugucaaaggcuggauuuuggugcccuuuuccuggcccuuaagauuuuauaucuaaaguaagaaguuauuuacacacuucuuuuaaacauuuuuuuucaaaaauugacaaguagaaauuucauauauuugugguauacaacaugacguuuuggaaucuguauaccuugugaaauggcuaaaugaaacuauuuaacauacgcauuaccucccaugcugugaggguuaauacuaacugucaacuugauuggacugaaggaugcaaaguauugguccuggguguaucugugaggguguugccaaaggagauuaccauuugagucagugggcugggaaaggcagaccuacccuuaaucugggugggcaccaucuaaucagcugccagcacggcuagaauacaagcaggcagaaaaaugugaagagggagacuuggccuagccucccagccuacaucuuucucuugugcuggaugcuuccugcccuggaacauuggacuccaaguucuucaguuuuggaacucggacugucucuccuugcucuucagccugcagauggucuauugugggaccuugugaucgugugaguuauuacuuaauaauaaauuccauauuuuauauauauauauauuauauauauauuccauuaguucugucccucuagagaacccugacuaaaacacaugcugaucacuuacauacuucuuuuauuacugcgaacucucauauacuaauuuaccaugugauugaagucaguacggccucugaauaucuagauucuugcacaucguagagaucucuaaaaacuggaaagucucaaauccucuucucuguaggacucagcaccaucagauggugaagaucuacauucauagaaguauaaauucugacuugcgccggucaauuuugugaaaagaagcuuaaaauggugccaaagcaacaccaaaaccauccuuucacaaaacccauuucaaguaauaauucuccuucaugcagccacaaaaauaauauccucauggguauaaaucuuagaaggcugcuggaaaaagcucucuguacuuaacgauugaugguccucagggacaggaaugugccccaugcugacacauuuaucaccuguguuuagagccagaauagcaccagggaagggcuuuguaaagaggugagccugagugccagggugagugauggauuugacauaaaaggcugaaaugggaggucuaauuacgacagggaaugaacaacuaccuuaaugaaucugccgcagaaauuuaguguuguaggcaccagccacaugaagauagaaagugauagggugguugcucacaccuguggaaugcauuauuuagaaccugaucacuauucauucugaaaugauagcauaaagugaagauaaauucccaucucuggaaauucuccuauccuugaccuucacaaugagaaucaaaacaaaggcagcuuucaaaaugauaaaaaauguuuuccagauuuacuuucuuucuuaaagcauuauagagaaauauuuuaggguuagaauuugcacaggaauagaacaaucagcuugguuuuccguauggcugacucucuuuaccaugugauagaggguugugcuuugauuucuaaaagugaaggugaaaacuguuauguacaaugauuuuuuaaaaaacaagaaacauuuucacuucaguucaauuuguuuuucuuuuuccucuauuuuuaauuuuaagcuuaaauuuaauauuuuaucaccuuaaauacuaaaaccagauacaucaaaauauuauucaauuauguugcuauauuaaaaaucuaggauaccgugacuacuuaaauaugacuucccuuuucuaucaauugagaaaagaaaucccuuuauauucugcauauaacacugaacauagauucugauuugaacaugugcuacaauuuucauuaaugucaccugaauuuccauuauuauuaaggaagcuauuuaaaaaaaugugguuuguuauuuuugucauugcaaaaaauaacucaggcuuuaaaagguuugugugaaaguggguucaucaucagcagaguuucuauugaugacaucaugugugugcagagggaacgucuggucucuguugcugccucccccaacagccuugguuucuggugugccuuguccuguaaagaggugagggacugagcugggaaguccagccagccaacagcaagagagcuggccuguggaaggcuuccaugagcuguguggcagccaucagcaugauuggcuauuuugaugccaccaguguuugcugagagcaauucuguuccuuuacccgccuccccaacauggggugugugugugugugugugugagugugaguguguguguauucauuuacauuaucauuuugcuucuuggacacagggaaaaaggaaugaaaaaaaccaaguaaguugguguuuauuggucauacucuaguugagggcugccucaaaucucucugcuauuucacccugggaggacaaaucuguuccgaaaacucccaucaagacaguaucuguguaccauccgagugacauguagucuugccauucaggucaucucuuaagcagagagcacacucuuccugcuccugaaaacacaauucaggucagcauccaccucucuucuccccacucuucaguuuccuccaccugcuuuucacagaaaagauucaccuucuccuuuccaaauccucccacuauggcccguuaagcacaacccuggagcuauugugacuuucuaggggcugggagacaacugaaauuucugagagcgcugagcugauaggguccuauuagagugccuggugcacaaaaccugcaccuuuggaauauugggguaaucaaagggagacaggccugcuagguaggaaucccaccacccugaguugcacuucucuuguguauucaaaaauucaauauacaaaguggguuuuucucucuuuuuuuuuuuuuuuuuuuuuuuuugcugaauaagauauuuuaaucuguuguaauuaaaaagucaaaguagaaugaacaggagguuuaaaaacagguccccaugccaaccucaagcauguaguuguuguccaagaaauauuugcuaaauuuaauugaauuguggcuuaugagucacuucucuguaccauaaaagucuugguggaaagguuuugcagauaccuuaaauuaacuggcuauguuugacucuuuugaaaaggaagcagggggaaugauuggaacaauuuucaaaaaauagguaaaaauuauuagguaauauauaaucugaauagacccacaaauuauuagugugauuucuacucuauuauuuaauuuaauaguuuuacauuaucuuaaagaagaugcuaugguuugaaugugucccccaaauuucauguguuggacacuuaaucucuaaauucauauguugaugguauuuggagguggggccuuugggagguaauuagaauuagauaaggucaucgcggugggucccuaugauggggcugguggcuuuaaagaaagaggaagagaggcggggcgcgguggcucaugccuuuaaucccagcacuuugggaggaugaggcgggcagaucacgaagucaggaguuugagaccagcuuggccaacauagugaaaccccgccucuacuaaaaauacaaaaaaguagcugggcaugguggugggcgccuguaaucccagcuacuugggaggcugaggcaggagaaucacuugaagcugggaggcggagcuugcagugagccaagauugugccauugcacuccagcccgggcgacagugugagacugucuuuaaaaaaaaaaaagaaaagaaaaaaaaaaagguugggcgcgguggcucacgccuguaauccccgcacuuuggggggccaaggcgggccgaucacgaagucaagagauugagaccauccuggccaacauggugaaaccccaucucuaguaaaaauacaaaaauuagcugggcgugguggcacgugccuguaaucccagcuacuccggaggcugaaguaggagaaucaauugaacccgggagguggagguugcagugagccaacaucaugccauugcacuccagccugggcaacaagagugaaacuccaauucaaaaaaaaaaaaagaaaaaaagaaagaaagaaagaggaagagagaccugaguugaccuggucuugccuucucaccaugugaugcccuccaccaugccaugacacagcaagaaaguccucaccagaaguggccccuggaccuuggacuucccagccuccagaagcaugaaugaaauaaagucauuuucuuuauaaauuacccacucuuggguauucuguuauagcaacagaaaaucagaggauauaugcauauuuguuaaaaacaguugcuuugggauuaagaugauuauaaaugugucaggaaaaggagggccaaugggucacauggcaugaaauaaaaacaaucacucaaucgguggcaucuugcuggccacugauguuaccuaguccaagagcugggagguguauacaauuaugagcgaagcugaacaauuguuuuuguuuauugacuuuugccuuuuuuucuauaguggcuguucaaacuuuaguuucuugauuugauuuuuuccuuacaaaaauaaggcugaaauauuauuuaucaaucaaaagaaaugaucuaucaagccaugaccugaaggaaacuuagauguauuuuacaaagugaaagaagcuaaucugaaaaggguacauauuguaugauuccaauuauaugacauucuggaaaaggcaaagcuauagaggcaggaaaaagaucaguaguugccuggggaccgggcaaggagcagaggggagggagggaugaacagguggagacagaggacuuuuagggcaggggaaccacucucuaugauacuguaaugguggaucugugucauuacacauuuguccaaacccagagaauguacggcccaagagauuauuaggguacuauguguggcaaguauguaacaccaaaaacaugacguagaaagauguuaauaagaagagaaacuauguauaacguggggaggggugagggaguauauggaaacucucuguacuuuuugcuccauuuuucugugaaccuaaaaaugcucuaaauuacagucaauugaaaaggcuguaaaguuaaaccuucaaacuauuaauccacacgauaguguuuuauuugcaaggcuaagucacuuuguuuaauuaauaaugugacuuccuuuguauuaucauuaauuugauauuaauuaauuuugauaaaauaaccguaauaguuaagaaauaacaaaaagauuuuuuuuaacguguuuuaggguuugacuucuauaacuuagaguaagaaaaucuacuaaaacuuacaguguuuuaaaaaauaguaauuaggcccacaaaauuaauuuaugauuuauauuaauccuuuccuuauuguuugacuuuucuuuccuuucuacuuccuaaugcacuucccauauuaaccagaauuuugaagccaggucuuucuguguauagggagcccaggcugccacaagacaguuuggagaccucuacugguuaaaagccgaugagagcacuaggaucgacacagagagauggaggaaaaggaaagaggagagaaccuuaucaggaauugacaugguccccuuucugaagcaucaaauaaauacacaguugacccuugaacaauaugguuuuaaacugcaugagucuacuuauauguagauuuucuccugccucugccaacccugagacaguaagacuaaccccucuuccuccuccucagccuacucaaugugaagaagaugaggaugaagaccuuuaugauguuccacuuccauuuaaggaauaauaaauguauuuuaucuuuccuaugauuuuccuaauaauguuuucuuuucucuagcuuaauuuauuauaagaauacaguauauaauacauauacaaaauaugucuuuaucaacuguucauguuaucaguaaggcuucuggucaacaguaagcuauuggcaguaaguuucugaaaagccaaaaguuguaugcaaaauuuugacugcauagggggucagcaccccuaauucuccuguuguucaagggucaccuguacuaugccuaucucucagggucuuuucucuuucauaaaacaaacacagacaguaaauaaaccaacaagcacagaaagacccacccuggaaucaugguucuaccacuuacuagcuauaugacuuggcacaugucacuuuaaaacuucagagccucuuuccucacaugucaagugcagauuuaaguaggcacuuacuugcaagguuagaauuagugauaauguagugccaggcagguguuucacacuuggaaggcauucaacauacacuguccuccauaguaccugucuaguuacuguaagugagacugaaagacagucuguuaaauaaaucuggcacccgugauaaaagacaauggaauaaggcucacuucuguguauggcuuugcuuuaaccucugaguuuguauuuugaaugcuaauuccucccagucaauaaagauggaguaacaguuggaaaaugaauuuaccuuggagaaguaguauaaauugugaauuaaaaauuauuaaacacuucuuuuagaagauuaucuuccuuagauaaauacacuuuauuguuuuuuaacagcuacauuuaaaagcaggaaaauaauucuuacuuagaccacagagucugucuuaucaccagagcacagagcugugacauucaaaaucuagccaugcuugcugccaaaaaacauaacagucccauuaaauaucuguuauaaacauuuaaugcuuuuuauagcaggauuauucacacccuauagauuuuuaagaggugaauaauucuuucaugcaaacauuuguuuuucuacaacugcucuauucuuccuucaaagugcuacagaaaagucuguggggaugccagucuucccaaauguggccauguuagugccggaggaacauucaaagcauagacuuauugggccaaaucugcuucuucuguuaccauuucauuguguuuuucuguuuuguucuucagagcauucaaacaaggagugacuugauuucuuuuuauuccaauuuguuaaccuucaagcucuccaaaguuuaaauuccaggucguuagcaagauuacauaaagggucuuuguagcccagaccuuuuucuucgaaacauguuauguuccccuuccacggaccuuaagaugcagugguguugagugacagccagucuuuaugcuauaggaagcaccaugagauuucacaaaccagaaggagaagaccaggcucuaccuggguagccuuaguuggacuuguuaaucuagugugcugagcaguaaccacucuccucuuaccuccauguauuagucuguuuucacuuugcugauaaagacguaccugagacuggguaauuuacagagaaaaagagguuuaauggacucacaguuccacauggcuggggaggccucauaaucauggcagaaggugaaaggcacaucuuacauggcagcaggcaagagagaaugagagccaacugaaagggaaaccccuuauaaaaccaucagaucucaugagacuucuucacuaccaugagaacaguaugggggaaacccccccaugauucaauuaucucccaucgggucccucccacaacaagugggaauuaugggagcuacaauucaagaugagauuuggguggggacacagccaaacuguaacgcuccaugaacaucaugugugauaauagcuguggaagagcuguuuaaacugcaaaauaauauaaaaacauaauguaucaucauauucaugugaugcagguuaaaaauaauucagucaauugucacuauuugcaguagcuauguuucauacaguugcugcuaacacucaauuagugaauacuaaaacauuguuccuaaaguaaauacaggguuagguuccugcaagcaucuggucauaacauuuuaucaaccaaccaauacauuaccuugcuuuauguguguaucuuauuuaauauucaguuuugaaauaaauguuguugauuuauuaacauugagcucauggcugccagcacaaucagucaugccuaaagacagcucaucuaacagauguauuuucuccacaggacagaucgcagcgucuugugcuuaggagcaauagauagcauuucagcacuccacuuaggggccauuuuauacaguaaaaucaccaauaaaaacacaagaaugcaaaaaaaauggcacugaauagacuacaaaaaugauacuuguuuaugguauaagagcugaaacuagaaggcaagggcaucaccuuguuugacuucaaaugagaauguacacauugaugacaaauuguuugcugcacagcacaugucugcaaauaaccacaaaagcaccaagaauacuacuuuugagguucuaaauaaauuuuagagaguaggugaauuuguaaauaugaaauguauaauaauaaugaucaacuguauauaaauaagaaauucaaaaauuuuccaugccuucuggaauacuuuggaauguuauaauaauaagaauucuuucuuucuuuccuuccuuccuuccuuucuuucuuucuuucuuucuuucuuucuuucuuucuuucuuucuuucuuuuuuuuuuuuuuuuuuugagacagaguugcuuuuguugcccaggcuggagugcaauggcaugaucuugguggcucacugcaacuccaccuccuggguuuaagcaauucuccugccucagccucccaaguagcugagcuuacaggugccugccaccauaccuggcuaauuuuuguaguuuuuuaaaguagagaugggauuucaccauguuggccaggcuggucucgaacuccugaccucaggugauccaccugccuuggccucccaaagugcugggauuacaggugugagcuaccgagcccagccuagaauuuuggcuuucaaauguuuguuuauuucaaaacaauuggguaugcaaaaguauguugugugucaaagacaggugaguugaagauuugggacagaaauaaguguuuugacaaucuucuuuaaccaaauacuaaaaaugugauuaaaacagaacuucugaucucucaucacauuuuaacaauaaaugauuuuuuuugguggggguugcuuuuguuaauuaaaaauaauuuaauuuuggaaaccauggaaagaugaugauaccaauugguuuucaaucaaaaguuuuuuucaguuuuucauuguuugaguguucuuuuuaugagugacccaggauuggagucagccauucuuuauuuguauuagcuaaaagucaaagauuagauguaaugauacugccuaagacguacuggacacucacugugugccaggcugugugauaagcccuuuacauucaugauagcaucuuucaucuuccuaacaaagcuuaugauauuggcacuacuaucauucucauuucacgguuaagaaaacugaagcugagauuuguaagaaaccuguuaaagcuccucgagcaggugaggcaacuggaauugcagguguucugacacagagccuguauugagccugacccucaauguucaaaauauccucuuccagccuacacuuaugacaagauuugccuuugcagcuguuuuaucuagauauugagaguauguuugcagguuaugauguauuaauuauuuauuguccuuguuaaagacacauuugggugauaagcaaagauuauucugauauugacaguauauuauauugaaaauaucguugaaggcugggugugguggcuuaugacuguaaucccagaacuuuaggaggccgagguggguggaucaugaggucaggagaucgagaccauccuggcucaugugguaaaacccugucucuacuaaaaauacaaaaauuagccgggugugguggugugagccuguagucucagcuacucacaggagaauugcuugaacccgggagguggagguugcagugagcugagaucacgccauugcacuccaaccuggugacagagugagacuccgucucaaaaaaaaaaaaaaaaaaaggaaacguugugaaguaccagcuaugugaccuuggcuucauuuaaccuuucugggccucauuuuccucagcuguaaugugacaaaguuucaacaaauuauuucuuagggccuccuaugauucuauaaggcaauaauaauaauaaagcccaauaaaugucuaagaaugaaagucaaugcaauuaaaaaagaaugagaagccagccuugaacuagaacucccugagugaauucuuuuaaaauagauuuccuucagccuugagaagauucuggacauuaagacuacgcuauauguucuuuaggauaugaaaaacaggacauaauuucuucucuucaguuuaaauauuauuucucaccuaucacuucaaugagcuuucucaucagugcuuuccugcugcuucuguccuuauaguaaaacgcaaaggcaacugaccagaaauuucaauuaacuauuugccauuuguucauuuaucaauuuugcugcauucuacucuuaggagguagagauaaaucacaaggcgauaagcugccaucggggacuuuccuugagagaaguugcaggcaguuuaaucuaccccauuuucucuagcuccuuuuuaaagaaauguauuauauuaaucauucucuucaauaaugacucuaaaagaacuacaaaauucuaagcuguaaauaaauaauaauucccacauauuuccuaaucucuacuggcuagcgcaggaaaguaaagagggaauggguagaaccgguggcuuaaucgcugcaggucccucuccugucccucacgcucccccaggguggauggcacuagccccuaggagacacugacuaaauaucccaugaauaaauggcuccacagaagaagguggacuuggucuucuuuuacuuuuauugcuuuuccuuuucuuuuuucuuuuuuuuuugagauggagucucccucuguugcccaggcuggaguccaguggugugaucucugcucacugcaacuuccgucuccuagguucaagcgauucuccugccucagccucccaaguagcugagauuacaggcucccgccaucuugccuggcuaauuuuuguauuuuuaguagagacgggguuuugccguguugacuaggcuggucugaaacuccugaccugaggcgauccaccugccucagccuuccaaagugcugggauuacaagcaugagccaccgugcccggcuuuuuauugcuuuuucuaauugaaacuuuaauugaguccauuguagaaucacauguaguuguaagaaauuguacagagagauccccuguguauuuugcccaguuuccccauuggagacauuuugcaaaucaggaguacagugucaccaucaggauauuaacauugauaugauccaaugaucuuauuucagauuuuguacucuuguaugugugcaaaugugauucugcacaauuuuaucaucuguguaggucugugcauccaccaccauagucaggauaaugaauaauucccacugcagaagaaucucucuuuuuuauuuuuaaauuuuugagauggagucuagcucugucaccuagaugcaguacaguagcaugaucuuggcucacugcaacuucucugucucccgggcucaagcaauucuccugccucagccucccgaguagcugggacuacaggcaugggccaccaugccuggcuaauuuuuauauuuuuaguagagacagauuucaccauguuggccaggcuggucucgaacuccugaccucaagugaucuuccugccucagccucccaaagugcugagauugcaggagucagccaccaugcccggccuccuuguuuuccuuuucuaaccacaccucucuuccuuccccuucccuccuguccuagucacuaacccuuggcacucacuaaucuguccucaauuguaaaauuuugucauuucaaaaauguugcauaaaugggaucauuggguauguaaccuuuugggacuggcuuuuuuuccauuggcacgauucucuagagauucauccaagcuguuuuguguaucaguaauuuguucuucuucaucauugcguucauaugcaacaccugaaugacuuuauaauggagauauauucugacauuuaucaauaggcuuuuuucuuuuuugccuuucccaguaacgaucaauguccuagucaagccaagacaucuaucugccugaggaggagaugggagauaaagacaggaaaaggccguguuacaggugguguucgguuucugauaugcaccucagugcuaugcauccauggaauagccuugaauguggcuagaauggaagucuuaauuuuuauuccacaguuccuaaacuacuucucucccaggguaccucauuguaguaggcagccccaccacugggccagcuauucaggccaauaccuugggaaacgcucuuugacuucucuuucucucacccaccacauccgguugaucaccaaauacuaugggcucugacuucaguguguuccuaguccaaagauuucuccaucaccaucacugcuguugcguuggugcacgugccucuaacucucacauggacuccacaacuguauuugaaauggucucuuaguguccauccugccccuauaucagcccaccccuucugcaguuaauacagcaucccacagcuggaaugaccuuucuaauauguaaauuggauuguguuacuuaugugcucaaaaccuucuacuguuucucaucucauuuagaauaaaaugcagacucuccaugauggucuccaucugugcaauuggcugcuggcuaacccucugacuucaucugucuccugccacucugucccuugauggcuguauuccagccauguugguuuucuuccuguccuugaacaagccaggcgugucccuaccucacagccuuuggacugccauucucucuuccuggaaggcuuuuccagcagauguccacacagccagcuuucucacuuuguuaaggccacugcuuaaauauugccuucucaaagacgacuuuccuggccauuguaacaugcuuuccugcuaagccucuuuuacuuuucuucauagcacuuauugcuaacauuuauauuacacaacucuuuucucauucugucuaugcucaugagaguacaugguucauaaagauaagagauuucuguuuuauccauuguucugugccuagcaccugguacaugugagcacugaacauacuuuugagugaauaaaaugauuuccccaaguuccuuugcucaggcuuuuuuuuuuuuuuuuuuugagauguagucucacucuguugcccaggcuggagugcaguggcgcgaucucggcuuacugcaagcuccaccuccuggguucacgccauucuccugccucagccucccgaguagcugggacuacaggugaccaccaccacgcccggcuaauuuuuuuuuguauuuuuuaguagcgacaggguuucgccauguuagccaggauggucacaaucuccugaccucgugaucugccugccucggcuuuccaaagugcugggauuacaggcgugagccaccgagccgggccuacucaggcuuuuuaguacaucgaggaggucacagaguucuccugcauccaccuccuaaguauggaagauggcauuggcggccccuaauucuuuacccuucccuguauccguggccuuugccaugugacuuugcuguuuucuucacugaagggaaagcaaguuucucuucuccucgacuauggauuuggccacaugacuuaguuuagauaaucagauguuaguggaugugacaagaccaaaggccuggaaagugcuugugugaguggcuuguucucucgugucucugccagagaaaaacaugcccaugcuaacucccuggucccaggaggaagacgagagguguacaagagaaacuucggcccuuagcugacccgcagauuagugauaaaaauagaauuguuguuuuaagcaauugaguuuuggagcuauuuguuagauggugcuuuuuuuuuuuguaggaaguaaaagcaaagcuuuuuuucuuuuuuucuuuuuucuuucuuaaugcccuagaagacuaugagaaaaggaggagauacagcaggagagacgagagcuaagcuuuggcccagagagcagaaguggguuucuaaaggaugacggaugggaccaaggguuuagggcucuugccuugcuucccagucuggggcucuggggagagguugcuguguagggggucgguggugguggggggcgguccuguacuaacauggggcagccaagccucauguagagagggaagaagaguaagccgacagggucucugguccucacgugcaucaucucauucucgugcagcaugaagccuuagaugaaagcccucacugcuugauagcugacgacaaccugccauggggagacggaggaugcgaaagagacuuagggcuuaggggucucucaagugggagauugagggcacagcaaguaagcaaagggcaggauggcaggugcucccugggaacacugccugagucaaagaaagggacucuaaguucaucaaccacagauuuaagcuccaaggccagaagagcacucagggacacaggacacugggcuggaggccagcagaugccuggccaugcaaacucaaggaccagcaugcauccaggucucucccugcccacgguaucauuagaaugcuaaagcuagacauguugcugccugucuccuuuuauauucuguacaccugguccccaccuuauagaaagaagcagaggacgggaaaggcucuucgagaaacugaacauuuuuauucaugagggacagagcacaaccaggaaggaauuuugaaaugauuaagucagaaucagcuuuaaaccagccuggauguuuagcuuauuugccuuugcuacccagaaggaauacgacaucaucagacacagauaaagacauugcauuuucuccacauaugugagcugcuuugugcauuacaaugugcaauucugugauaaccauggcaaccuccaauuuggucucccugcagcuucucacuuccuguuaugcauuuugcacucugcagaugguauuaucuggcuaaagugucaaucugaucacguuauucuauggauuaaaaaacauccuuccuugacuuccuuuaaccccuaagauaacauuaaaaccuuaacauggcuuauaaauagauccguaauauggcagaugcugucagugcccggcauucaccucaguccugcuccaggaaccacugacugcgauucgcugucaucugcacuuuccucuggccucagcaguguguuggguguaaacacgggacaagcuggaagugcuggggaguuaguaccgcaggaagcagcccucaucacugcaggaugggaggagguggcgagaugcccuggcuuccuccugccuugguugggacacucggaggcaugucucgcacugucuuccagaguguccuggugggauuauguuccaggugcccacaguggugaguggcuugauaaugcuccaucccuuucccuguuucaugucucuacuuuccugcuuguuuuaugggauugucucccagguaaacuucuuauauucaaaucgaauucugcaggguuucuccugggaacacccaaauaagauaggugaucauacaacugcguaguccuauuuuuagaguaaaagugggcacugcuaauaauguacucuuguccuggcaggaguagcuugggucugucccaggcaaagcaggacauguggcccugcugguaaagccgccuuugaucugaacccugcuuaugcugcagcauuuuuaucacuugcaucuucacauccgacuuuccaccauucugaaugcaacuugugguuccucaaauuucucucauagcacacuguguuuccaaagaugucacaaccguaacucccauggcauguuucuuugcaaugugaccuggcuacgaugccaccaagagguagggucugcuuccucucucuuggaacaugggcuggaacccagauuuuggucaauagcauauggcaagaaugguggcucuuagagaccuucagcuucuacauuugcuguuuggaaagcuccuucuuggagcccagccaccaugccaugagguagcccaagcagccaugauuuggaacccuugggggagaacucagccccuggcucguggccccaaagagcuccugggcagccagcacuugcugccagccacaugaaugaggcuauuucgggcuauccagucauucuuacacccugccuggagucaugaagcagaacaaccacccugccaauccacagaauugccagaaauaauaaacuacuguuuugagccacacaguuuuggguggacugcugugcagaauggagaacugaccucccccgcccuuauggccucuacuucagcccauugcuuuacccagaucauucuaacucuucauuagggucccagcuucuguguuacuuccucuaguaugccuucccucacuccuggacuggcucaagugcccucccuacuugcucccaaagaauucuauacuucuuuucauuuaucccacccucuugucuuuuuacuucuaauugacuuuccauuaccuucuuuuccagaaacugaagcucuaaagaugugacccagugcauauugauacauuguaugauccccuaucuugcuuuggguucucccaagagaaaccucugagaacuggauuugaauauauaaaguuuccaaaggcagaaacugugccugucuuggacccuaaugauguuccagggacuuauacaaugccuggcaucugacauaugaugaguauacauuugcugauuaugcaaaguaaaaaacuaauauguauuacacacauacuaugcagcagagacugugcuaaccgcuaaacauguauuauuuugcugaaucccgugacacagagaccauuacuauuccuauuuuacacaugacaaaacagauacacacaauguuaaguaacccgacaaagucauacaaucggcaaaugguagaguaagagauuguauuaggcuguucuugcacugcuauaaagaaacaucugagacuggguaauuuauaaggaaagagguuuaauuggcucacaguucugcaggcuuuauaggaggcacagcacuggcaucugcuucuggggaggccucaggaagcuuaugauuauggcagaaggugaagguggagcaggcaggguacauggcaaaagcaggauccagaggaagaguguuggggggaggugcuacauacuuaaacauccagguuuugugugaacucagagugagagcucacuuaucaccaaggagauggcccaagccauucaugaggcuuccaccaccaugauccaaacaccucccaccaggccccaccuccaacacuggggauuacauuucaacaugagauuuugguggggacaaauauccaaacuauaucagagaucaaacccaagggugcgagagcaaagucugcccuuaagucaguccuuaugccucagucaggacaggccaaggcucugccacaguaacaaacagcccuauagucucgguggcuuaacaaagcaaggaguuuuuuuuaucucaugcuauauguucaucacaagucaagaguuuucuguucacuguagucacagagggacccaggcuuacggaaaaaaucacugucuuaggcuugucagucaccaugccaaagggauaaaaggacucuagagggucuugcaugagcacuuaaauguucuagccuggaaaucacacaaaucuuuuccauucauaacucuggccagaaauauucugugagcagcaugguuaucacaguauaugauuucaccaacaaaugaagaucuaaguaugucaguuccuucugugugaagaggcuuugccaaagcuccagaaaguuuuagaaagccuuagaauaagacuuuuuaaucaauaaaaagucguguaggaucaugauauucacaauuuagauuauaauagaaauaauauaggggcuacuagccacuucuauuggaauugcuuuggauaaugguaguuugggaaauaugaggaucugagaccaauaugacuuacaaacucuaguuaguucaaauggauagaaguucgcuuuauuuuuaccaccccagacaucgccacugacaacagcaaugaucagccaagcaacaacgacacugcauuaguauucagcuucuuucuaagcacagcuucucaaguuuacacagagaagcuaccgucuuuuuauuucagaauagaucuacuucauuacgguuuuauauuacucugauuuacagcgauggcagaaauaguuaauuugaaaaacgauuaauuaaagagggcucagaaauaaaauuaaaaugcauauugccaccuuggaaacaggucguguauguaauuacacaacucacagugauguggugaucgcuguacauugauauucuucuaaauucauaucuaucaucaugcaucauaacaguguuuuauaucaaggaacccuaaauguuaucccccuaguugccaauggaacaggagacccugcucuacuauaauauugcauuuucaccuuuuuaauuaagaaaauuacucccaccacaaaucuuaaaguuucaaaguuuauuuaggcuauaucuaaucugguuuuacucaauccagacaacuccuuaauauacagggcacauuuccguuuagccuuuguugaauauucucaauaauagagaguucauuaccucaaaguagagaccacucacuuuugaaaagcucuaauuguuaggaaguucuuucuuauauggagcugagauuuuccucuucauaucuucugcuuuugguccaugucagucuugcugaguaagccucaacuaagucuaauccacccugcauguggcaguuaccaaagacugaaaauugauucucucgucucucaaaucauauuuuuuucugaucagacauucccaggucuucugacauuuccuuuacgggucuuguguuuaucugguuuucuccucagaugacuaauacccucgcucuggacaugauucucauacuaguguggcucagaaucacauucauuuaagaauccaucaccauguaacauugcuuguaccagacuuuccaucaaaccaauuuccuaaguuuuuucaugaugcugggggucucccaucuucuauuuaggugauuguauauauuuuuuuuaucuaagugcugcaauuaaguuuauuucuauuacauuucaucuuauuauuuuuaucccaucuuucuagccugucaagaugguuuugaaaugcuuuuuauaauccaucauauuaaaccaucccucucagcuucgugacauuugcaaacuuaauaaacaugcuacuugugucuuucuccaaggcauuaauagagauguugaaaaggacaugagcaaacagaacaccccacuuucggcuucaaguuauauuucucuuccuugaagauuucuugagagaccauuaaauuuguugcugaaagauaaagucuaugacaucacucggcugguaaaagauggauggauaugagggaugaaagauggacauaacuaugucuagugagauuucuccuuugugaaccuuugcugauugcuagugauucugaauuccuucuagaagcauucagaauuauguaagaauccguucuaaaaguuugcuguugguuggcagugaucacacuacuauuucuugaauauauauccuccauccccuuuauaaagaucacacuuguccuugauuagguagccuuucuuucauccuuuuucugugucccuuuuugaggagugcucaucaaagagcucagugugaagucauuuuagguauuuagagccaucuucuucucuuucuuuuauagaaucaguuucugaguagcagaaacugauccuauaaaaguaaagcaacaacuuuggagcaugaaacuccaggggguuucaaaaccuggccggaguacauaucaguugcaaguucaauacuguaugucuguacagauggauuuuuacacaacuggggaaugcaaauggguugucucucacugaaguauauguuguuuucaaagagacauuuaagcauauuccugccccugugaaaugaucaaauaucaaaggaguauuggcuugaagggguggccagugauuagcuucucaagcacuuacaugucuucuuggggucuucacugagacuccuucaauuuuauuaacagaauuuuagcuucagaguagcaagaaccucguccuugcuuccucaccauucuggaaggugcaggugucaucaggaagcaaagcauaggucuuaggucacaaaucacgcuuuucaaaucucagcgucaccgcugacucgcugaguagcuugaagccugugguuuucaacuggggugguaauuuuucccuccuggggaacauuuagcaauguuagaagacauuuuugguugucacaacuuggggugcuacuuauaucuaguggguaaaggccagggagaaugcuaaacauucugcaaugaacaagacagccccauaauaaagaauuuucugauccaaaaugucaauaguucugcuguugggaaaccccacuuuaagaagaaaacuuaauaguuuugagccuuagcuccuuauucuauacaacgaggguaacaauggucugugguguugugagaaacgcagacaguauuguacuuacagcauauagcauaauaaccggcauguagcuagcaucaaaaaugguaauuauuuauguauuaggcauuguguuguguaugucuuaagacguuauuagcuuaauauuaaaagaguaguucauuuacuccacaaguauuuuuugagcccuuucuguauacuaggcacugaucagccugcuguaaauagauuaguuucaaaaaaagucucugccuucugcccucagggaguuaacaaccugcaaguaggcauuuguguuccccauuuugcaaaggagagaaccuaggcucugagagguucaacuaagaaagcaacauggucaagauuucaaugcuaacagagguagaacuggauuccagucuaacaagcucugccugauuccgaaguccacauucuuucuacuucaugaucgucagaugccuacuuuuaggcugugagauaugugaggauugcagcucucaccucugugcgaaucuuacugauucuguuaggaugaucauccauacccuuucacccugcaguauacgucuacaaugauaucuuucuguuuccuuccccuuuuacucuuuauuaauucaacaaauauuuauugagcacuugcuccuuguuaguauaugguggaacuaugagaugcuuucuuggucugcagggaggucacaggcuuguagggaugagagauaaucuccacuagaagucagugcaccaaggacccauugcuggagcccuaacuacucucaccugcauaacaccauuuccaucuuggaauuguggaccuccuuacagguauuuauguguacuuucuguaacucacugccacaugcacaguuaccuaguuuguguaugcagcaacauuuuucuuggguguacaaaaaauacaggguguaaccuucauguaucugaggcucaugguacacuuuuagcuuugcacagauugaugucaagguacauucuuaguuguagaaaauguggccuuuaugauguuauuuguucacgaccuugaagguccaugccauacaguauauuggaauugugcugaaaugugaacuaguuacaugaccuggaaaacagaggaaccagagaauauuacucauagugacagaaccuagaaaucauccaacauucccaucaaaauuugacuuugcagguuccacaaaguaauaaaaagucuauuauuuucggguauguuuauaguugauguuacuuuacgaauaucauaguguaguaucuuuaggaacaucaccauaucauaguguagcguuuguuuugauggaaucauaugguucugaaggagcacuuaacauuuuaaaguauucucaacugaaccgugggaguaccucugguagaaagcggguacucaccaaagucucagauccaugacucaugaaugccaaggcccuacuccacuaaacagccacuuuuuguugcuaacugauggcaucgcucaacuuucaaauacaucccucuucuggagcuucaccaugaaugacaagauuguuugacccacuuaagagucuggacugucuucagagagaccucgcuuccaaacucugcuuugccaguauuaguugaguaacuuuugucaaauugaccuucuucugcuucaguuuucucaucugcaaaaugagguucauaaucagggaucucauuucauuggauuguugugacguuuguuucuuauauuuacacguguaacaugugaugucacaaagucucuucuuguucacagaacauaaaaguggugauaagaucuguaaaaauacaucaacuauagaaaguguuggagaaaauucagauaaggacaucagggugagguaauccaaagcuagauuugagacugugccugagugcuguuuucaggaugcaaaggauuaagcagaagcuauuuaauuaucuuucauaucguacaauaucuaaggcucagugaucaauacauguuagcccucuuuuguuuuccaguuccacccuuugauuuaucacuugccacuccccacugucuuguucaccagguguguggucuugggcuucaugcacacaccugcuuucccccucucuucuggaugccucccucuccagccggacugguguguuccugguucuaaacccaggaauccuuuuuguucuugaccacuuccuggcacaagauauaggcuuuaucccuuaccuggacagccucagcauuuaucaccugcccaaucuuuccucucugucuuucucuuugcauucuagauuaacugccacagggauuacagcacaguaaagagcucccuuggugucugauugccugaguucaaauuuugguucugccacugauuagccagguggcccgguuauuuaaucucuucaugguucaguuuucucaucuaaaaaguggagaucauaaucuuaacuaccucauacaauugugacgaagauugaaugggcuaauaucugucaagugcuuaaacuggagccuggccuacaguaaaucuuacauaagugcacauuauuauuauuauuauuauuauuaagacagagucucccucugucgcccaggcuggggugcaguggcgugaucucggcucacuguaagcuccgccucccggguucacgccauucuccugccucagccucccaaguagcugggacuacagacgcccaccaccacgcccgucuaauuuuuuuaaauuuuuuuguagagacgggguuucaccguguuagccaggauggucuugaucuccugaccucgugaucugccugccucagccucccaaagugcugggauuacagacaugagccgccacgcccagucuauuauuuuuauuauagguucagucuccuacucacuccucauuuugugaccccugccgcauguuuuuaagugagcauuuuuaccauuaaugcuauucugaucacuucuacacacuggccgccgagugaccucccucccaccuguacaucaccaccaucuuacuguuuucauugcaguucacaguacacagccucauaugaacaaaauucauuggcuucacauuaaauauuuuaaaauacuucaccaaucauaucgauauuuuaaaaauuuaggguguaaucuucacauaucuguggcucaugguacauuuuuuagcuuugcacagugcuaaucuccucuggugaagagagggacaaggagacucuggaauucacagucgcacauggggaaggguguucugucacacugucaaauuccuuauuggccuucuuaucugcaaauaauaucaaggugcuuucuuacgagugagaggaagauagaaucauguugauaugcuuugacaaaggaaacguuaaauuacauauugcuaguagguagaggucuguaauagaccaaauucuacauagagaagccuggagcagauuugccuucgcuuggguuguaguuuaugccacgcaccaaacaacguuuguuccauuaccaucgcugacuuagaagcccccauuaccaaucacaauguguuuuuuguuuguuugguuguuuuuuuuuuuuuuuuuugagacagagucucgcucugccacccaggcuggagugugguggcacgaucuuggcucacugcaaccuccaccuccgggguucaagcaauucuccugccucagccucccgaguagcugggauuacaggcaccugccaccaugcauggcuaauuuuuguauuuuuaguagagacgggguuuugccauguuggccaggcuggucucgaacuccugaccucaagugauccaccagccuuagccucccaaagugcugggauuacaggcgugacccaccaugcccagccuaaucacaauguauuucaaaggcgaauuagcuuuagaaugaguuacaugagcaauuucccccaaagauaauuuguugacgcuuugcuugugcaacaccgagaacaaccacguaacuuuccuguacagagaagauauucgugacuggccccaguaagagaaauuuaccugauaguuuuaaaauccaaacucacauuacccaaauguauuuguagcacgcauuuauaccuaacgaaccacauucuuaccuauaacuuuucccagaaagagcgacuugggagaauugaagagggugucggaugaacuuggcagaugguaacucacagaaggauaaugaucgagcugcaggaggaaaacaagagacacuuuuagaagcacgucucuacccuguguggaaccaaaucuucccuguggggaugacaucacucuuugaacccugguuuucugauaucuuauuucaucagcacugacucuaaaacaccaccccgagaaaauggaaacccaugucuuccuuugcugggguucuuugaaaaaaucugaggaugguaagugaagauccuuuaugaacggcucuccaggugauguacauuuucuguggaugauuuaccuacaggauuaagauccauguucuuuuuaauggaguaacaucugcuugauccaaucuccagugucagccucugauagggaauaugccacaucuacagcaaugaaguuuugcggaaacauuuuauuuugugacaugaucacacacacacacauacacacacacacacucaaaugcugagggucaagugggguaaacaguuguaguuuucucgguuaucccaaugagaaugauuucuccugccacaggcaggggugguugggcgaguuggcagcagagggagagaaaugaagcuguugggaacggugcacagacaguaaccacggaagcgacgcacguuucugauccuguugcccguggacaaagugccaaugguggugucagaaucacuggccuugcccuuugugucccuguguggcuuuuccugccuuaucuucucagcugucuuuuuaccaccuauacagucuagauguguuucuccaacugugagcucuuagagcuuucugggccuuuuuugggccccccaccccgguggaaaacauucuuuuguaagcauucauuuuucugaagugaguuuaauacgugcuaaggucagcaugacgagaggugcggguuauaagaaagcacagcauugcuuuccgacaugggcauucccaugggggccacgucaauuguguagaggaaggagacagaacaagcagcaacuuguugaaggcagcagcacagacucagaagcagauacgauccagaguccuugcucaaacugggccugauuaggcaaaaaacuguccuucagaugagcaaagaugcuggaagcuagcugugcucuugggaggaaggagagaguggcagugaagaaagagggcaggcaagugaucaaauggcaucaccacaucauacuacgaugaauagucauucauuauuaaugacugucugcagcagaaucuugaaacugcuuccuagaaacuuagagaucauugcacagucacgguuaagagucaaaggguccucacaucucaagaacauuuuagauuuuugacccacagaacugguacaguagguuuuugugcaugaguaguauugccacaaaaauccaaaagcaccccacccccaaaaacuauuaaaguaaacauuugcaugcuuggcuaucauuuugaaaaguuuucuauaacgucaaaugcaucauuaacaaaacaaaccaggugugguggcucaugccuguaaucccagcauuuugggaggcugaagcuuguggaucucucgaguccaggaguacaagaccagccugggcaauauagugagaccauuaucucuauaaaaauuuuaaaaaguagcugggugugguggugugcaccgguagucacagcuacucgagaggcugaggugggaggauagcuugaggccaggaggucaagccugcagugagcuguggucaugccacugugcuccagccuaggugacagagugagacccugucuggaagcaaacaaacaaacaaaaacacuuauuccguucagauaaucuuaaauauuuaaaaucucauauauauguuucuuuggagcaaaagcucuucaguuucugcucuuaaauauuagcuagcugcuuugcugccaucuaaugacacccauggguaacugccaccgcacuucuguuuacuuacucucuuuuguuaaaugguuaaaugcaaaaugccauuguuaaccaauagccuaccuggcaaugccuuaggaggugauaaucuccaccucauacuucuuacaauuuaaaaacuaaauuugugaucagggcaguggcuuacgccuguaaucccaacacuuugggaggccgagguggguggaucaugagaucaagagaucgagaccauccuggccaacaugaugaaacccugucucuacuaaaaauacaaaaaguagcugggugugguggcacuccccuauagucccagcuacucaggagauuguagcaugggaauggcuugaaccugggagguggagguuccagugagccgagaucgcgccacugcacuccagccuggugacagcaagauuccaucucagaacaaaaaaaacaaaacaaaaaacuaaauuuguaacaaaguucuauuuucuuaaagaauuuuaaaaauggauacaaauaauauauguucauuauagaaaaacacagauuugccggaaaaaaaguugccugcuaauaauaaauguuaauuucuaauguauuuucuuucaacuuuuuaaauaaaaaagggauggaacccaaguaacacauuguuuuguauauuuuuuaacuugaugauauauuaugaaugucgcucugugucgauaaaaauacaacaaaauucuauuuucuuagcuuuaaaaauggauacaaguaauauacguucguuauagaaaaaaugauauagauuugcagaaaaaaacugccagcugauagucaauguuaacuuuuaauguauauucuuucaacuuuuuaaguaaaaagggauggaacccaacuaacacauauuauguuuuguauauuuuuuaacuugacgauauauuaugaaugucuucugucucaauaaauauacaacaaaaaucauuugucauggaugacuaguauuucguucuauggauacauaguacacaguuuuaaagauuaaauuuccauguuuagguuuuuacauuucuguguccucaggcccaauacagcccaauacaauacauggugggaucuugauaauugacauuaacaguuguuaaugcaacuuuuaaagucgcgagcaccgaagggaaauccguccucagguuuggcaugacccacacaguggagguaccuuccuuuuccugaauuguuucugcagauccagacuagacggccuuggcuuuuuggcagccauuuuauauuauuuuugcugagcuacaguaaaauaaaauuccuaguugaucucuauaaguguauucccuuccuaugucugcgugguugauggcuuuaaccaaaaaugcuaaauuuuacauuuauuuauauaaacuuuucuuucuuucuuuuuuuuuuuuuugggacugagucucgcucugucgcccaggcuggagugcagaggcaccaucucgguucacugcaagcuccgccucccggguucacgccauucuccugccucagccucccuaguagcugggacuccaggcgcccgccaccacgcccggcuaauuuuuguauuuuuaguagagacgggguuucacuauguuggccaggauggucucgaacucuugaccuuguguuccgcccaccucggccucccaaagugcugggauuacaggcgugagccaccgcacccggccacuuuuauauauuuuguuuugaaacacaguaauagccucuacucagagguuuuugauuguugauugugucaucuugcuucucggugauccugcucgguuuugacuuuucuaaaaaacauaaugaacacuccuagccuuaacucauugaugaagucauuaauuucaaaacagugaacaggaaccuaaaugggucaugcuguacaguucuaauccaaauuaccugcucaguuaggaaaauaugagaagugacgaggauauccagaaagccuucaacauucacaaaggugaagcugcagugccugaggaaauucucaaaggagggaaggaggaaagcguucuccgaucagucucugaucuuaccacgagcaaggcguccuuacgucuucucucucgcauacuccugccugccuugugucuaagaaggcgggcuguggccggaagggaugagugggauuguggggaagguggguuaaagcaagaggaccccaaaggaaaagcagcucugcagcugacggcggaugcuuugccgaguguuaccaccagguggugcugucccccugccgaacauaauucagaacagcagcaucggaucagggcucuccaggaccugaccaugugacacgagaccauucugcaauuuugucugaauauggagauauggugggcggaaucaugccucccaaagauaacauccuaauucucaggaccugagagcgcgucaccuuccuuggcaagaggggcuuuacagaugugauuaagauaauaggggaauucuccuggauucccugggugggucucagguccccaccagggucuuuauaggagggaggcaagagggucgcaguggagagaagaugugacaacggaagcagaaguuagagugacgugaggaagggcccaaggaacgcaggagacucuuagaagcugagaaaggcaaggaaacagauucuccucucagagccugcggaaggcaccagccuuucugauugacuucagccguuugcgcugacuuugcacuucuggccucuggaacugugagauaguaaaugcauguuguuuuaaguccuuaaguuuguggcaauuuguuacagcaacacugggaaacuaauacaagaaauuaaaaaauaacagaccuuguacaacccaaaaccaaaacaucucuuucucccggcaauuucuucaauaacaacguuaguguucuccauucuuccugccucccagaugaaaugcauuaagaggcccaauaacugaauuagcccugcuuuucugagagcacccaguugauuagagacaccugcuuccuugaacccuccccaccauaagccugauuccuaaaauaagcccuuccugacucuuagagccaccccgucauucucuaagguauaugggucccuuugcgucaauuaucaaucaacucguugcuuccuggcucccaaugcacccuucaauauaagcucuaugauaaacaauggaauuccuuaaagauuuugcuuuuaaggugagcacaaugucaagcuuucucaguagcgugcucuggagggacacugcaagaggaaggggcuuacugcaauuuccagcacaggcucgaggagggggauagcagaggcucugcccagagugcgaggacaugaggugaagccugucugagucgcaggccuuuuaagagaacccucugugacccuagcgucucagccauggcaaccugcccacagaccucuggacgugugucugaaccgcccugguagccccucacucucacccccaccgccauugcuauugccugcucccccaccugcacuccagagggcagccagccugucgcucccccagcaauuccggaccagcuccagcuuggcuaagcaggggucucugcucucugccaggcagacacaccuucuccagcaagguccugaagggcuucagaacacgccaccuccagauaugcuggcuugagauggggacaauuuugagcuaaaggcacuugaaaaacaacagaugcguugggcgugguggcucacgccuauaaucccagcacuuuggggggcaaagugggcggaucaccuguggucaggaguucgagaccagccuggccaacauggugaaaccccaucucuacuaaaagacaaaaauuagccgggcaugguggugcacgccuguggucccagcuacuugagaggcugaagcaggagacucgcuugaacccgggaggcagagguugcagugagccgagauggugccacugcacuccagccugggugagagugagacuccaucucaaagaaaaaaagaaaaacaacagaugcacaaaggacacucugaccuccccuuuucuuccugaaagcaggagaugaaacuuucauauggaagauggcuucucucuaccaggaagaaaagaacauucuucucuccagaggcggggaguugaggccgagggaaaucgguacaaacaaaaaguguuuugacaguuaaaaagcucuuguuaaaauaacccuugucuuuaguaucuccauauaguuaguuacuuuuucaaaauuacuacuuuuuguucacccuguugcauaagcacuuaggccuggcugcuuuuggaucuugguguccugugaaggcccucacaugccuguaaacauuggcuugcguuuccucuguuagucucuccuacgucaacuuaacucucaggcccagcuggagacugucagaggagacaggggcagcuuugccuccauuacggucagacacccaccgagguugucccuggaugggcucccucagcccuagggggccacuaggaaacugcacggauuuccuuacaucuuggaguugcuguuugccauaguuaaugcuucuauuuaucaccccauuuuaaccgacugugguuuccagcucccguuugacucaaacugcuaagcccucacugcaacaagggauaaacccaacuuuguccaacugcagauauaguucuggucuuggcuggugggauucaauaguaggaaaaaggaggaagcacauauugagcaacugcuguguacaaggcuuugugcugaucuuuuaauauguauugucuuauugaauagauauuagauagguaugaucucguaucuuugauauuauaaaguguccagucacagaguaaguaccaaggcuggcacucugacuccagagacaaaacggugagcugcaggccacagucucuugaacuagcccagucaccucaauuaggagagggagaggaucagcuacauuuuaaauauuuacauuuaaaagagaaaauacuuuaaaucagauauagcgagaaaagcuuaacaugaaaagccuaaggaaaugacauauuauaugauuucacucguauugccagguggccaccucuuuucaaaugaacccuggugcauuugccacgguuaaguguaauaauuucaagguaauuucuuugggguccaagugagcucuuuuguagaaauguauuuugcuguacauuuagcugguggucauuucacuggcaguuaagaggcgauaagagauuguguaauagaggcucauuaaaauuaaagacugugacuccauguaccccaggacaaccuugagugaacacuaacuuguucaacauuugccaugaagccauuagaagcauacugauuuaggcaggaccuugugucuuacacguggagcuuaaagcuuuaacgucuauucagguauuauuuugcaauauccauucauuuccauuuuuaagccacaguuugcguuggcagaguuugaagggauuucaucagccguuuacgcuuuggggaugcaguggagaagcuaaagaagaaauaccuaaauggcguggguucuccuggaccgguggaggggccgggccccaucuccugagaugaaggacacaauuucaaggcagaucccgcuuuuuccauggccuagacaaaggccuaggauuucuugcuguuuuuccuaaucguuaauuuuagggaauacuuggaauuagcucagcgauauugaauuuagaauauaucaucuuuuuucuucaaaauaucauuuuauucccaauaaagugauuauggagagauuggcuuuagguguaugacuaaggaguuucuuuuuuuuuuuuuugaggcagggucuuauucugucauccaggcuagagugcaguggcgcagucacagcucacugcagacuccacuucucaggcucaagugauccuuccaccuuagccuaccgaguagcugggaccacaggugcauaccaccaugccuggcuuuuuuuuuuuuuuuuuuuuuuuuuuuuuuaagacggaguuuugcuuuuguugcccaagcugaagugcaguggugugaucuuggcucacugcaaccucugccucccaaguucugguucaagcaguucugcugcagucucccaaguagcugggauuacaggcacaugccaccaugcccagcuaauuuuuguauuuuuaguagagaugggguuucaccauguuggccaggcuggucuugaacuccugaccucgugaucugccugccucagccucccaaagugcugggauuacaggugugagccaccgugccuggcugccuggcuaauuuuuaaaauuauuuuuaggagagauggggucucacuauguuguccaggcuugucucaaauuccugggcucaagugauccucccaccucaaccucccaacaugcugggauuguaggccaccacgcccagccuagagcauaucaucugaugaauguuuuauuuacuccaaguugaagcccaaggcugaagauaagaagaggcugaugcagauagacuucagguaggagaaacaauuaucagcucaacucgcaccccuuaucugugucuacccguccuucuaaacuagaaauucccacagacuucaaagaagagaggguuugaagaguggagaccaucucuuucuccccaucggaaucuccauucuaugaaggguauacacaagccuagggccauuugcaauugaaaauacgaacaagcaggccuugaccccaguaucaaggauacguucaucuaaauguuuucugccccuuccuaacccuagaaucacuuuguuccugauaauggagaggacauggagcaaauguagaugugugggagauaaagaaguaggauuaggugugacucuccugcuaguccaggguugcagcucuguuccugauccucccuuggugagaccguaacccuguggguucaaggacgcugccucaguuaccacuccugccccaggagcguggcauaacacacgcuuguuaaacacugaucagugggcucagcaggugcaguggaaauccaccugguugucagagcuccguggcuaacaccucaccucuggacuuucggcuauuucuuucucuguaguguuaucuaauaaaccuuccaguuaauuuacgauccacaugaaaagggccugugauaugcaaggugcucauuuaacauguguuaaaugggucagcacuggcugagccauguucguguauguaucuguauguaaaucugucuguguguguguguguguguguguguuuaagguguggauuccuagcuuuuacuuccauuagaacuucuguuuguagagggaggaaucucugugaaugacucaguggacugaagcccucauagcauuuuauugacaucgaguuugagugagugagcuuggcuccauccucccagaccacaucgauggggagacuggcugaucgugaaucugggacuccgaauuuucaugcaagagacacuugccccugcucugcucugagagucuugauuucagugcaacuuguuuuugggaccacauugcugagagccacaagcccaucagggugagggucagcaggccagcccccucccaaccuacauugccaagcccugcggccaucccuccaaucccaagaacagccaugggugcagaugagaggacaccauuugggaggcugacccauuuagaggucacguugucuaccuuaauuuguuuuugguugagcuacucauaaauccugccgacuuauagagauacucaagaagaagaaagaggccaagaaacacucuccccuaacagaacucuggaauaaacgagcaacagccaugcuuuugucacuggguuagcgaugcaugccgguccuggaggugccugguguguuucacggcggaugccuuuacgaagggaaaguuaaccgaauccugcagguaacugcagauggauaagucagggagccuuugccucuuugggagagauuaaauggcccuggggagaucagagggguagggggcaucuucguagaauggagaggcgagaaugcagugcccucgccuagaccuugccccugugcugugaccugacucucacaccuggggaggcacugugcacucccaggugugcucagggcuuuagaccagcuguaucuuuugcccagaaugcucuucugcuguccuuucaccaaauacaauaaucaauuugugcuucuucugggaauuauucucuaaaccacucacuuuauuaccaguccccagcugggcucaaccacguuggaggacuuugacuuaauuaauuaauuaacuaauguauuaauuaauuguuggcaaggccagagguggccuagccuagggccaaagcagacagauuugucuccugagcccccuuuaccuaagccuacgccugggucugggggcucuccgguccaagagcaagaaagaaaaacuggcugcaaaacuagaagagauccaggugaauccacugugccuaagccuuucuaggacagaaaauccccugcgcaugggagcuggggcucucuccaaacccgaaucaccugacugugagaaggcaaaaagagaaaaguggcugguuucaguauguguuuccucuucucgguaaggcacuguccucuauggaaggucauucagggaccccuugcaaaccagcuucuagacuuccaguguaagagaggagagguggccuggggggaugagaauggggccaggagaugggcccuggcucugccacguguuaaauggauguuuaucaaguuaggaagccuucuuggacuucaguuuccucauuuguaaagugaggagguugaaccaguucugugagguuucuuugaagauguucugcuaccauggcccuaaggaauaguauuuucccaugucucugggggcuuugagcagaaucaucugugaagauacaacucuaggguaccacuugaaggugucuuuucagggcacuauucaacuucgaccgguuuuggugauggauggagggugggaggaagcguccaccugcccuggaaaggcaucauucucucacuuuccauuuugagauccagaccguauaacaagugccaucuuugccguauguacuaaaacaucucggcagacuuggcucccgacauucagccauaagauugucaauuucagguucauuuggggauuuucagguagggaggggccucagagauguaguuuaucaccaucuuuucacaaacuuagaaggggaagcagaaucccagggagagguagugaucgucucagauuccuggacuggaagugguagcaucagccuugaaccaauauucaacucacaaggaacgcaguuucccagaaaugcuuaaggcucgagagagaaaggauuuaagagacagaucuuucuuuguuguguaauuucuguuucagagaugucaggagguuucucuaauggcuugauaagcaauuuuaaaaugagagguauaauaaguacuuacugcuauugucauuaugccauuguuauuaugguaauguaaucaguaaaauauaucugccucuuaaggucuagaguaauugaaaucauaccauauugaugcaauuaaaagaauuagugaaacuauuaggugauuuauguuuuauaucaaaaauuucucaaaauaguaggaagaaaaaauuagcuuucacacagugauuuacuuuaucuagacuaauacuccaccuacuggaaaaacacugaauauuauuuaaagcauaagauguuuaaaaagaaaccaagcaaacggauuuucuaucaauaaguucguauaauuuuuguaaaugucaacggacaggaggagaaauucucauuucacagcugauauagcauuucuuuaauagcauugauuucaaagauauuuauagcacaauggcucaagcacuauauaauuauuucagagaaucuggucagaaaacauguagcacuuuuaguuuugugacuuugacuugcaaaugaaaauucagaagaugauuguaaaucauuaaaaacaauaucugaacuagucuucuaguaaauuugaaauuuacuagaaauuucaaauuucuuugagauguagugugagaauaguucaugguuuuauacacuuucauauuuagaaucacuuuaguaacaaucaacuuuaaccguuacacauagugaguacuuuagauaauaauuuacauaaaauaaucaugaauuaauuuuauauggcauuuuuucccugaagagcucgaggaaaaacacauuuugauaacuuagaacaugacuuucuaggaggaagaaaaacaaacaaaugcguggaaaagggaggaagaaaacaauaaaauuaggaagagucgcuuuugaaaauagauauuaacaaauaugaugcugcuuaaauuguauaauguuaugguuaaguuuuuuuuuuuuuuuuuuuugagauggagucuugcucuguugcccaggcugaagugcaguggcacgaucuugacucacugcaacuuccgccuccuggguucaagcgauucuccugccucagccuccugaguagcugggacuacaggugcccgccaccaagccuggcuaauuuuuuguauuuuuaguugagacgggguuucaccguguuagccaggauggucucgaucuccugaccucgugauuugcccaccucggccucccaaagugcugggauuauagguaugagccaacgugcauggccuaaguuuuuaauuaaauaaaugaaaggaauaaagaacuuugagaauuauuaugagaaacgauggagauaugacaaauaugauugaggcuuuucuuauuuucgucuuuauucccuucuguaaucuugaauuguugagcacguuuucgggguuugauuuguuuaaauuugguuccuggugaauuccuggcugaguugugugggggcgcuuuaauaaggccuucaguaaaaugaaacuacgaccaggauaacuguauuagccuggugcgguaagagccguugaugucacaucgucugcuugccacggaugggacuggucaguuuugaaguggguggcuacucugacuguuaaauucucaaagcagggccuuugcuguaacugguacagaaacaaggacuuuauuugaagaugauccccucacagaaauguaguucacccuuaaacaacaugggcuugaacugcacugcuuacaaguggauuuuuuuuucaaccaaaugcggaucaaaaauacaguauucuugggaugcaggaccugcguauaugcaaagucggcccuugcuagaugcagguuccucagagcugaccacaagauuugaguaugcaugagguuugauguacuuggggguccugaaaccgauaccccgaggauauugugggaugacuauauaugauuagucaaaucuugagaagccaguagguugucaugucagcuggggaugucugcugugugugccccugaaguuacaccugcccaguaguacacucaucccaugggccacccagagcacagaugaaugacugucacaggguaacuuggcugcuggggguggugcagacccccugugggaagagagaggccucggcguaagacucaaaucaucuugcugacaccuccuaacauuaugcaagggcuuccaugugguuuugugguccagccaccuugagcacugggacuggaguccagcugaugacgugcagauguucccagcugggcucaaggcgcuuuagauucuuguuuggaaaacaugacaugaaacaaugaaggaauaauauucuaagacaaucuacuaaaauuaaauguaaaauguuaccccuaauucuaaaauauguaauauggagaauaagugucaucaugguacaguagauuggcagaguggaggcguuuugaaggaggaauaauaaaccaaauuucucuaaggguguugaggucacuagccucauugaucuuuaggauguguuuuggaaaaaaaaugguagacgacaccagccaugcugguccuuaggauguguuuuggaaaagaaugguagaagacaauagaagguaaauggaagauacguugugaagggcuuugaaugcuaggaugcaaaguuuggauugaucuauacaaaacugggguuacaguuuuucaucuaucaaucaauaucuaucuaucuaucuaucaucugucuaucuaucuaucuaucuaucuaucuaucuaucuaucuauguaucuaucuaucucuguuauucuggcauaggaucacccccaaauucucauuguuguuguuauuuguaaccacaacuccuuuaaagggggucaaauccaaguuuuugcaucuguugagcaccugacuacucugggccagcaagcuuggacccuguuuugggaagagucagcuuguuauuguauauaauagugggggagaccuggagaugagugaggaagcagguggggagccagggagcaugaaucaggagaaaucaaaauccuggcacugccuggggugaaagcagaaagacuggcacugccuggcgugaagggcuaugagaagccucuauagaaggauggguaaaggaacuauugagggcaugaauaucuacucuaugacuugcagugauuuguuaaugugcuguguaccccucuccccgacccugaaauagucaauagaggcuacugcucagugaaugcuuugggcgguuguguguuugugaaccaaaggaagugcugagcuucauucuggguggauauucucuggaucagagagaucacccacagaagaaagcaccuggaagcagaaagaacccuuggaaaucccagggaggacuucagauuuccaucagagaggaaagguuggugaaaauuguggcucaaggugaccugaucaagacccuaaggggcugacgaauuaguucauguguagcuacguugggacucaagcacaugucggugugucuggagagaccccaggaucucucuccuugagaaacugauauucuucuugagagaaagaauguauuaagggaugaaaagaucuggaugaagaaacaguucaaagacauugggcaagaguagggugauucugggccuaaauguaggaagaaacugacauucaauucccaaauuggaagucugcucaaccacagggccugcuaaccuaaucaggacuaugaggcauguauaggagaauguguauugaagacagagagaacaugaaaauggccuggaggagaacuuugcuugguuaucugaacccaagagguaaagaagauggauucugacugugcccuacaggcuccuguguugguggcugugguacguauauggaacuggggcuacagcauggcugggaacuucugcagaaugaggcaaggcugcacacuccuccaagcaauguagcauaaucauacccuuggcauuuaggaagaacaugugacuggaucauccaauaggaucaccaaugccugaggcugcugcuuagaauugaaaauguccaggaauagggaaccugcuggagccaccauuuguguacuuugggccaagagaaagcuagcuagaagagcagugaugagaacugaggagagaagggcauucauguaaggaggaggguuuuuauguuuuccuucucccuucuuuucaucaaacaugcaauuagaguugggagcauugagcccaaaccccagauaaggcagagggacuggagauugaguucaccuuuguggccaaugauucaaucaaccaagccuguguaaugaaaccucuaaaaaaaacuuuggacaccgaagcucaguaaaugucccugguuuguaauacucugggcauugucacacacugaugugcagggaggguaguguguccuuaggacaaagaagcuuugcauuugggacaaaucuugccaccugcaucucucccuuuggccggucuggauuguauccuuuauaguaaaacuugaucauaaguauagugcuuucccgaguucugcaaaucauucuagcaaauuauugaccugagggaguagugggaaccucugaauuuguagccagcugcuuguaaaugagggucaccuggagaccccugggcuugcagcugggguuugacgugagaccagucuuguggaggacugugcccuuggagcuguaaaguuuggccuaacuccaaguaguugguucuagaagucuuugcagagagugagguaauaauagaacaaggguuaaaaaauaaauaugggcugagcaugguggugcacaccugucaucucagcacuuugggaggcugaggcaggaggauugcuugagccuaggaguucaagauugcagugagcugugauugugugacugcacuccagucugcaugacagagugagacuccgacucuaaacagagcagaaaaaacaaagcaaaacaaaaauaugaauagauuugaaccuguggcuauaauaaguaaaaugaggccggguacggugguucacuccuguaaucccagcacuuugggaagaagcaggauagaggugaggacaggacagaccccgaucucucgugccucccccuguguuuuccugcaguguucugcuagcugaacccaaccauaaucugguggccagggagcugaagaugucaaucugcaggggcagagaaaagaggaugauggagcaguguugcugcagaaugccuggcacuggcugggugggaagaaaggggccuccgagugcaucgugugggaaggaaucuguagucacaucacagguccguuuauucauucaagaaacguuugucaagugcccauaaggugccuugaacugacuguucuagguacuuaggauacaucagugaacaaaaagccccaaauccuaacccucauaucgcuuccuuccuaguauagagagacacagagaaaaaguaaaugauguaauaugguaggaggggauaaauucgaagucuuuucccucaaauuagagcccaauaagaggccugguguaaaagucagacugcaacccuaaauaaggcggucaggguagccucacugagaaaaggagauucaaugaagacuugagggauucgagggguuagcccugcagaaacccagggaaagaacacucaggcagagagagcagccaaggcgggagaauucccggcaugaagccagugaggcucaaguagcaugaaaaggggagggucacggggcuaguuccuguggaguccugcaggucacuggaaagacuuuggcuuguccucagagaaacgaggacugucaguggguguugagcagagaacucguacuuuaaacagaugggguagugaugucagagacgcuccugcaagggcaagggaggaagcuuggagacccgucaggaggccucugcagaacaggauggagucuggagcccgagcagcagaugugcaaggugggaggcuggucagaauuuggauguuuucaggguagaaccagcaugagguucugaaaaaccggaugugagcugugagaaccagugagugauguucuagugauauuccaagguuuuaauccugaccagcuggaaggauggaguugccaucagcugaaauuggaaaggcuauaagcagggcagguugugggaaggggcagaucaggaggucagauuuggagauauuguguucggaguguuuaucagacaucaagaaucaguuagauaucugggagucaguuuggugugugagucggcaguucauggcgagguuuggguugagauaauaauuuggaguuugaggcacagagauaaaauuuaagagcacgacauuggaugagaucaucacaggagugaauacaaaugguaaagcacuggaagcacgcccacugaaggaggucaggaaggagagaaacagugaaggagacagagcaaaaggggcccaugagggagaaggaggacaggagcaguguucccuaaaagccaagggcucccugguuucagaugcugccuuuaaguggagcagcaggagaacugugaaguagccaguggguuugguggugagaaggucauugauaguauccauaagaguagcuuuaagcagugguggacagcagcccagcugggauugggaauaagaaaaaaugaggauaaaauauucacaguacaugcaucuggcaaaggaguuguauccagaauacguaaagaauccuuauaacauaauaauaaggcaaacaauccaauuuuaaaaaggggccaaaggcuugaacagacacuucacgaaagaagauuuaccaguggucaauaagcacuugaaaagucgcuaaacaucaucagucaucagggaaaugaaaauuaaacccaaaaugagauacuaccacacaccaguugaauggcuauaauuaaaaagacugacaauaucaagugcuagugacuacguggagucacuggaauucugcugucuuccuagagggaauauuacaucaaaaaacaguuaaagauacacuuaccauaaacucauugauuucauuccuagauauuuacuugaaagaaauaaaaaaaagucugcucuauacauguguaugcaaauguuccuaacagguguagucauaauauccccaaaaugauccacauauccaucaagaggugaaugaauaaaugcauggggguauauucauaaguguauuaccacccagcaauuaaaaaaacaaccacagauacacacgacaagaagaaggaaccucagaaucauuaugcagaaugaaaggagcuggacauuuguuuaaaauuauagaacaaguaggccgggcgugguagcucacgccuguaaucccagcacuuuggaaggccgaggcaggcagaucaugaggucaggaguucaagaccagccuggucaacauagugaaaccucaucucuacuaaaaauacaaaaauuagccggguguagugccaugugccuguagucccagcuacuugggaggcugaggcaggagaaucauuugaaucugggagguggagguugcagugaacugagacugugccauugcacuccagccuagaugacagggcgggacucugucucaaaaaaaaaaaaauuauagaacagguaaaacuaaucugugacuuuauagaaauagaaauuugaucaguaaaugcuugggggcaauggugggugggaaaggggcccaggggaaccuucugggauauuagaaauauuccaaauuuugaguguggugguggcuacaugggugugcacgucugucaaaacucaucagucuguacauuuaaaguguguaaauuucauugcaugcaauuuacauuucaguaaaguugacugaagaaagaggcugagcauggugguucacaccuguaaucccagcacuuugggaggcugaggugggcagauugcuugaggucagggguccgagaccagccuggccagcaugaugaaacuucaucucuacuaaaaauacaaaaauuagccaggcgugguggcacacaccuguaauuccagcuacuggggaggcugaggcaggagaaucgcuugaaccugggagguggagguagcagugagcugagauugcacaacuacacuccagccugggcgacagagugggacucuaucuccaaaaaaauaaauaaauaaauaaauaaauaaauaaauaaauaaauagagagagagagagagagagagagagagagaaugggagaagcugacccgaaacagcaagcauagauaacuauugccgggcguuuuauugcaaagaaaaacaaagauguggggaaaguggucucaggagaaauuuuuguuuuaaaguaagagaaauaucugcaugcuuauuugcugaugggaaugagucaguagagaacgaagacagagaacugcucagcaaugcccuggaguaagcaagacggguuugguggagaagggucgagggcugauuuuaaaugggacucacaagcaaaccugauuuuccucuguguucucuucuguacuuucuauaauaaauauauuuaaauguauaauuagaaaaacacaauaaaugguauuuuaagaagaaaaauagcauguuuuccauaacuaguaauauaagcagagacuggucaaggguuggacucauggccaauaaggaccaaucugauucuaaaauuauucuaaguacauauuaccacuaagguuuauaguuuguauuauaguuuuuaaggaagaacuugaagagguuugugucaaucauuuuuguuuucuuauccagagaaagagggagaaaaggauauuaaugcguucuaccucuggggaaacugaggcacacacaaagagguuugugucuaauccauggccacagaauugguaguaaacauucaauugaauacaaauaacuauguucaagauaccacgcucagcaaggauagaaagaaaauuuccugacucccugugagucuagaacuucccuucacuguagccuaaucuuguguuuauuuuuaaauaaaugaaacugcacuuucuaccacugagucauuccccuaacucagggagcuaauggcuuuccuaaguaaaugacauucauugaucaauaagucuuugcuggaugauguuuuaaaauacugagagaaaauuuaaaugcaguaugucuaaucagacuaaaguuaagggcuuuaugggucuaaaccuaguaaugaaacagcguuuucuucuuuauuggcuggucuccuaguuuuauagguuugcucaaauugugauuguggaaugauucucguaugugggguguuuaaguaaagcaaccccaguugcuuuuacuuuauugaucuuuuuaaugcaccagcuucaguauuuaaaugaguuugaguuuguuucuuuaauggucuuucaauaaagcuuaaguugacccgguugcuuuugcaaucacagcacuguaacagcagaaaaagaauaauaauaaaaaugaacucauuuuaugugguugaaaagguuacauuucuauugauuuuaacuguaauauaguuaaaguccuugauauuaaagaaaacaacguagcagacacauccuuuuuaguacgguggcucuauugauauuacuuuaccaguagguuuuggcagcaauaacaauauucaggauggagucgaaacauuggcaucaucagaggacugauaaccacauccuucaaauucuuuuccaggugaaagagcagaaagguguaucaggaagaucauuacauagagagugacuucagaaugugggggaaugccugaaaguuccauuuaacgaccaguucugccaguuuauggaaagcagcaaugcucuguucccuggaaacacugaagcuuuuuaaugcuauguuuggagcucguuccagaaguagaagguggagagggaugggagaauucaguagaaauggugaggaauggagacuagaaaagaccaggggaagugaagggagaugauggacauucgcuucuuuugugacccggcccuguacgagugcucauugugugcacugaguguguguguguguguacccaugugcauuaaggcucuaacacaauuggcugagcugaauucucaguacagaagccuauuaaauuuggauuuggacuuggauuguguguucaaaucuacucgagagaaagcuugggggagucugcagaccuugaaccucauggugacccugagcccgcucuaucuugcucaaaucccagcucuucuuccgucaaucuuccagagagguuuaguuccuggcauucugccuggguucccuuggcaaucucgggaagaaagaaaaugcugcugaaaggauuugggagaaggaagagcagcgcgcagaauaugccagcagcaggaaaaacaucugguccuccccuucauccuccuccacaucagcaucuaacauuuccuggaggcgaacugcaggugggaucccaccauaaguacuuuacacauauuauuuuuuuaauugcacacaacucugucggcacauacucuuauucgccccauguuacaguugaggaaacugaggcacagagauuaaguuacugugucuagaggacacauaguugcugaguagcuagcccagaggucugugggcuugcagaggccaagcuccuccaugugccaaccuguauccuuugccauagaagagcaaggcuggcaucaugcccacaggaaaugcacaagacaacccaguuguuauuccaaauucuucucuaaaaguauucucaaucaacuccaguccaaaauugcuuuucauaaaaaauacuaguaaauauaaauacaaaagguacaauuaguaaaaaaauacaaaugcauauucugauuuuauugguuuuauuuuuucaaaaucuauaaaucauauuacuauuaaauauagacuacuauauguaaucuauaauauccuuauaauguccuauuaaaauguuauauuagauuaaaaaaaaaggcaacagccuggcaugguggcucaugccuguaaccccugcacuuugggaagcugaggugggcagauugccugagcucaggaguuugagaccagccuaggcaacauggugaaaccccaucucuacaaaaaauacaaaaauuagccgggugugguggcucaugccuguggucccagcuacucgggaggcugaggcaggaggaucgcuugagcccaggaggcggaggcugcagugagcugagaucaugccacuacacuccagccugggggacagagugaaacccuguauugaaaaaaaaaaaaacccaaaacacacacacacaaaacccccaaaaaggcaacaucaaaaacccuaacaaauccuaguaauuaaaacauaaauauaauccaaaacauauuuuccaaugaauaaauaaauauacacacugggcucaauacucauuccuuacaacuacaacuaaagauuaccaaccuuccuaaaaaacagccuucucagcuacauaacacaaucaauauuguuuuuauaaauauggccagaguuaauuugugaccuaaagagagaacuugugagacaaaaucacauacauaagcagcuaaguuugcuugucucugugccaacauaauuucacaaagccccaacucugugaugacauacagcucuccaaaacgacaaaauaaaacagaacaccuggcccccaucucuccuaccuaagucacuauauuccuuaaaagacaaaugaaccuaguccuuaccuucuccuacgcauaaaauaacaucuggggagauuagugaugacacuucuauaaucuagaaccagauauacccuuacacccaaaccuuaacguaguucuacuuuaauauaaugucuaaacaaguuucauauaacuuugcacaugcuaaaccccuagcaccuauauauacacagugggcuaaaauacugugcuggcgcagucucauaaaaccucuguaaaagacugcuuguggguuguaggccucagucuacaguccccaauaagacuucuaaauaaaaccaacuuuaauucuucaaaaguuuuuuuuuucuuuuuucuuuuuuuuuugucuuuaguugacauuacauuuccuuuuauccauugauaugguuuggcugugucucuacccaaaucucauuuugaauucccaaguguugugggagagaccuggugggaaguaaucgaaucaugggggccagucuuucucaugcuguucuugugauagugaauaagucucacgagaucugacggguuuaaaaagaggcauuccccuccacaagcgcucucucucuugccugccuccauccacguaagaugugacuugcuccuccuugccuuccaccaugauugugagacuuccccagccauguggaaccgugacuuuuccauuaaacccuuuucuuuuguaaauuacgcagucucagguacgucuuuaucagcagcgugaaaauggacuaauacgucaacuuucugauuuguacagccucuguccccucugcuagcaggacagguucucagagauggucaggauguuggaggcuacugccccugugcauuugugguguuccacuguugggguuaagcacacaagcccuggcagaagcuaugauguugguaaccuagauccuaaugccauuuccccaggagaccaggagucagaucgguggagugggcugauuucuacugucuguucucaccauguaaccucugcugguggcccugggugacaauaucaggaaggaugcucggauaggauggcagccauucgcucauguguuuuauucauucucugacuuccacuucuuuuuggauguccuuucuucaucuuuucucuugagcugccagcccagaccuucucuucuacccacaaaggggggguuuguugccccucuccuuaacauuuugauuauauuuccucagcucaaagauauaagaggaaaggcaauuauuagcucaccaagcgaccacuggggaaaggaugcaaaucaaauauauuuaauacuucagaaagcaggaagaauuugugcacuuucaaauagccaagcucauugaaugugcacagaauccaugauucauaaacuggauuccuucacguauucagucacucagucaacacuucuugaaacucucgugugugcccagggcucagggacagagcagugagaugugaaagcguaagaaaaaucccuggauuguacccuuugaaugcaacggcaagcuuccauuucuauaaguaauaccaaguccuaccgccaucgcgguauccgcgacagaugcaaguaacccgcgcuauaaccuaggacucugguuuuggucgguguuuauagaaaaccacacccaagccaguuucacaagauuuucccuucccuacgcucacugguuacagcuaaugaccacuagagggcauuuuaacacuagcuccgaacucgcuccaggaccauguccaucaaaaucuucagacucaaucccaggacugacuucucccugccugaguggaagggcagcguggaacccuucagaaccucaaaccgcauguugagauacacuuacuuuucagacagaagaugaauuuaggugagauaagaaccugcuucaguuaccugggcaagaaacaacccgcucugcccauugugcuaaaaauuugcuccaagaguuacaaucuuugagagugauuuuagugcacugcagauggauauaacaguaugaugcuuugcagauuggacuuuaguuuucaugccagacaaaauagaaauccaggaaccuuauguucuuucuugagaggugauuuauguauuuaaugcacuuggaggaaaaaaaagugaacucccaaccuuggucuuacaagcuuuagccguauucuggagaaagaaagagaggacugacaucucaaacccuaaacuggaucagaaauugcauugcaacugccuucccacugagcugcaugaaauguaaaacgaaguaaacacauuuuucuggaguguaggaauggagguacugucuagcccuggagugcauaauucauuugcagaugaaauugcuuuagaaaacaaaugaaaaauguggaaguguugacauauucauuaugagucuuuuucuguuucagaucagaugggcuugauggcuuagaacuuauuuucuuaacauauuuucuguauaauuuuuaugaagggcaaauguugaaucucuguaguaaaaaauaaauaagcuaaugugauccuccccccuccaccauggaaaccuugaaggaacagcucaaaugccuuugugagacugcucugauccacucuuuccuccucaggauuauucauuccccuacuuuucugugcucccacagcacaagcuuauacuucaaugggcacuugguucauaucuguaugacugauggucuuucuucuacuggacugggcucauggaggcaacagccaugcugcaugcugggaauauacuaggugcugagaauaugcuuaauggguugaacuacaaaucaauggaaagaaaccauagucccaaagagccuguugguacugauccugacaucugcuauuuuauuuuuugcuuuuaagaaagagaagggaauugggaaugaaggaagaaaacuaccguuuuauugggucauagacuaugcuagauuuuuuuuuguauuuccauuuaacauacacaaacugcauuagaaaagauggacuuacuccaauuuuagaaauuaagucaacagagauuucauuaacuugcuagagaacacagagcuauuaaguaagugugaugguuaauacugacugucaacuugguugaauugaaggaugcaaaguauuguuccugggugugucugugaggguguugccagaggagauuaccauuugagucaguagacugggaaaggcagacccacccucaaucugggugggcaccaucuaaucagcugccagugcagcuaggauaaaagcagguaggggaacguggaaggacuggacuggcugcaucuucuggccuucaucuuucucccaugcugggaugcuuccugcccucaaacauuggacuccaaauucgucagcuuugguacucuuggaccuucgaccacagacugaaggcuguacuguuggcuucccuacuuuugagguuuuaggaaucugacuggcuuccuugguccucagcuuguagacggucuacugugggaucucagcuugugaucgugugagucaauauuccuuaauacacuccccuuuauauaugcaucuauccuauuaguucuguccugcuagagagcccuaauauaguaagguagccuaucaauaaagacccuuuuaaauuuaugucuuaauaauaaccucugaauucaacaguuuguaauccguggggucucuguuuacacugacauuguccucaaggggaaaucucguuacgugcuguguccuuaucaccaccccaaacugcuaauauucucuuuugcuggauacccuuuuuauuauuuacauguugauaaggagacuugucaaacugucuucuagaggagaaguagguggaacagguuucuauuaucugacaaaaugccuagugacuggacacaucuuuucuccccucccagaauauaaacuccuugaguuguaaaagauacauuuuauucaucccuguaugagucaccuacuguuccaccaacucaucauuaucuauccaaauuucuuuuauauuguagauacucagcacauauuuguucuccucaaaguuauuuugauuaaaguggaaucaauuuuaauugcauuccacaucaguaaauggccuaauggaaugguuuuggugaccaucugguuuuauccaaaucaggcuucagaaacgauugcuguuuggaacuuucucaccaugugguggguuuagugguaggcagggguaagagagaaugucaauuagauaucaucauguuaaauucuuagggaccccauguggcuuuaaguagaagagaaguacauugauaacagaagaguccuggacaucuugagaaccuucugucuucuucagcaggaucuucaccacacgccuccaccacacuccuaggaaccauguccuugcauacgggcuggccagaccucucaguguggagguggccugaguuuaaaacuucaagcugguuugaagguacugggagggagaggaaucugaggcucugguaguugggcaucuuguuuccucuuuucagaaacauuuugucaaauacugcuacuuucugaaccaaauaaugaaaacgugcucaaauacuuucucaggggccgaggagccauagcucaacccaaaaccagaggcgacauuacaaaagcuaaugaggucaugagguuuuugaugugucucucaaucaugaacaggcuucucuggauacauagaaauauagaagaaaaaaugaauucugacucauauacagaccaaauuaaugggcaacuucccaauauauguagcccucucucuucucuucccauagaucuucuauaucaguucaauagacucaaaccauuguaauacuaucagaaacuaauaaaauauuggccuaugcucuccauagaauuauacaugucagucguucauuaaaguggaaaguuaagugcuaauacacuugcuaagaaucccaauagagagccagugcuauaauagguaaaaguucuucuggaagggaagaagccagaguguucaaauggcucaucauuauucuugcaauugccugccuucugucaagcaugcuuguauugcacaacccaggcugugaguuuaucauccagaguagauaaaaacuaaauuagccaaagggaaggaguuacaguaaauguaauuucaagagcagugcccuaggcuagcuaggucaacuuucuuuauuuguucugacaucccuaaaaaauuuagugcuuccaaacuguguuauuuuccuuaauaaaggcaugaacaacuucugauaguaaaauuuuuaggaguguuuacauccauaugcuuguuaguauuguucuuuauuggcagaaaguucaaggguaauaaaggcacacauuuuuaaauaauuuauuugagcuucaguaucuaauuucagucugggcuccauguuucuacagaaaagaaggauccuaaaauggacagacaagagguuauguucauauuuacuuaaagaaugagauggaauuuuuauggguguaugauacugugugcuguaaaaacacuagccuuaacguuggaccuuguaguucucuuugauuauaaaaauuaggguuuuaugacccccuacgaaacgcuauaaagucauugcuuuuagugacuccaaagaaaacacaaauccucaaaagacuuaauuuugcguaaacauuuuuaaaaaauuucaaaaguuuauaaggcaaaugaacaggagugagcuugcuucucuugcccacuugcaaagacaacaaagagcaaacuaaguggggaaacggggucugguuagcuggguucuagagaagaucaugucucuugugagcacugggaccuuauucaucauugggacuucuuuuuuuuugagauggaguuucgcucugucaccaggcuggagugcaguggcacgaucucagcucacugcaaccucugccucccggguucaagcgauucuccugucucagcccccugaguagcugggacuacaggcgugcacccccauguccagcuaauuuuuguauuuuuaguagagaugggguuucaccauguuggucaggauggucucgaucucuugacaucaugauccacccgccucggccucccgaagugcugggauuacaggcgugagccaccgcgccuggccugggacuucuuaaucucuguuuucucauguauauaaugggacuaauagcaccagcuauuuccaguucauaaggcugagaauggcaaugugggcaagcauuucgauauguaagaaagggcuuugagcacuaccuaacaugaucauuaaggcccucucaagucuacagagauuuuucucugggcuugaggagguuaugugaaaguccuuacaauuguacacuuuuccacauauagaaaguggugaacuagggcucccccggccaccaauguuucacgucaauuaacauuuggugcugcccuaggaguccauaauugaauuacucucauuuugcugcugauaaaauucuuccaacaauuuuugacaccacucugcaugugccucagacuacugacuuuacagcauucaauauucauaaaugacuucagaccauuugauguuacauauuucagagugagaauuucuccagguaagacuuuuuacugagucuucuccaguggucuuuucuauucaugagauagagacaggaugaaaucuaugaaauagucacucugcuagcaucuuuguuuaacaucauguucucuuuuggaacacacaucuucccucuccuucucccucuuccauaauaaauauucuuccauguccucucuugccccccauucacagguuaacaucuuauccuuccuucaaagccuuauaguuauagcauagaaccacaaugucuuuuacucuauuauuuuuggacauuaguacaaacaccuuuuuuaucagccuauuuauauauugcuuacgauuuccaacuagaaaucauuuuacuauuaugugggaaagaaaguuauuuguauuaagccucugauuuuuuguuauagcagcgaauacaacccuaacgaauacauacauugguaucuuaaggcagggugcugcuauaacagaaaccuaacacauguagcauuggcuuugugguaagguggcagguggugcaggaaugaauauuagggacuugaaagacagaggaagaaugguaugugauaugguuuggauaugugucccugcucaaaucucauguugaguuguaauucccaguguccaaaaugaggucauggugggaguugaugggaucauggaagcagagcucuaugaacgguuuagcaccacccucuuggugcuguucuccugauaauaugugaguucucaugagaucugguuguuugaaagugcguagcaccuucacucucucucaguccugcuccugccauguaagacaagccuacuuucccuuugcugucugccaucuaagcuuccugaggucuccccagaagcagaagcugcuaugcgucuuguacagccugcagaacugugagccaacuaaaccuuuuuuuucuuuaugaauuacucagucucagguauuucuuuauagcagugcaagacagacuaauauaguaugcaauaaaauauuuuguaaaacugucaccucacauaaccuggaaggcagacuaaaugccuaaguagcuuuaaggaaaguucuucaaaagagacagaauggucgugugugucaguugcuuuuugcuccucaugucauggagcagaugaguucaggaaagaauugaccaguucccaauaaucaaugaaaagaauagaaaaaagucuagauauuuagagccuuacacuagagaguaagaaauaacacugcaaaccgcuuugaccaacaauggggcaguaagauuucuguuuagcaaacugacuuagccucacggguaacauuuaaauuaagggucuuuacuucccacccaagccuuuuguguccacuggccccaaaguagcugccauuaccuugagagagagaggcaugggcgccuggaggcaaaugauugaguaagucuaagauugaugucuagggaagagcuuagggugcauuuaccagcacaugaaacuuaccagaagcaaauugaucagaagccaccuuggguuuugagggaauuguauuggaaaagaaagcacagaucuaguccacaaaaggcuuaugaguguaaaaaacccuuaguguaauuugaaccugcaggaaaugggccuuaaagcugcacagcuguagccaggcgcgguggcucacaccuguaauuccagcacuuugggaggccaaggaggguggaucacgaggucaggagaucgagaccauccuggcuaacacagugaaacccugucucuacuaaaauuacaaaaaauuagcugggcgugguggcacacgccuguacucccagcuacuugggagacugacacaggagauucacuugaacccgggagguggaaguugcaaugagccaagaucgugccgcugcacuccagccuggugacagagcaagacuccgucucaaaaaaaaaaaaaaaaaaauaauugcugcacagcuguaaggagcacauuauccggcacauaauucaggggaggccauggcugaacacacacaaggaagagccucccagaggauggagcccaggagggcuucaagaauaauggacaauaauuuggccuaauccaggguuggggaagcagggaaguugguggcaguggcagguccucagagugccugcccagcacaauuucaucacugcuggagaccagagaacuuuccuuuucugaaaauauaucugauguaagacagacuuuuauuggguuaaaacauggacauuugagggcuaauuuguauagcaacuggcaucauccuaauauuuguauccuuucuucuacuucuagcaccuagcacacuacauguugcuaauguuuuugacacuucucugacaguucuuaagauuuauauacaggaccuaguucaauuaacaauugaugcaauuguuuuuauacaauuugguugaaauucagauuaguagcagguaagaaauuaccgugcuuauauuauuuuaaagaacagaauucagugauauuuuugaacauuuguuuugaaaauucccagugaaaauaaucaaagucauccucuuuuugguguaagaacuuggggaucuaaucaucauuuguuccugaggaccuagaauuauuuucuaagaaaggccuuauuuugcuugcagaaaaucuguuagcuucuucuuggcaaagauaagauggcccucuaguuagaugaaagccaaaaugauacauccuuaccaucuguucauuugauuuguagagaauauggauuccgaguaucugugccagagaauauaucccugaacucucuauugucuaacucacaucuaaacccaaaaaugugugauugucauggauaauuauucaaagaacauguaguuuauucauuaucauuuuccagcuaguuuuauccuaggaucaguucaaaauuucagaaagcugcaucaucucagccuuuggccucuucaucuguccaucauccugcucuaccucacucucuacagacuuguuugggcugaauucaaaaugggaagcuuuacuuucccaaggagcuucagcaucuaacagccuuguaacaaauacauuugcagaaaugcugcugagggcauugacucugacuuuuauuggggcccacuauguaaccaggaggacaacagacucuuaauuguugcuguguuuaaaaaaaucugaagaaauagggcaaaaugucgaaauuuguaauguuucaaugguggguacauagcauaugguuuauuauucucuguguuuuugcauauuuugaacuaucuuaugguaauaacaguaacaucacuuaauuucuuaccagccagagguaucugcuucuaaaauuuugugaacauccuuccagacaucugucuauuaagcaagguuaagagccuguguacacuuugaaguaugacggaccuggguucgacuaugcuguggccauuuaccgcuuucuaacuuugggcagguugcaucuuacuuuaugaacuuuaauuuccacaucucuaagaugguauauuaguccauucuugcacugcuauaaagaacuaccugagacuggguaauuuauaaagaaaagagguuuaauugacucacaguucuacaggcuguacaggaagcauggcuggggagaccucaggaaacuuacaaucauaguagaagacaaagggguagcaggcaugucuuacauggccugagaaggaggaagagggcaaagcaggaggugcuacacacuuuuaaacaaccagaccucaugagaacucacucacuaucacaagaacaucuagggggaaauccacccccaugguccaaucaccucccaccaagcuccuccuucaacauuggggauuauaauuugacaugagauuuggacagggacacauuccaaaacacaucagaugggaauaaugauggcacauacuucauaaaguuuuugugaugacuaaaugagaaaaugugucuaaagugcuuagcacguugccuuggacacaguaagcaccaauacaugugagcuguuaucguguaugugauguuguauaaguggaguaugcuaugggcauuuucuaugucaguaaauacaauccauggaauuaaauaaaauaaaaaugauauaauaacaaaagguucaauucucaagaggaacuggcuuaguucauccuuauggguugcauacuucuggcugccgagaaguucacagucaaauuuauccaagugguaagaccuugugaccugauaaucauguucuauuuucucgaucuuggggacuuacuuuuugugacuuccauuaacucucuauuucauuuaauauucucccuguaaacccccuuagaucccuugugcaaugugguugggaagagagaaaggaaaaaauaggaaggaaaagaaacauggauggcaagacggaaggaaggaaaggaagaagaaaggguuaguugcacaaggcuuuggaauuguugauuagaauguuucgcuuuuggauucaugcuaauugacauaauuuuucacugcaugccagacuuuuucaggugcucucuggcugcaccuuguuuguuuauauuuugacuggcauuaagccuuaagcuauucucccugaugcgacugugaguuuucacaaaugaugccacuggagguaugccauggguucugguucacgcuggugucugauaacuacuacagucaguucccuguuaucuauguggagacuggguacuuugucuuuuggcagcaaauguuucauccaaggucaguuucccucaagugcucagugcuguuucacagggugugugcugagggaaugcagauuaauuuaauguuagcuuuagccaaacccagcuacgaaaguaaaccugcuuuuaaagacaccauaaacacugaugaggaucaucuaaauuauauguuugagcauguauaaaugcaucaacauucaccuuaauuccaaagacaucauuccacagcacugugaucuaccauucaucuuugcauuagccuuauuuuuguucuuugacuauaaauaaauaaauauuaauuugaaauuauugaaaugccuuuguuaucauauguuauuauaacuggggacuaccagaauagguugagaauauauggcuguuucauauuucuguuugauuauaaaaaugcagcaugugcuuauaauagaaaauggggaaauagaaaacucuagaggaaaucaaaccauugauaaucccuucacacacagaugaucacugugaacauuuuauuauaucucuuuccacacacaguugaggcuguagaaguucucaagauggauuuuuagauuguuuuaagaaaaaauugcaguguuauuugguguugcaaagcacuuuccgaauuacuuccacgucugcaaggccucccugcaugaaagaaaguggggcaugggagugagaagcccugggaucugcuuuuccauaaggaggaacuacaucuugucuuccuccaccaccucuaucuuuacuuucuuuuugcccucaguggugggcaggucccaggguagaugggacaggcugggcugagagauuggagcuccccaggccgugacaucuuuccuaguugcccucacguggguugggacauucagaaaucuuacugcagucaguuacauuacaugacagagaaggagggagagcuggaucucccaacacuuccaggugcagaaccuagggcggaaucgaggaagcacuucccagguuuuucuccucuccuaccucagaaucgugcauccaaaauuuucacuccugucguccuaucuccuuccuuuuucuggaacugcauucuguucuuuugagggaguuucccaaguuccccacucuaaucaagagaugugauuagggacuaugggucuuuguucccccuuccacccaacaaggugagcacgugacucaaaccaggccuaucagagauucccugggauuuuaaaaugagugucaagaaacuaggaccccuucuuccgguaacaaaauugggaagacaugagcccaguacuccugugacuauggccuaggauaugugaaagauggagcaugcaguaagagguaauuaauccagucuucagagagaggcagagaugagaaugaaaaagagggagggaaggaaggaagggagagagaaaccuagugguauucuaguccacaguuuuaauucuccaggcucccuagauucucuucccaaaguuugguuuuaucuuuuucaaauucuauaauucuaugaccuacccuaggaauuuuccccaacaaauuacuucugaauugcuuuucuaucauuugcaaccaaaauagucuugggcaauagaaccagacccucccccaaacccauucauccccuggauucucugcaggucucuggcugcuccacugucuauaucucuggcuuucugugccuccaaagccccaagucuuaaaaaucauccacuccucuccccuuccucaagucuuucucuaauucacuguggcagagagugaggguaaacuguauacgauucuauggcuguggugggucucugcuguuauacugucugaaaagccauuguuuaggucuuuuuaaguuuuaguauuauuucgcaaugguaaaauggcaagauaagucacuuucuuuaaaagaggugacaaauuggguggcuuaaaauggaaaaagucucuaaucaaaagccgagggagacaauguugaugaaaugauguaaaacgaucugucuccuggacuugcuggcuuuucugacuaaaacuugguuaaagaugggcuugguuuacuccauaaagaauuugucaccccuaaugugugccagguacugugcugggcucugggacucugucgaccaugaugagagaaccuuauuaugccaccuuugauugauggcgcaguaagcugaaacagugcaugucaguuuccuaggaaaggccucuccuuaaaaugcccucuagcauuuacugcuaaaggccacgcgcaaacuccauaucaaguuaugaaucugacauccaccagugcucaaaagagauagggcuugugccuuuucuuugcaaccugaacuucccacagcauccagccgaaucagaaugaggucugagaggcugcugaaccccugccaaaugacacuccacuuuacugacaaaacagcauccuccugcuguucuuucuccugacaggcaucuauuuugaacuccuucuagagaaugcagugacaguucccauccuugaugucuuggccuagcucccagggagaccuccucacauuauguuuuauucaugguguuucccaagcugguuucuucacuguaaaaaucaguggugagggccggggucgucaaugaaccugaaguaaaauuugagugucauaauaaaaccaucccuuugugugccgaaagcccacagucagagucugagauucuggggaaagacuguuuugaggauuuuuaagacaaaggcucugcagagagagagagaaaaauacagcucuuuguauuguguuggagcagugaaagaaguaggucggagaaaccaaaauaaccuuugcugggaaacacgguaaguuucagaugucugagagcuuggcgaagaaagauggugcaauggauaaaagcaguaaauugauagauauguggaucuagaacugggaaaaccagaaagacuauacggaauaaacauuuauucuauuucccccuaaaagaugucuucaacuucaucauugucuuuccuugucagaauuauauauauuucuacuucacuaguuaugcacuuguaggagaaaguguaaaaagcaucucuucuacuucuauccccucaaaacaaaaccaauggccaagcauuauagggacagggacuauaaugcgauauuauauguaauuuauauguacauguauguauaccuugagaaagauggucuucucguggcgggugauguugacacuguggggcuguccauuggccauguuccuguggucuacgucaauauuguauggcucucgggugccacccagguuguaucgaaucuguaagcuuccuauagaagaaaaaagaaagcucaguaauuuguuugcccuaaauuucauuuuaaugucacauccccucaauuccugcucuuagauucuuucuuucuuccuuucuuuucuuuucuuucuuuuuuuugacggagucuugcucuugcccaggcuggagugcaauggugcgaucuuggcucacugcaaccucugccucccagguucaagcgauucuccugccucagcuuccugaguagcuggcauuacaggcaccugccaccacgccuggcuaauuuuuguauuuucaguagugauggggguuucaccaugcuggccaggcuggucucgaaauucugaccucaggcuauccguucgccucagccucccaaagugcugggauuacaggcgugagccaccaugcccauccaauuucuguuaaacuuuacucccucccuugauguccacagauaacauucaauauuugaauuuggauucacgagcucagaggccuacugacccauaucggcugacagcaccaggcucgcacauauuuacaaucugcccacagugaacuucagugacugucgucucaaaguugaagaugcaaauaguuuaaaugauccaaguugggauuaugccuggacacaaagaaugagagcauauacaauauaggacugcagggaggagacaucugcaggucccacgaaacacuaugugaaauaaaaaaauaaaugcagagugcagggauguucucaccccgucagcaaagugugacauugggcauauaaaagaaucaugagcauacaauauuaaaaauaaacauaguuuuuuuuuuuuuuuugaaacagagucucgcucugucgcccaggcuggagugcaguggcgcgaucucggcucacuguaagcuccgccucccggguucacgccauucuccugucucagcauccccaguagcugggacuacaggcgcacgcuaccacgcugggcuaauuuuuuuuuugguauuuuuaguagagacgggguuucaccguauuagccaggaugaucucgaucuccggaccucgucaucugccagccucagccucccaaagugcugggauuacaggcgugagccgacgcuccuggccaaacauaguucuuaaagaugagauuuuggguggccucauugagaccaaguaauaaauuuuauuuuagcuuacagacuaaucaaaugcaaaucaacaggaaagauggcuuucccugguccccugagucccuuuuugcccucaaugauaguucacuuugccucaacaguauauucuuuuuuuccuccuugcuucgucccaacaauaaaaaacaauauugaaaauaacuaauaugacaauguagauccugcuuuuaguuaaucugcaagcauaaauauuauaucuuaguuaugaguuuuaaagacaucaauauuuuaucucauuuguuacucaaauuggaauuuucauguugauaucucagagcuuaaaaauggagccagcaaucuagcaagaauuugaccaacugcaaaucaccuaauggauuauuugucaccuuucauuuccuuuuuaggggaacaaaacugauauucugauuuuaaguuacaaaauaaaacaugcuaauuaaaacauagaaaguaaacagaaaaaaaauaaaagaaagucaccugaaaucccaccacccaaagauaauuuuucuaaacaucuugggaguagcuccuuccagacuuucacacacacacacacacacacacacacacacacacacacacacacacacacgcugugcucuuccuuauuuaggcauccuaacauuacacuugccauguuccuggauuucaaaggaacauuuguuagaauaaucaagagcuaauuacauuuccuauauuuguuuucuaaacgaaauucaacaaaccuucacuauuucugaguuuuaccuuagaaugucauccuagacuccuuugccccuggcauuucaacuaagcaccguggauuggauuuucgucuccuaaaucuaucuaaauucccucacucuuuuccacuucgguaaccacaggcuuucuguuggcacccacaguguccuugugugaauuccagagggagccugcucccuggcugaggcagcuccacacagagcuccugguucauccucaccugugcuuuaccugcaccaucuucugccuggauugcagaagauggugggucuuagucagccuccucuuuaaaaauuacugcucuugaccucauuucacucucaagugaggccucuuauccuuugcuuuucuuugcuccgaaccccaugaaaagagauggguacacuugcugccuccaaacccgucccuauuuuagcaugagcccucugucucacuucugucuucccugcuccacggucucuugcugggcccgugacccuuggggaaguagaggcaauugucccucucaggccucaucuucacucggcacagaauucauucaccucccgggaacacuuggcuuccagcacacacucuuucgguuuuccuucucuaccuguuuuuccccucguuuuggggcaccuuacucuugcaguccccaaagaccagcccugaagcauauucucuuuuguauucaggccuguuuccauggugauccuguuacugaaggaaaaucccaaagggucugcagcaaacuugauccuugccuccucagaggaaagaaugcggcuugaggggcagaaguagguuuaaggcagagggagagacugcggcaaguuuuaguagagcaggagugaaaguuuauuaaaaaguuuuagaaaggaagugcacuuggaagagggccaagcgggcgacuugagagauccaagugcccuguuuggcccuugauuugggguuuuauacauuggcauaguucugggguuugguuucuucuccccugauucuucccuuggggcgggcugucugcaugcgcaguggccugcgagcacgugggaggggcugcaugcacagguguuuacugaaguagugcgcaugcucauuugaggcauuuuuuuuccccuuuccaguugaguguuccuagaggaaggucauauacccguuaaacuccaucauuuugccucuuagugugcaugcuugggcccgcuugcccaacuccugagaucugauugggaagcugcugaucaccagcuccagauguuuucuaucuauugggagacggucguuccuuggugccagcugcagccaauuaucauuuuagagagagacaguuuagcaacugccugaccaucaccugaugguugucugacauucuuggugguuggugggagggggcacccucuucugcccugcucgugugucuaccuaccuacuccaacaauccuauccuauguaggaccuuugaauaagguguaugcccaucagacaccacauucauacccuagucagacuucucucuugaacuccagacucuuuuuuuuuaauaauagcauauuuuuauuaauaagcuacagaaacaccuguacuuaucagcaaucuucaaaaugauauuccagucaagaagugugaaauuaucauuugaaaauuaaugaauaaauucuaggaguaguuucuuacuaagagugaguuaaauaacuuuucagcacauucauuugaggagacacaguggcauugaggagacucuuucacaaacugucuacuugauauuuucccucagauaucuuacuggcaaccccaaacauaacauaugcaacagaacauccaucuucucuccccaaaaguauuccauugcaguuuuccacauuucagugaauugccaauucauccuuccaguuauucuugccaaaagccuugacuguccucuuucuccuauaugacaugugucaucugacaccaagucuucuuggcuugaucuucaaaauaugcccugaaucuuaccacuugucgccaucuccaucucuacccccuggaccaagccaccagugucuuuugcugggauuauacuagcuuuuguccuuucuccaaccuucccugaucccacugggccucugacccugagauacacaguguccucaccacacgguggucagagugauccucugcucaaaaucccaguaacuccccgucucagaguaaaaaucaaacuucuugcaauggcucaccaggccccauaugaucuccucauuauugcugaccuaaccuccuguuacucuccuccuugcucacuccucaccauccacauuggcuuccuguuccuacccaagggccuuugcagucaccgguucuucuguucaggaugcucauuccccaggucucugcauggcuaugcccucacuccuucaggucuuugcucucauguccucuucucagugaucauuucugugacuuccucauuaaaaguggaauuuacccucuccuuccccuuggccaggcccucccuuuucugccucauauuuuccccauaacaguucuuagcacacaacauacuauagauuguaccaauuuguuuauugucugucuucuccuauucaaagauaagcuccaugagagcaagaauuuuuguuucuauucuuuaugacuauucccaaugucuagaauagugccugaugcacaguaggaguggaauaaauauuuguugaauaaaugacugaauggucucugauaugguuuggcugugucccuauccaaaugucaucuuaaauuguaguucccauaauccccaugugccaugggagggacccagugggagguaacugaaucaugagggugguuaccucugugcuguucucaugauagugacugaguugugaugagaucggaugguuuuauaaggggccuuucccuccuuugcucugcacuucucccuccugccgccaugugaagaaggacgugcuugcuuccccuuccaccauuacuguaaguuuccugaggccuccccagccaugcggaacugcgagucaaugaaaaucuuucguuuauaaauugcccagucucagguauuucuucauagcagcgugagaacagaugaauacagucucccugcuucuguaccgucuucuuccccauguuuucaaaauguguaacugauuauuuuauugggucauuuaaaauccuucaaagccuuccaauucuuuacagaauaaagauguacuuuccaaauagcgguugcaaugcccugucugaugugcauuccuccugcuacuuuauuuucaagucauaccacucacugucacuuuuuacauucaaacuaccacgaacuucucuuauucccuagaaaauacgaucuccuccuaccucagggccuuugaauaugcugcuccuacuucuugagcugcuucucucuccaccccucaguguuuacucgguuuuuccuuuacccaauagcauuaaaauaguccauuguuugggaaugacggagaugaucaggcaguuguuuggcaacacgcagaaaaaacacguugauugucuuagguuuuuacucucugccuuauuucuggugcucugacaucauaucaucccagccaguuuucuuaaauauacagcugccuugauucaucucuuauucauuucuucagaacacauauauuuaguuccugugcaaagcacagcuuuuuuuuuuuaaaggucugaaaauaggcuuucugccugguuacaaguguagaguccacuuauaacacauacagccaugcccauccccuggcaugggucaggcaauauguguguggcucugaggauacaaacacacagaggccuagaggucggaggaaccggcaauuaugcaaaacgcuggacauuuuccucucugcugucacuuugucacuggccccuuuauguuccucagcucuauuaaaaucagcauuguuuucucuuuuuuuucuuuucuguccuucuuggacuuuguaaauaugauuuuaaauuccuauaacugcuucacuuaauggcagcagaaauuauuggcuuugagaaagaaagaugaguuggaacuuuaaauuuauauauagugacuaucuauaaacaguaauggugauauucuugaauaauccaauuuaaaugauguauuuauuccuuucagauaacagcagaagaggaccgcuaaaugaugguaggaagaaugcuaguauuuguccauuaaaauaaaacauuauucaaaugcugaggugcuucacuucugugucucauguucaucucccaagugaauuaaagcaguuauaagggacuucucuuuuauuggaugcagcaaauaacaugcuuaacagauuuauucucuccuggucaucaucauuaucaucagcacacacuuacaggguacugaucguaggcaggagauguagugcugggagcuuuucaucucucugggaagacagggcauauuuaucacagagacagauaacaauacaguacauuaaaugccaaacaaaugacauugaaaguaaguggaauaggaguuuaaagcaaggagaagucaucaaaaggaggugggacuugaucucagccuagaaugaaaggcaggugucuggcuagagaggaaguuggggcauuucuagguaagggaguauugcaggcauaaagucaggugcacauaugaccacagagugcuugagggguaaugaguuucucaaaacgaagaguagggguugcugaauaugcguuagaauguagauugaauccguggaccugggaaauaauaacuguugacacaugcauauugucauuugaguuucacaacacuccugugagggagacacuauuuuauggaugagcaaacagaggcauggagcugccaacugauugcccaagacaacugacaaaaggcaaagccgaccucaaacccagacgguccagcucuacaggccaccaucucacccaugagcuuggugggucucaaacuuaaaaguuuguggcacugaggagucucuccugguuuugcuggaguggggcaccacugaguguuuaauaaagacauuauacaagaucccuuuuaagcaauaucccuaugcuauggugugaauauccccuccaaaacucagguugaaacuuaaucccuaauauggguauauugagaggugagcccuuuaagaggugauuggaucaugaggacucuguccucaugaauggaaugauccauucauagauucauggaaugauccauucaucgauucauggaaugauccauucaucgauucauggaaugauccauucauagauucauggauuaauggguuaauggauuaacagguucucaugggagugggacugucuauaagaagaggaagagaggccugagcuggcagcuuaaccucgccaugucaugcccugcacugucucagaacugcagagaguucccaccaguaauaaggcccucaccagguuuggcccuuuggccucagacuucuuagccuccauaacuauaagaaauaaauuccuuuucuuuauaaauuacccaguuucacguauucuguuacaagcaacagaaaauaagacacccuauaaaggcaggcggugcuggcuguggugaaaaagggugagggggagaaucuggaagcagagagauggauugggagagaauuucccagccaacaagcugaagcccacggcuguccuacagaugggugaugggguaccaggagcaaggcuccccucacaccguggcagacaugaagaaggggauggcagcuggagucacugggcagguggccuccaaaacaugaccucauccauuuacccugguaccauucaaauauaauaauuuucuauggacaccaugacguaaacacuacugggaauuaaaagauauuugccucagagaguagugguggggaggaaaaggacaccaugaguucaauucacaggacuuguuugccugggugacccacaaaagcagggaagaacggagcacuggugagugacacugaccuugggaacacaagugucugaugggcagugguggugcugggggcagcugguucuggaggacagugagcagagcuuucgauaugugaaaugugagugaugccaggguguuuaguggagacuuucuaguagcuuuuuccugauacuuuggcguagaccuuacugauguuuuuuccuaaugauuuccuuuuuuuucuaacuuuaaacuucaaauaauaaaaacauguuguauuugaagucugaaaaagcugaauuuucaccagcaguuugaggauagucuuguaacagugagacagaacccacccagcuuugccuuccaagaacacugagaguuccagagaugccugcccuggagaguacagccgguggggagcuuugggucuggaaucggacacccaggcugagaaaccccagccuggcccaacauccucugagugugcaaggcacucaaccuccaugcacucauguguugccaucaguagaaaggaaauaauaauaguaucuacuucauagaguugugcagcucaugggaauuaaugcauggcaccauucaggauggcuuugggcacaaagugagcuucauuaaaugguggccauuaauacagaauccauugaucaacgcccuugaagacaaugaaaguccucacacaggcaugagggcacagcaguggcaggugaugaaggcacagcagcgguggguguguagcagugggcaugugagguagcgaauacaguugaggaccaaaucuaguguggcagugacucgaggagcagacaauaaaaguaugugugggaauguguucaccaacuucuugacagucucugggugagagcccuccuccuggggagggaccugagaagaaacccaagguucuuaucugcccagugggaggcugguccauguggguagugaacaucagugggucaaaaaaaccuauugacccugauccaggagaaauaaacugaugaacuccugaagaccaggggcuccauacuucucucucuuucauccucacuuucugauuuuacuuacuguuuucaucuuucugauuaaagcauuugacaugcauacaaaaguacugcucaggagaaaaaaaaaucauccacaauccaaccaaacacuuuuguguucacauuauugcuuuuuuuuuucuaucccuauauuuuuuauggagcuaauauuucacauucaaggcuggaucuuguucauguuuuuuugguuuaacauacauaaaauuuccccauaucauuaaucacgauucauaaauauuuuaauagauacauaauauuccauaaaauggcaacucccucuuuuacuauuuuacuaaaaguugaacuuucagauucuuuucaauuuuuauuuucauaguuaacauuaugauguuggccaggcacgauggcucacgccuguaaucccagcacuuuggaaggccgaggcgggcggaucacgaggucaggagauugagaucauccuggcuaacacggugaaaccccaucucuacuaaaauuacaaaaaauuagccgggcguuguggcaggcgccuguagucccagcuacucgggaggcugaggcaggagaauggugugaaccuggaaggcagagcuugcagugagccgagaucaugccacugcacuccggccugggcgacagagcgagacuccgucucaaaaaacaaaacgaaacauuaugaugaacaucuucaugaugaaucuuugacuuuuggcuuauuucuuuaggaauaauuucagaaggggaaaauacuagggaacauacuuuuuccuccaucuuuuuaagcaacagugcauuuccuagagagggaguuuaauuuacuguuuuuuuaaaacucaagcugaauuaaguuaguaauaacaguucuagcucccaugggaaaaaucuugaucuccuuuuuucuuuuuuuuuaaauuauuuuauuuuagagacagggucuugcucuguuauacaggcuggaguacaguggcgugaucauagcucacugcagccuugcacuucugggcuccagcaacuucugggcuccagcgauccuccccccucagccuucuaguagcuaggaccacaggugugccucaccaugcccaguuaauuuuaaaauuauuuuugguagagauggagucuugcuauguugcccaggcuagucuugaacuacuggccucaagcaaucauccugccucagccuuuugagcagcugagaccacaagugugcaccuucaugcccaguuaauuuuuaaauuauuuuugguagaaauggugucuugcuaugucgccuaggcuaaucuugaacuacuggucucaagcaauccuccugccucagccuuccauagugcugggauuacaggcaugagccacagugcccagccaaaauucuugcucuuuaagaugccauaacaguggaauaaucacugaagggcaggaaacaaugggcagugggagagagagucuccauauuuucggcuccaaugggaagugaguuagagagauuuguuccugcaugcucuuaaaauauuuuuauucauuaaaaaagugaucuuagggcugacgcagugguucacaccaguaaucccagcacuuugggaggccaaggcagguggaucacgaggucaagagauugagauugucuuggccaacaugugaaacccugucucuacuaaaaauacaaaaauuagccaggcgugguggugcaggccuguaaucacagcuacucaggagguuaaggcaggagaauugcuugaacucgaggggcggagguugcagugagccgagauugcgccacugcacuccagccuggugauggagcgagacuccaucuccaaaaaaaaaaaaaaaaaaaaaaaagagugaucuuagaauucuaagguauaugaguucauuuucagagaggaaguggacuucucaaguucagcaaguuuguacacuccagggcuucuuagaugucucucagaggucacugcugaagggucacaagcccauuugcauauucuccucaggaugccaauuuuaggugcacucagauccucucuggcuuaauguguguuugacgaccaagauggcccaggauauuacaaguaaaaauacaccccugggccgggcaugguggcucaugccugucaucccagcacuuuggccaaggcaggaggaucgcuugaguccaggaguucaagaccaggccuggcaacaucgugagacccccaacucuacaaauaauuaaaaaaauuagcugggaguggugguaugugccugugaucccggcuacuugggaggcugaggugggaggaucgcuugagccugagagguuagggcugaagugagcugugauccugcuacuguacucaagccugggcaacaaagcaagacccuguuucaaaaaaaauuaaaauaaacuccugcuuuaagcaaccuuuaugacagggauacacuuugugaauuuaaaguucugagaggauugggaaugaagacauuucugauuuucuacuccuauugaaaguucagauguucuguaacaaccuacugguauacuaucauaaaucaggauaaaauuaauuuauguaaaauuaauuuuacucauucaaagcccaucucuguuuagcacauuuagugaauguauuuauguuuuauuagucuuucuuauuagucuuuuuuuucuuuugagacagggucucacucuguugcccagccuggagugcaguggcacgaucauggcucacuauaagccuugacaucuugggcucaagugauccucccaucuuggccuccugaguagcugggacuacaggcaugugccaucacacccagcuaauuuuuguauuuuuuguagagaugggguuucgccauauuggccaggcuggucucaaauucuugagcucaagugauccgcccaccuuggccucccaaagugcugggauuacaggcgugagccacaguguccagccaaauguguuuauuuaguagggagaaaaaauaaucauuacacaugcaaacauaucucuuauucaugcaacagcauucuuguaaagaacgcaacaugccucaccaacauuauuacucuaacaccuugcucuaacacacccagcuggcaaguuguuuuccugauauucauggagagaaaugggguucaaagaaguuaugugacuugcuuaaaaaagccuauggggaauaaauaacaaaccaagaacaaucuauagacucuugcuagaacauucugucugcccaaauguuaaauggcagaggcuggguauccuuguccuuaccaguggguuugacgaggacugccaagaagucuguggugaaggagcugauguagaggagaaugcagggcgccuugguggugcugaagcugaagcggaucuccuccugugccagguccgggugggaguucugcuggucgggagcguugucuacucugcugcuggagucucuggcauuuguugcuggugccugaaaguuauaucguagccacaucccuucuucaaaaaaugcaccaacaucuguuauaaaggagagagagaauugaaaaaugaggagaggucugaugccgauacccuacaaugaccucuccagcaguucauggagugcaggcacuggcuccaggaagggcaucugaguaaguucuauggagaaagaugcuauugcaucaacacaaauacucuuaucaaaaaaaaaaaaagcauguaacaggguaugauguauuagucuguucccacgcugcuaauaaagacauaccagagacugggugauuuauaaagagaaagaaguuuaguggacucacagcuccauauggcuggggaggccucacaauaaugguggaaggcaaaggaggagcaaagucaugucuuacauggcggcaggcaagagagagcacaugugcaggggaacucccauuuauaaaaccaucagcucuugugagacuuauucauuaucauaagaacagcacaagaaagaccuccuccugugauuaaauuacuuccaaccaggucccuuccacaacaugaggggauuaugggaacuacaauuugaaauuaggguggggacagagccaaaccauaucauauagaaaucuauaaaauuaaaaaaauaguaaaauuuaagaaacuuacauuauaccagaaaaaaauuucacauaccaagaaaaaaauucacauacccugaaaaaaauuucauguacucagaccaaggaacgaauugucagguugaagagauaugccaaaaauaaaucccugguacagggaacccauaggggcauccucuuugagacugaauuugcuuggauauucauacaggaaagccuuuauaagcccuacguccuuagagacuuuguguauaggguuuacaaucacaugucuugaaguuagagagaacuggguucaaauuuggcucugccacuaaauagcugugugaccuuaggagaaguuacuuaacacauuuuucuaggccuugguauuucaucuaugaaguggagaguaauuaguacuccauaaauaguaucuauuuuuauuauuauugagaaauuagaagaaagaaacccuuccugcaucagccuuuuccuagagccugagcagugcuuacuggauauuaggcacuucauggccagcaagcuccuguugccggucucccugcuguuugcucagcaauguucuaaaucacuccgacucacugugaagggcugugccaccuuagggauccuguggucuucacgguuucuguuucacggccuucuacaagggccuugcugaaagcauuucccacacuccaucgcccaugcaaccguuaaucucacaacacuugacaucccacuaaauuaacacuaugcagaauauauugugcaaaacugcucuacguuauaauuaaugggagaggacaguuuuuaauaggagucuuccaacugggaauuuugauguuuguucuuguuaaagaggucggcacagagcagcgaaguccgacgccuggggguguaucuugcccuugucuguagcagccguguuaacuugggucaaugucuugaaacuuucucagccucaauuucgucccuaaaaaaugggaccucauaggugguugugaggauuaaguaaacuauauaauacacagcuuagugcccggaauauauaagugcucaggaaagauuagugaacuauuauuacaaagacagguuaccguuguauauugagggugacauguccuggcccccaccucacaucaccacacacaugugugaaaguugucagaaucaaaaugaagucacuaauguuaaaaaaaaaaaaaaaagaaagcccugagaaauggagcuggggaaggccaugaauaaaugccugaucaaaagaacuaucacagagacucugcaaaaagcacaacauugcccaaacaccauugcaaccuuacacaaaaaaacgguucuacaagaacaacugcccugaauuugccuguccaaacuuggacuggugucacccuuguuauugaucuuuguagccaaggauaauuauuuuaaaacaauuauguaauccuccuccuuuuuuccuuuaaaaacuuuugucuucaccucccugaauaugcauguaguuaacuauggcaugcauauucccauugcaaugcuuuauuuccagauaaauaucuuauauuucagagauccucuuucuguuaauuauguugacacauauaauccaccauggcacuguuacggaguccauugcuucucaccaaguuguaaggaaaagacuuaacuauagcuuuucaacuaugugcagugcaauuuuccuccugguccucuuacccccaaaacuuuuguaacuguguguguaggugggguaguugucaaaaugauugggauaccaaugaaauuuagugggcacgggcaaggacagcagcauguccugcaauguguggggcugucuuaugcaauuaagaauucuccugggcggggcgcgguggcucucgccuguaaucccagcacuuugguaggucgaggcuggcggaucacgaggccaggagacugagaccauucuggccaacacggugaaaccccgucucuacuaaaaauacaaaaauuagccaggcguggugguaggugccuguaguccuagcuacucgggaggcugaggcaggagaaucacuugaaccugggaggcggagguuguacugagccgagauccgccacugcauuccagccuggccgcagagagagacuccaucucaaaaauaaauaaauacauaaaaauaaaaaaagaauucuccugcuccacaugccaaaacuauccuucuuggaaaacauaggauugaacagcuacuuaauccaugcucauugcugccugacuuacugaagugugaagaugaacaaaauacaaucacuucccaugagaagauuuccaucuagcagugguugugggaggagacgcaucaacagugugaguacaauacagugaauguuauggcgguuuauuuagcagcuaugugaugagaaccccaucucacuaccuaaaugugcugaguuagcuuucagcaaacaucuauugagcacugacugcacccugggcacgaugcugggugcugacaacucuugcucugaaggagcuccggaccuggaggaggauucagguaaacagauuauuagaaugcagagggguaagugcaggaucagguagacacagggcccccuggaacacaggggugguggaagacuugcugugggaaaagacaucuaagcugggaccuggagggccagagguggguagccaaguacagguagguggcggagaugaagacuagcuuucuagcugaaggcacaguguauuggcagugagagggucugaagucugaggcaucaugccgccuggacaaacuucacgugcuucuuuuuaagaaucagucauucacuugagacccccgaggcucccaccacauuucagcuggguguuggggaucccgugagcaaggcacaggugaccccugcccucaguaguucagagucugauggggcagauggacacuccuaggacaggcuucuguaaaugugucuaacagaggacaggggagggaggaggagucaggaagggcaggcagggcgggccgccuggagaaaacacacugagcaguucaguuugccacagagagagguucugcuagagaauguggggggucauuaccugagaacaggcucuggcgggggugagaagagguggaccugggacuuggagggagggugggaggcaggcuagagauggaggcuggggcauucaaaugaaucacaguggggcaggcaggaugaugugcaagagaagacacgcauaccaggcgcuugaaauucaagacugaggagcacagaaccuggccuagggagggaagggucugggcagcagagaccccagcaccugagugacaggugcagcgugucaccggcaagaaccucagcuuccaccugucagccucucuccaguuacuccaucccgaagccagaacuggagucagagagcauguagagcugagacucucacaucauuucugugaccacuuuccugggagccuguuaaaaugcugguccccaggccuagucccagaauuuagcucagggguucuggagaagcagcauuuuucgcagguccccaggugauacuuaugcgcacaagggugugagaugcuuggggugaaagcugaggcaggguaguguaccugauggggcacgaagcugagugguccccgccugggugagacaugaugcguuuaucagcugcccuggagacagccauuccaaggcagaucaugaagggagauucagcaaucuagagauuucagauaaacaauccaaaaauaugccucagagacuacuuuggcuguauuuuagagacaucauuaaaagcuuuauggauuuaugucaguuuugcaggaagggauauaccauguucaaaaguguuauucugaaaccacaucauaaaccaacuguuaaagcaaagccugggagugauguaagcccucuaaggcuccaaguggcagauuuacagcugccauuucauuguuucacaucucuuuaagaaaaugccaaaucaggguacugcaauaucuaaaagauauucuaaaagaaagcaauucucucaucucuucugaaugaauaacugaaaauaacucuaaauuaacaagcccaaaauagcaucauuucccucguaaaauuaucaaaaaguauugauuuagaaugcuugguuuaagguuuuguacuaguaauauagauacuaguaauagacaauacuaacagauauagacaauauaauacuacuauagauaaugcuaauagucuaaguuuuauaaucauuuuugauagaaaaauaauaaauucuguauuuagauauucuaugauauaaaaaggauuugcuuaauuauaucauguuucucaaaguuuugaaauacauuaugccaucuguggacucagggucacaaaguugacaguuaaccuucaaguagacaaauaaccuugucuuaacuauuucuugguccucaucacagguuauauguaaauuaucccugauugaggaaaagaaguuugcagauguuugacauaaaauccaccaauuauucauuccagaauaauaacauaaagauauuuaucuccuuguuuaaccaaauccccgaggcuuacagugggagaaaaaaaaaaacccacaaaaaacagaaaccaaaagcaaacaacagcuggcacucacuccuauuauucaauugcucuucaucuuucucuucuccaaguuaaauaauucuauuccuuuugccuuuucacuuaggauuuugcaaccuauauuuugcaaccuauauuuuuaaaauuggcaugauucuuuuuguuuucuaacuuuccuaucaggacucagaauugaaagcucccaacuugcaaaugggcucuuuuccaaaaauuuauuuuagacucaguaacuugcaacuuggaaaacuuccccacagaaacaauguuuuaaaugauggugaguuugccaggagacuucacaaaugcugagccacucugguuguguaauaaaagauuacugaagagugccacuguauauuaguaauuaaaauaggaaagcaaaaccaaaacgccuucagguuuauucuuaagguaagaaccccagggaacucugcucccacagggauuucaacgaagugacccaaugguaaguugguagauguuaagcaacuggcuugagggggagggaaaaauucugauuuauaguuuuugccuauuucccaugaugucaauacugccaccuuguccgacuucaagcuaccaacaugaugucauuaaauaaggagcugagaagcgaggucucccagacugugcaagcugccucaugcacgugcucuauccacuccuucagucagcaagguagucgcucaagcaaaccacauuuauugagcucccauuguggugagcuucuuucuuuuuaccuucugcuguaaauaaacccuuuaauauuugcuuacuccuuucugucgcccaaugcgcucuccuaccucuucccagauauccuggauucuugaagcucugugcagcuucugcuaaagucuaggaggcucuccugggagccagaaccaugcuagaggaggcauagaacugagcugcagccucaggucauuaaccacuuucauggcugaauuccauugcccagaaugaucacucucauuaacugcuuuuuaauuagucaccuaguaaaagaguuaagugaauuuuauggaguucugcucccggggaccuuggacaucauccucugcaugcaucaugauucugcaucaggcaggccugguuccuuccaggcaaucugcauggcacaacucugcuuaaacuuguuuuguuauucucccaagauacugcaaugcugaaacacaaccaguuuuucuccuggucuuacauuggcaaaaucugcuuuuucuccccaaguguaccacucugaauuuccuugcugaauuuuuuauucuguuuguuugauguuuucuucaacuuacuguaaucuuuuuggacuaacaacauuggaccugggauggguuaacguucaccucugcuaguucuguuuccccagguggguccauaucuauuguaaccaauuuccugccauucucuccaaaggcccggucacuucuaggucaguuucuauguaauaagcuuuaagugucugaaucuguacaauggagaaaaaaugccaaagaaaaaucucuaaguuuauccugaguggcacguguggcccacaagacacaagugugaaguauauuacuguaaacacaucaaucagcuauggcuugacugugugggagccggguggccuucuuggauuggaauuuaagagcagcaccacugaacaacucuacuagggucuuaaacaggaagauaguuugcaucuauuauagaauuuccugggucaugcuccugaaacuguguuaauacguauuccuguugugcaugguggucaacagguuagaauguuuuggggacagcaaaugagaugagggcuucacuacagcuaacuucaucuaagacauauaauaaaggauuagugugggacauggggaggccaagaaucaaaagucguggauugcagcccuggcuuugccaccaacucgcuuuuugaccuuggccaggcaaaucauuucauugcugugggcuuuaaaucauucucaucuuaaaggccccccuacccugaaccucuauuuuccucuggcuagcacucagucuuuuuaauccauucuuucaaauauguaauaacugccaucugugaacuaugagcugacagagauuuagcaggucguaaauuacauuuaaguuaauaauugaaggccagugagauuuugcugguaacggggguagggaaaguauucuaggaagagaaaagagcaugugcaaaggcucugaggaagaagagaaugucgaggaugaacguaguggaggccaagaugacaaacccucaggggagaccauaguaggaagugaggcuagauagaaaggucgugguauucugaggauuuugguuuuuacacagaaagcaacggguaacuccugaaagguuuuaagcaaaggugacauaaucugauuucaguuuugaaagcucauucuggcugcauuuuggugaaugcauuggaaagagaaaagagggaauauagguagaccauugaauaggcuaugcaaugggacagaauaaauauaaugaugguuuggaguaguagaguggacagaaucugaugauguuuaggaauuaaaaaggugaaggaaagaguguuaagacagacucggauuuuuggauagaugguggugacaauuucugauuaugggaacacagaggcaggcaaucuuggugggguuggggauauggcagguaucaagaguucagcuuuggcugggugcuguggcucacacgguaaucccagcacuuuggaaggccaaggcaggagggucgcuugagcccuggaguuuaagacuggccuggacaacauagggggacccugucgcuaaaaaaaaaaaaaaaaaaggaagaaaagaaaaaaauagccggugugguggcacaagccuguagucccagcuacugaggcgggaggaucauuugagugcaggaggucggggcugcaaggacccaucauggcaccauugcacuccagcuggggcaacagagugagaugcuguuucaacaacaacaaaguucagcuuugaacaggucaaguuugaggugccuuugugucagggaagcauagaagucaaagagccaaaaaagucugggcugaaauauucauuuuaaaaucauuuuuaugaugguauuuacaaugcaagcauggauagaauucccugggagaagugugugaagagagaagacaggagggcccugagaagucacccuuuucaaacugggacagggaaaugagcuugcaaaggaagaacagagaggaaguaauuagggcaccccggggaccccuugaacacgaggucugaaugaggccaaggaaaaaggguuuuucaagaaagaggagcugaccaauagguuagaaugcuguucagagguccaguuagauuuucccaaucuaacuggggaaauucuagaaaccuucucaucuccucauuuucacuuccuaaucauugauuuuggccugaacuccauucacugaagugaaguugcugucacugagguguucaugaacuucguaguuaccaaagugaacagaccacuucugcccuuauuugauuuacucaacucuuggagccuuuggaaacucucuuugguuuuccuuuccccucuuucagcuucucuguaaggcauuggcucuuuuuccuccguguauccugaaaauguuggggcacugagguuuucccuccagugcuccucuuccaucacacucuauacucacucaucaggagagccucaucuccaucacucccaaccugcaacuuucuguagggaaacuccgccuuguucuuucaugggaaacccaaacucaagcuucacacaauggaauucauccuuucccacaaaucugauccucuccccgaauuuucuaguuugaccaaugacacugcaucugcauggucacucaaaggcagaaagccuagagacacccuaagcucucuguuugcauugccucguaaccuuuugcaucuguucucucuugggcacagcucugucaugccucugguucaggcacuuggguuucacuuuggcaccugugaugaccucuuuuuuuuuuuuuuuugacacggagucucgcucugucgcccaggcuggagcgcaguggcguaaucuuggcucacugcaagcuccgccucccggguucacgccauucuccugccucagccucucugaguagcugggacuacaggcccccgccaccacacccggcuaauuuuuuuuuguauuuuuaguagagacgggguuucaccguggucucgaucuccugaccucgugauccgcccgccucggccucccaaagugcugggauuacaagcgugagccaccacgcugugaugacuucuuaaaggguguccuccaaugggcaucuuaccuccuauaaucuguccuucacagacuuucagugacccgccuuacauccuagucuaaccauguccuucuuaaaccuaaaauauaucccucuucuuagaauguggcauaucauuuugggggaagugucacugaauacauuucagaaaaccuguaaaucuucugacauuuucgggaaaguaugugcaaauacauucuucugggaagaaaguuaguuucaauccggucccaugacuccccugccaaauguaaagaaaaagagcaaaaaagaauucacucauuauuucucuaaaaugcuugacugagaggcaucugugugccagcgcagugcgaggugcucacucugcuuccagagugacuaacgcucuugguccccuucaucgucuggacuggcucccuucuuggccucagcggccauucuccuucgcguacuccacguggcuccagccagccuaagaggcgggcuguucccauuucccucuccugcccgacuacuuagcuauuuauucacucuucgauucugcgugagcuccaucuccuuccgcaagugccgccugcacuguaagagugcacauccucaagugucccauagcuccuuguuauaacuuuauuccaacaaguauaaccuuguuugcauuuaauuuaguaaacauuucuuagacuccuacuauaugugaggcucaugcugaugacaaaagcaaacaugauauauacuuuucccaaacggaguuugcgguggguugggagacagagcaaacacagcauuacaacagugugggaaaccuguagaaggagaguguguagaaauaaauagcaggaggcgggaaggaugggaucuaccuguggguggggcgugggaugccuggaugguuucacuaaggaaggcgacaucugaguuggauccugacaaaauaauaggaaucuacaguacugaagagguggacaaggacccuccaaguacuggaaacagcaggcaccaaggcaugaggaaugcagcagcaugguguuugggaaacaggccuccaggcuucccaaccuaggcuauguuuuuggaaaaaaccauggcuggagcaaacucccaggaguccugaucugauugucuggggagaggccugccuauuggcauauuucagcauuuucucagauuagucuaaugugcagucagcgucaggaacgacagcgggaggauguuggacauaacuugguauuaaauguggggugauguacggcugcaggugcugcugaagaaaggcaggauugaggccaggaaggucuugaaucccuuauuuuaaaauuuuuuacaagaccaauauaccuugaaauaauuuugaaaaguuguaaaaauaguaugaauaacuccuauaucauccauaucuggauucccuaacuuuuaacauuucacuauauuuguuuucucucucauauuaaauauguuauauuuagauauaauacaaaugguagucaaaauuuaaauauaaauauuaaaaauuuaaauauauuuauauuuaacauuauauuauauauaauuaaaauaauuuuuaauguuacauaucuaguauauuaaauauauuauaauauauauuauauguaauuccugaaccaugugagagcaaguuggagucaggaaaccaacauuaauacaacaccauagucccauuucuauaaaaaaauauauauaugaacaugaauauuuguauacacacaaguaauuuugggaaacuacuuugaggguauauaugaauauuuauacauguguguguauaugccuauaugcauauauauauuuuuuucauguagaaagucuuuugcaaauaagcgugccuuaccaggaagagaagggaaggaacagaacagggauaaggagguuaaaggugaaugccuuauucaugcaccaggcuucucucuagacugugaguuucugaaaggaagaacugugucuaaucccagcuagccccuggccuccagcagauauucaauaaauguucauugaguugagccgaauggaauuaaaugauuuuuuaauugcaauaguauauucuucaacuaguuggaucacauuggccuuuccuuuagugaaaaauuucaggguucuuuugugugcguaugaagugggcuucuugaaagaaaugucauucaguugacugagaccucaucauuaauuaaaacagcaguuuauuaaugaaaauguuauaagaugcauuuagaauaauauauccaaaagaaugaaaggacuuacagcuuaacgaaugcucuuaauuucuacugcuuuuuuucuccuuuauacugguuuaguaaacugcaacauaguugugcagagguuggucaauuacucaagcagcuuucacaaaucagcuugucuccaauccagugacucugccucaguuugcuucugugcugcuaacuucacaguuugcugcgaggagacugcuuuuagaaauuauauuguuucuuuaacuacauauuuguagacuuacugaauuacaugauuugugccuguugcacacaccaggguguuuccacccuuucuguugauaggcagcaaguugcuucaucugagcucuguacuuagacugcauauuccuuauuuucucacgugcucagcugaucugccugagccauguagaauucuugacccuagugguucuugaggacaaacaccauuuuaauucgcgguuuuagucucagucuagugaaaagaggcacuugugaguuuguugauucagcgaggacucuuguggaugggagccagguacauauuuacacaccaugaagacaugagcuccuacugaguuccaauaggugccaaugggcacuuuuuaucucauuuaaccuaauuacucaacagcaacgcuuugagcagaugucaucaucccuauuuuacagaugagguaacugaggcuuacaggaguaguuuacucaaggacacccagcuaaucacagagucaagagucaaaugcaaaucugcugaacuucagagcccacacuccucccucugucuaggcgacgauugugcaaacucuagcuguuuucacagaaacccacaaagcgauuugcuuauuagcuccugcuuugggaauuaaaaacgaaaugagauaccaggaaccacugauuauuacucacaaacauaaaaacacaauggaaucuuugaauuaauaaaauuuuauuuuucucuaccaguaaagaucuuaauagaaaagaaaaaccaaaaaucuacaaaagcccuauuacuuuugauaaacuuuuguuaacaauagaaugauuuauauuuuaauuuuaaaaagccacauuucaaagucgaaguugaugacauucccauauguguucugaaauucaaagucauucccauuugcugauuauuguaaaagcaguacauaucuuuuguaauauuugcccugaccaaggaagguaaaugaacuauagauuauaacuuugguuuuccucguuaucucugcaacuacuuuauuucauauauuaauuaagccuugaaauuugucuaaauauuccaacucaucacugaaauguucuucaaucaacacaaaccguccucaagccuucugccuucuuuagagaacaugccacaucguaucggcagucuuaaagcagauagacuaucacagcugagucucacucaucaaauggaaguaacaggauucaaagaaauucucuagaguugcuuccuugaauggggcgcaaauacaggaagcauuagaagcuaaugggauucuacuucaagcaacucaagagcuugguuauuuccuacuaaaguuaucugaggccucacaggguuucuggacucuuagcagguaguucuuuacuaugccucuucaaaaaagauguuuacugaaugcuguuuaugaugguauaccgaguccaagagguggucaggcccaggagcacugggcuucuccacuaacccugcauauucuggcccugggcuucuuucuaguuuggcaaugaccccucuggcuuguuuugcacuuguuucuaugaaaaccagacuuagaaauucuuuuuuccuuuucuuuucuuucuuuuucuuuuuuuugagauguacucucgcugggccacccaggcuggaguacacgaccuuggcucacugcaaccucugccuaccggguucaagcgauucuugugcuucagccuccugagaagcugggauuacaggcucaggccaacaccuccagcuaauuuuuguauuuuuaguagagacagaauuucaccuuguuggccaggcuggucuggaacuccugaccucaggugauccacccaccucagccucccuaagugcugggauuacagaugugagccaccuugccuggcccacauucauuucucgaugaaauacauucaaaauauaauacuuccaaagaguuugucauacuaaacuggaauugguaguuuacaugugcagaugcuggagaacauaguuuccuugagggaaacacguuuuauuugacuuuuuauuucuggaguacaacccaacuccuagcacauaguagguaugcaauguacacuguuugaauuaaugaacaugaauuaaugguaucacagaccaauuuggccauauacauauuuuuuucauuuuauucccccaccucuccuccccaaaagaaaauccaagacaucuuagugauguauuucuaccauuagcuauaauuuuucaauagugguuucuuugaagaagauaaaauauaauuaaaaagcaaagauucaccucaaggaaaccaagaaguaauuggcuaacugcagguuuuggaaaauacaacugaaggauuaugauuuaucgagagauccugaaaaugagguugucaucaaaguuauuauacuuuaucugucuuuuggcagaagaaggaggaaaaaagaaaaaaugagaagagaaaggaaaaagaagaaaaagaauggauuuaggccacgcguuuguuguaugacuacacagagccuugaaugaaugauuggacuguauccccagcacagugagagccucuggucaucuucaugcacacacgauguguguaauuuaucuggggaaaugaacaucgugggggcauuugccagaucccccuuugucuucuacuucaguggaaacaauauuuucaagugaggagacagcuucaauuacaaagcugacaacuaaaauuuuacuuuaauauuuuuucccuguaucagcagcuuuuuccccuuuguagaugcuucaagcacaccccucuuuuugcaccacgucuguggcaaaagaauggauuuauucauuguugugugaaauaaauucaggcuucuaugaaauaaauuaaaaauacuugcaaaaggcuuucuauauggauggauggcuuucucugucuccguacacauaaaaucaaccucaaaugaguuucuggaaaaugcgugugugugauuuucagaaaguauggauguacacauguauguauguauuuuuuccccagaaauuauguauauguuuguauauacacacacauacuacuaucugaaacacucccaaaugguuuuccagaaagcaucuguugcuuagugaugugcgugccaagccugauuugcucacagguuugcucucugaccuguccuuugucacaaggggaacuguaaaaacaccuuccaguggcaggagagaggccauugaagggaggggccgugccacauaugaaauaccgcaacuccuugaaauaaaggauucugcaaaaggcucuaugcuauuuucagcacccaggccaauccuacaaagaaacagccuaaaaggcacaggcuucucaagggccccugcuucaggaagugagauugacucucuucccaacucauucauuugccucaucugcuuguaauacuguccuucacuaacaacaaccgugugcgucaauuuguuuacuauaauaucucccuguguauugccauuucuuuuguuccauagugugugaaaguuuuaaaguaaucacuucuuucuaaugucuuauuuuuuuuaauaguucaagguguaaugaaaugccugcaaauguuucccuguucuaauggugccuuugaguuuggaaauaauagugaccauggauggugauuuaaaaugcacgcugccugcccaucccugauuuuauucuaauuggagacccaaaggacggggcacaaaguuuaguugcauacaaaacuggcuucagcuucacugguuugucuccugagaauuagggaaaccaacuauuugagucuucccaugucuauaaaaaagggaaacuuuugaagacaaacugguuuaauaaauucagucacguuuuuuuacaaaguaaauguuugugcuuggcaaugggaagaaauaggauaaaaugguguaaaaacuaaauuauaaauuucaaggcuaaugagcugagcaauauuagaaaaauggugaugaggucacaggugaaaagacuuagguucaaacauaaagagcaagcuaaagcgaacucucacaaauaaaacaauuugauuagaguagcaagagcuucaagccuuuuauucaccucuucuuucucuugccuuccuagcaaagaucugcaugucuuucccuuuuagucaugauauuuagcgaaggcacguggcaaccacaauucugaccaccaaacacacccuuuccaaaugacauuuugcuucuguaauuauuuuuauucugagauuugaauauaaaucugacaugcugagaguuuguuucuaaucaaaugacagaaguauaaagaaaacucaagauucauuagggagaugaugaauuucugcaccucuguuggugcaaggacuugaggcauugcuucuuauguugaaucucaucaccugaauccaagauaacuccacauugucuuuaaauuucagcaccaauuacaaaggcucuaccauuuauggagcauuaaggacuauguuauuuagucucacaacaccaugggguacauauuauucaaauucuacaggcgagggaauggagauucagagaagguaaacaaccugccugcagucacacaucuaccaaguucuuacuauuaacuacuauguuguauugccuuucaaagccuucuauuuauaucuugccuacaagaaagaucuaaaaaagcaauuuagcauuuuucuuuaaaaaaauuacugcggagaaugguagcaucguagguguauuuugaagguuaucauagagggcuaugauuccuauguaagaggagucuuugaaaagcucuacaucaguccuguccaguagaaauauaaugugaaagccaggccugguggugcaugccuguaaucccugcuacucaggaggcuaggaagggaggauugcuugagcccaggaguucgaagcuccagugagccaugauugugccacugcacucuagccugggagacagaggucuuuaaaaaaaaaaaaagagagagaaagaaagaaaagaaguguaaugggacccacauuuguaauuuuaauucuuuuguagccacauuuaaaaaguaaaaaagugaaaugaauuuuaauaauauguuguauuuaauuuaguauaucuaauauuuuaucaacauguaaucuauguaaaaauuauugagacauuuuacauugugaugguuaauuucgugugucaauguggcuggccugagagaugcccacauggcugauaaaacaugauuucugagugugucuaugagggcauuccuggaggagauuagcaucucagucagucgacugaauagagaggaucauaauugucagugggcaucacccaauccauugagcaccuggaaagaauaaaaaggcagaagaaggggaauucacccucucuugugcugggacauccgucuucuucugcccucagauguuggugcuucuagcucuccagccuuuggacuccaggacucacaccaguugucccccugguucugaagccuuugggcucagacugaauuauaccaguggcuuuccugguucuccagcuugcagaugggauaugaugggacuucuuggccucuauaauaacaugagccaauuuccauuaagaaacccccucuuauguaucucucucuauccuacugguucaauuucuuuggagaaccuugacuaacacauaaaccuauuguuucaugcuaagucuuuaaaaucuacugaguguuuuaugcuuauagcacaaucucaauuugaacuagccccguuucaagugcccaaccuccacauguagcuugugguuacuguauagacaguacagcuauauagaguccaagaaaggaaaacuaaaagcauuugucaaugucaguugauuuuuccagccuuuggagacguguuuucgacaugggcauuggaaucauuuuaacaacaggaugucuacagucuaucucaaaccacuaaauuugaguuucuggguauuaccucuggauacaccuaagcaaagaaggacuugaaaccucacauucccaguucagcccucuuagaauaaaacaauauaagccugcuugaaaugugccuucuacauaucucuaucaggaaucuggggagauaauacguggaccauucugggauuuaggauucuagucacuucuuguuauuagacauuugaguagcagcuuggaaaaucauuuccuguuuucaguuuuucugcauuuuuagguuuauuuuaaggaugcaauggcaaaaggaauuaauuuagccagagugaucauuuuauaauauaugucauaucauguuacuccuuugcucaaaacccucuaugaacuccaccucccucugggcaaaagccaagcccuuaccauggccugccaugcccucccuaaucugcaccucuucuccccauuccacaccccauuguuucucucacccuauuuucuucucuucuuugcucauucuacuccauccccaaugaccucccuauguucucugagcacccacaugagacuaauuucuagauggggcccagguaucaauauuuuucaaaaguuguauccaccagggugagaaggaguuuucuacggcaaugcguggauuccauccuccuaaauauguuuucucucaguugagcuucgcagcuaugaauucaaggucauguuuuugaacuagcaccuugaauacaaauauccuaugaagcuuuaaccaacugcuaagacaaggacauaucugaaagggcgaccacuucugaaagggcacaucugaaaagauggcccagggaguaucuagaagaacacaguguccuccaaagcuuaugaugguggcuaccacuugcugggacacauacggucacaauccucauagcuguagagcagggauguaguuauuucagcaugggagauuuuacaggagcuguggaagacauuuacauagcuuaaccauuaggaaaaauccccaugaagcccccacagaaggagucccuuaaaagcacucaaggcaguuaagaaucuacauuagauacucgaugaguuaaagauugcacaggucacauggucacaaucgccaucaaccuuuaugaaacuucucacacauuucuuacuucuuggaucaugccccuuugccaaaccuaucaccucaaagacaaauugcuaugaauugcccaucccuaaccugaagcuucaaaagagaaagaacaggggcugugaucugcugccauggggggugguggcucuggguagcaggcagccuccuugcucgcuacaggcuugggucagucccuuuggaaccagccacccucaggcuucucagccugccugacaucguucccuucacauggaaguugggagucucacuuuccaguuccgccauguugagauucgcgcagggaaaagauacauggauuaaggcuccaguggcuccagauggaaauaaccuuuuagccuuuuuagagcuucaaggaaacucaaaggaugaccacacaaauggaacuugaagaacuaaucuguaugguguaggaugaggggaaccuuugacacaugacugauaggaagccuaguuuucaaugagcuuugaaggugagauguuuaagcugcuuuguugagcuccuccucuuuccauuaaauuugguuucaagaggcagcuggcuuuagcaacacgaugaugaucggcugauagaauucuaggagcugucagagggcucaagccugucaagauugcugaaaugcuuucuuuuaauucaauuuaauuuuucuuuguguaugugugggucauugguauaaucagaaaaauaaaucuuugcccugaauggacauguucugucauuggugguagcuuacacugaacuccaaugccuuauuucauacauugacucuguuguauugcucugaaaauguuaaaaagaacggguaaacacuugagcuuucguuuccgggauuuaaaggcauuauucuagggagaauuuuucuucuugggugaccuuuauuuugggguacugcugcaggcuuucuaaaagacuauuuuguuuuuaauauauaguuucaggauuacacaauauaucaagggucuugcuuugcauuuuuucacggaaucaucuauauguggauaaauaaucuaacaaguagggaauaauucuaggaaaacuggguucuaaucaagaaauuucugauaaauuucaaaauaaaagaucuaaauuauguaaaaacauauuuuucgucagggacacacauuucuagugcuaguacugaugaaugcuauuugaaguaaauuuauaguagguuguugauguaaaggaaugauuuuuuucccuuuguguguauuuuaugauguacauuaauucuguaauauauuuacaaaauguauaacugaauauauaaagguauauaaacuggcacucguguuuaacauuguuuuuuuuccuuuuagaaauuugcagccuaagagucagggaagcacugccuagcaagugaaagcacuuacuucuaggggcugcucccugaaucccucccuugagccuggacccuggugcaagcaguuagacuuuccuggaaggaucucaaugugccucuuugaauauugccagcucucacauuuucaguggcuguccacugcccugcugcccaaaagaggcucaucuucucccuggaacaguuacaagucagugguuaagggcacagguguuagagcaaaauugucuauguucaaauccuugcucugccaaagagaugggucacuuugagcaagcuacuuaauuuaucaaugccucaguuuucauguuaguaaaaugggucuauuaaaacuaucucccuuauuggauucuugugugaauaaaugaguuaauuaauacacuuagaaagugccgggagcuguuaucauugcuggaccccucuggucccagcuguaagccugccaguuacuauucugugccuaccagcuuccucuacugugugcugcaaacuccucugcucacucccugccccauucuagugaucagacgaguuccuggacccagauccccccaguuccuccgaauccugcugcagcgaacucuucuaucccugacuacacaaggaacuagaaaagucuaauagaugauugauuuauuucacuugggauuaaaagacaagcuauucaaacugcauuuucauggcauaguuucccaugcugagucuugacagucaaaaaaauuuuucagggaauuucuuuuuugauuguuccuugggaucaguaaucaauugauccugaaauugcucaacucuggggaaaauuaaucugacgugugugcaaaugggauauucuccuagaaacucuuuaaaaaugcuguuuguguuuuugcuuucaauuaguguuugcgaauagcaacccgguacaaugaucaaaaccaaacugauuagauuugacaggucaaauguugacuuggauauucuuuuuguaggcauuuauaaauucccacuaacauuuugcaggucaguagaaugcauuuguaaggaugcgugcucugaaugucugagcagacccauuuuuuuucuuuccacggucuuuauugugguucaauugcucaggaaauauuagugauuucucuaaaggggguugcuugggacaccaagaaaauacagaaauaaaaauggucuucaggugccugucucaauuuuauaaaagagucucaguuauaggauauauuaaauucugacuugaauuauuugacaaauaugacagcuuuggaguuauccuaucauuguguauuucaaacauuuuaaaaauauuuagaaaauacuuuuuaaaaagcaucaaagcauagguagaaaaagucuuugcgguauuucauugcccaaagacacaaacugaaaugagaucaauugugcuuaagugggaugcuugucuaguuuggaaagcuagcuauagcuuagguugugaauuuaauacuacagggaaggaauuuaaugcuacagagaaaggucaacuaagacuucugugaaaauaacuuucaccaauauuuuccuguuuucaaguugcuuucucauuuccuugucuuuucuuuuccuauuuuuuucagagauggaaaacucacaugaaaaauaaacaucuccaggaccaagaaauucaauuuaaaaguugguucuagaaaaugcucauucaucaaauacuuaccaaacaccuacuuuguagcacagacugugcuggagacugacaauacauaaugagaagacaucagcccuugcccagaaggaaugugcaaucagacagcgugacuuucaucacagaggguacaaauacaagaaagagaaaggaaagccaagccuauuucugacacccagaagagguagcacuugacccuauuauuguagggggaguugugagagauuucugacaaucauuuggguguugacugagugcugaucauauauaugcucagugaguauaugagacauggcuucugugaugguuaauaucaugugucaucuugacugggcuaagggugcccagauaacugguaaaacauaauuuuggggugugucugugaggguguugccauaaauuaguauucaauccaguaggcugaguauaguagaucugcccucaccaauaagggugggcaccauccaauccauugaggggccagauggaacaaaaaggugaaggaaggguaaguugucucuuuuuuuucuugagcugggacauccuucuucucaugcccugggacuccgcccaccccacuuccuucaguucuuaggccucucgucuuggacuggagguuacacacuggcucccuguucccaggccuucagacucagacugaauuacaccaugggcuuuccugggccuccagcucacagauggcauaucauagacugucuuggccuccauaauugcauaagucacuuccaauaauaaauucccucuuaucuauauuauacuuauccuacugguucuuuuucucuggggaaccuugacuaauaucgcuucugagcuuaaggaccugacaagauaauuggggaaagaaaacuaagacauauaagacaaauaugaauaagaaaagauaauuuguuacuaaauggcaaaugcuuuuauacauaggguagaucacucaaggcuggaggagucuuuaaagguacuugaaagaggccaggaguguugggucaugccuguaaucucaacacuuuggggaccaaagcagguggauugcuugaacccagaacuuugagaccagccugggccauauggugaaaccccgucucuacaaaaaaaaauauguacacacacacacacacacacacacacacuagccaggcaugguggcaugcaccuguaaucccagcugcuugagaggcugaggcaggaggaucaucugagcccaggaagucaaggcugcaguuggcccugauugcgccacugcacugcagccugggcgacagagcaagacccuguuucaguuaaaaaaaaaaaaaggcaguguuaagacaaagucuccagagaugaggauccucuugaacaagcagaaggaaacgggaaggauucuccacauggggagagugggaggagugagagccagugcugggaaugaacagcaguggacuaggaacaaugggaggcuccauggagcugggauggagaguguuugugaugaauuacaggaaaugaggcugggccuaccuaacuggagcagaagaugaacuaugacugauggccagagguaaggucagauaaggagugugggcuggaccauggaguguguggaauacccaagccagagaacagcauggcagaaagcaccauagaggaggaguuagaggcccugagcuuugguccagacucugccaccaccaauuacaggaaucuuuuuaggucccagaauccucaucagggccacauuaugacuuucaugggccccaggcacacuugcccuuguggucccuuucuuccacaaaaaaaaauuaugaaaauguguauuucaugacaauguuggccucaagagaaaauguauuaauguuaaauauuaaaauauuuucuuugaccccgaaguucauuuguauucuucugauuucuaaagaaauuuuaacauauaugugugggccccucaaaacguggguuguguccaccccaccuaauggcuagguuggccuuggcccuuaucuguggggaguggaguggagauggacucuaauaucuuuaccucccucuaaaagccuauaauuuaguaccuaaccucucaaucugugcaguauggucaggcugguauuuccaaaauccuauuauuugaucugaaaauaaccauguaggaaaaauauuugcaauaaaauaaaaauaauaaacuuguuuuugugauuuuagaauacuaggugaaaauccucuuaccucaaaaguauauucauuuugaggaaaaaaaucuucauuuuuuaaaaagagaacaaauaaguuaauuuuuaaaaagagaacaaguuuuuauuuguuaauuuuuaaaaagagaauagguuaauuuuuagaaagacacauguggcccuuauuaaaaauucaaacaccgccaaaaaaugcaaagaacuuucaaucauuucugcuacuuuuauaggaaaaaaauaaagucauauuucauaagaaagcaauaggaugaagaaacugaaauagagcuaaaggaauugcugaacuuugagugaaguuaagaaaacaugaauuaacugccuccucucucauucugaugcaaauuucaaaguaguuggcaugugucacguauccuuccuaauuugugguuuguggcaaugagcauugccauauuuuauuggagguuuuuuauuuuuugagacggaguuuugcucuuguagcccaggcuggagugcaauggcgugaucucggcucacugcauggagaguuuuuuuguuuuuuguuuuuuuuuuuggucauccauuucuuucuuuucguuaucaguuggcuuugagggaggggaaaaaauuacuuuauuauauuuuugcuugcguuuuucuguaaucauuuuaaugugguauuuaaguugaucaguuuuuaugaauguugugacauacauagucuaaggacuuuaaguuaaacaagucagaccgagacagacaaauacugcauauucucauuuauaagugcgagcuaaacaauggguccacauggacauagaguguggagacucagaaggguguagggguggaugacgagaguuuauuuaauguauuuuguuugagugauggagaccuuagaagcucugacuucaccacuauguaauccaugcaugcaacaaaauuacccuuguacgccauaaauuuacacauuuuuaagaaaggacucaagugcuucuguaagcccugaaacacauuaacggaagucuccacuccaccuccccacuucccacuccucagaagccaucuuauuuuuggcaucaacuucauauuucuaaguaacaagcuugcauuguucuugaucauauauguuguaaaacacuugcauuuacauuccagugcaaucuuuuguuucuucauuugccuuguuuucugcacacucaucacuaacucaucccuuaucucaccacuggaaggaaacagaaguaaacuguuuuauauuuuucuugacuguuauggaccagauguuuuugucucccaucaaaacucacauguugaaauccuaaccccuaacuugaugguaggaggaggugaggccuuggaaagugauuaagacaugaggguggagccccugugaauggguuuaguccccuuauaaaagagacccagagagcucucugaacucuccuucugccauaugaagaaacaacaguaagucagcagccugcaauccagaagagggcccucaccagcaccugaccaugcuggaacacugaucucagacugccagccucuagaaaugugagaaaucaauguuuguuuuggaagccacccagucuauggcaguaugcuauagcaaccugucccagucuauuuggcgcugcuaucacagaauacugcagauaauguauaaugaacagaaauauaugacuaugguucuggaagcuagcugggaagcucaagaucaagaggauggcaucuugugagagccuucuuguugaacaucccauggcagaaggacaaagagaagaggacacagagagagggagaagacagaggaaagaggagagggagagagagagagagagagcaagagugcacaaaaggggaccagacuuguucuuuuauaaggaauugacuccugcaauuacagcauuaauccauucaugaggguggaguccucacgaccuaaacaucucccauuaggccucaccucccaacacuucugcauugaagauuacauuucuagugcaugcuuuuugggggacacauucaauccuuagcacagcccaaagagacuaaagacaaagauaguccccauggagcucuucaucuuccuuguucagucuguacugguugcucucuaggucuggaaucuggaaucuucuuuuauuaucguccuaauaauuaggaguuacaaaaugauuugaaugcauguuuuuucuucuauuuuucuuuuuuugcucucucucucucucucucucucucucugucuuuccccuagggcugggacaucuccugcccuuggcaucagaacucuggguucuccaguauuuguacuacagaacuuguaccaguggccgcccggugucugagggcuccagccucccacugagagcuacaccaucggcuucccuaguucuguggccuuaagacuuggacugagccaugcugcuggcuucccugguucuccagguugcagacggccgauugugggacuucugccauaauugcaugugccaauuccccaaauaaaucuccuuucauauauagagauacagauauagguacauaucuccucuugauucugucgcucuaagagccuagacuaauacaaaggauuuagcaaaaacaaagauaauacuuggagaguaaguucuuuuggaaaaccaaaaaacuauuauucaucuucucuguuccaguccuuauugcuaccuaacagauugcuccccaaacuugcugguuuaaaacaacaacaauuauuucauuaucucuaaugguuucugugaaucagaaauuuggccucucucuaccuccuuaggucaucucaaagcuuuuucauguguccgauccacguaaccuagugcaguuccuugagcaugguggccucagggcaguugacugcuuuccugggcaaucaguacuccaaugugcauggcccaguccccaaggcacgugucaccuuggcucuauaaccuagcuuuggaagucaggcagcauaauuucugccacauucuguuggcuuaagcaagucccaaggcuguccagauucuuggagaggaaaacuagauaucacgucuugauggagcagucacuuggcucuggaagcacaggugucaggagagcuuuuguggcagccguccuuggaaaacacaaucuuccaaaucuucaagagauaaaagaagccccuccagacacuaaaucuugggucuucugccuuauuuggcucuggggcaguuacccagcugcaagagugaggagaagauugucuucauauagaaauuuuuagcugauccuuccguuuuuaagucuaucuuucugaggugccaggggcuacccauuucugagccuucuagugcaacagagacugcuauggcaguccgcuauagcagccugucucaguccauuuugugcugcuauaauagaauaccgcagauaauuuacaaugaacagaaaugucuuggcugugguucuggagacuggaaaguucaagaucgaggggaugucgucuugugagagcccucuuguuguaucaucccauggcagaagggcaaagagaagaggagccaugcccuugagcuucugccacccagaagagggcccucaccagagccugacccagaggguuccaccuucaugaaugaguuaaggcaguaauugcaggagucgguuccuuauaaaaggaacugcccuuuuauaauugccugcucuugagcuucucccucaaccagcuuagggguuggccucccuuugucuacuaaguguguuauuccuccauuugcuugccgucuuucuaaauguugcuguccucuccuguccucuuuguuuagauugacucuuaccuucaaaaaaauuuugaaauccuuuucuagggauuuuggaggaaguaaaggcaaauagguuaccauuuuagcuuauuaucuucauaaaaauaaaaaaaagaaaaacauugcugguaguguucagagaacaaggcauucucaguguauacugcauguacuuuggcacuguguuuagaaaaucuuacuagcuuuguacgugaaaagccuaagcauuuuacauccucuaacucuaccucuccauaucuggcaauccauccucaauaaauaauguaaaauauugaaaugccacuugcaaaaaucauuuacugcaguauuauuuacaauaaaaaaauuggaaacaauuuuaagaacagaaauugaaauugccauuucccuauugugaaauauuuagguuaaauaaauuuugguaaacccacuggguggaauaauaugaagcaguauuuuuaagugauggguaugaagaccaagugguuucaagggaaugaaaugcuauauaugcuaauacuauguacauaaugauaguacgguacauacauuauaauaauauaaauugauuuuaggaacucagaauacauuuuccaauaguacaaaauucuaacauggaucaauaacuaaagauuauuuaguagugaaaccaaauuauagcacuaaugccauuagcuuggauucuggaucuuaguagaagagaaacugccagaggggagagaaagacaguuuccucucuuuuugccagugcagaccugcuggcuuuaggcaagaucagcaaagaaaggaguaucuuucuuccuuccagucuguuacuaacaggcuucagcucucuguuuucauggaagucaucuuaacuaucuccucaaagcuuguccaaugucuuccccacuccuaaauuacaccuggcuccucccuucaaacucaaugcuccuucuucaggacagcucuucuggguaaggacuuggccauuucaauuccguccacauugagguauuaaagagaugguauuaccauccucccagacccacuccuacugauucaaaugaugcuguaauagaauagaauggccuaauagaacaauaggucacaggacagaaagggaacaagucaggaauuucaaaggaaaucauuuugggugaagaguggcuggucuccaagcacauuccuuaaacuauuccuacucucccacgauuuuuuccaucuaaacucauggguucucuaaaaguuuaauuuaaaaaaaucagugauucccugcugcaaugguaguggguggcuuugugugugugugugugcaugugugugcacgcauguaugcggggauggugggguggugguguggucugugauggguagggggugaaguuggggcagggcagcuuuuuauucauaugguugauuuuuauuaaaaagaggggacugcucaagcauacucuuguaugcuugcaagcuauguucugauuugugaauuccuuuacucaugccuagaggauaaauauuuuauuugugucauaauuuuuacauuauccuuuggcuagaggaaaaaaagcucauguugggaucagaguauggccauguaguguaaugcaguagcuugagcggccggaagcucauaguuguacacugaauuccucuuuguaacaacugugcaauaaaagcaaggaaacagcuggagcugaccaauugcauccacccuccuagcuccucauagaaauagaugucgaguuuuaaaaaauuguuuccauguuuuguuuggauuuuagaauuuccaucaucagaagcucguuuuacguagcgcagucuccagacuggaacagagaaauugccauccuucagcaaccaucaaucaguaauucaaagcaugaauuucaucaauaagaaaacuuacagggcauggccuguguuuacccugcaaaucagcuucuuuguaauaaggcaaucuaaaguggucucucaugucagaagaauuuauuuggucacaucccuuguuuuauuccucuccucauauauucagaaagagaagucucugcuauuaacacaaaagcauggauacgguguguggguggcacccuaagaaacacaaagaauuaucuuguuaucuaagacuuauuguuagaaaccgacagguccagcucacaccuggcucuguuuguguguguguguguguguguguguguguguguguguguauguuuccuugcucaaccgcacagagagggccucagaaagaacggcaaagaaagaagggaaacuucuucagaacuuuuaggacuuaggccugcccugagucaucagggugauaagauagaaagaggacacacagggcaagcuguguuaucugguauccaaggaucucauuaauuuaccauucuacauuggacaacaagcaaggccaauaucuuucaaggccuccuggggcauugggagaauagccauagcaaauuggaccacugaccgugugucagcauauuaguuuuaagggccauugagacuuugguaaaggaaacagaagaguaaggaaugaaucagcuauuaaauaccccuuuugugucaaacuuaggccaggugcucuuccuuaucuccacagaguuggggauuuugaaggugcauagguguuucugaguucuuacaggcacaggaauuugaacccagagccagacacccacuguuucuucauggagacauucuccaucuuuaauagagaugaugguucaggaugagggaaaucuuuccaguugucugaaaugcucaaauaggaagagggcugccucauguggucccgggcucuccaugaacacaacuuggaucugauccagugaguguguuauaaagaggacaucauucuaguguauaugguggaaaaaacacuaggcuuggagucagggaccuaggauuccaaucucaaucugccauuuacuagcaaugugauuuuggaugauaaacuuaaccucuagaagucucuguuucuucauuuuguaaauaaaggugaucauaucaaugccugaauguuguugugaugauuaaauaagguaaacuaugugaacacacuuaguucagugccuggcauaacaggaaauguuuaauaaaauaucaguugaauaugaaugaaugaaauaguccuuucaaccacgacauacuuugauuuugugacaaaaggggccuccugaacuuuuaaccaucuauaguaauagaagaaguguuggaauaaguaacccaaugacauuugaauguuagcgcaaaagcugaaagucugaguaaucauaaauucauuauaguaacagaaauaaaagucuuuuggaauaguccuugauauuuuaaaagaaguuauuaaguguuugucauaaccucaggugguuuaugauucaggagguuguuguaugaggccacagaagauaacauuuuaacuuaguuaauagaggagagggauuauaaacuuguuucaauuuauaacuugaucuacugcuuuaauuugacuuacaugacuuaauuuauauuuuuaacugaauuuacaagauuccuuuauaagagacauuuguuaaggaaauauaaaagucaacaggcuaaaauagaccuauuuaaaagggauuuaaaucaaauuacuucaauaguaaagcuuuagaaagcauuuuacuuauagcuuuauucaucucugaaaacuaaaaagugacuagcaauggacuuguucaaauauuuggguuacauuuggcuuagaccugagaaaaaucuggacucauucaucugaacaggaguuaucauccuugguaacggggcagaggaugcagagagacugucaaucacuugggauaagaggaaaauuuuagauguacuuucuacaauguagcaguugcuuuuuauuucuugaaacucuauaagauacucaaggaaccaacaugauuugcuaacgaucucaauaacaaccucaagaggauguuuuagaauccauucuuauuuaaucucaaguguguuugcugcuuuaaugauguuccaggccaaaugacucaugccaauuccaugacagagacaggaauuuaaucagggccaugcauucaaggguuggcugacuaugaauacaguacugccugucaugaacuaguauaacucugaggucuaaagucuugcuggauuguugugagcacggagcuucuggauaacgcauuucagugcuguacagagagacgggcgagcacuaaugucaacaauugagagggaaaaguuuugcuguugguuauggcaacacuaacaacacagauagaaaaguucugucuaggauuuccuagcagcucuugaaagauaaugguuuacauuuugcaggauucucacuaaagaggcuuucagugacucaaugauuaauaaacuuaauaauaauuugcauuuuauaacauuaaugcuuuucaaagcacuuucacauccaucagcucauuugauccucacagccuugugaauaaugaauuuuauauaauuagugcaauuuauaaagaaacagaaugccuaguuaggauuguucacuuugguuuuuaauaauguugaaauuggaauucaaguuacucuuguuccacuguucuauauaauauaagauucccucuuuaauugggauaaacucaaaaaguacaaauuuccccuuucuuuaaacaaaauuaguuuagaauaguguugucuguguuucuggucauaaauccaggauggaaagaaauagaagaugugaaaggacauuuuggugccuuugaggauugcugagaaaugauucacauaagggcuagaauuugguauuucucuguaagcuauacuugacccaacucccuagggagaagcacagaaagugagauuggcuacuggcacagguaaaucauaagucauuuguacuagucuaaaguaagcaaauuugcauuaguuaaggucuaaacuucagaauacuaaaauaaaauuuaguaauguuaaaguugauaaaagcaaguuuuuagaagaccucuuuuaacaaaaagcaaagauaaacuuauuuacaugucaauuuauuuuuagauauuuauuuuuuuuauagagauggggucucacuguguaacccaagcuggucucaaacucuugggcucaagcaauccugccucagccucccaaaaugcuggaauuaacaggcaugagccaccgugccugguuuacauaucaauuuguugaucuaucuuugaaguuguaucuuuaaaguuaucuuuaaggcagaaauacucaaggggaagguguccacuagguucauauaaaauuaucuggaggugggaguaagggaaaaaacugcaaggagacguguauuuugagaaaaucauauuaauuauuagaauaacuuuuugaaaaauggaaaaaauucccuacuguuuucauauuagaaauuaaagaaggcaaagccucaugaaauauuuuuggcugguggaauauaauuugaaaaauaguuaagcuaaucuaacuccuaaaauauuuuguccacuauuaaugucuaaagcaauucaauuuuguaauauuaaaagcaaauaaguaggcugggcaugguggcucaugacuguaaucccagcucuuugggaggcugaggugggagcauacccugaugccaggaguuugagaccagccugggcaacacagugagacccuguuucuacaaaaaauuaaaaacuuagcaggguaugguagcacaugccuauagucccagcuacucugggggccaaggugggaggaucacuugagcccaggaggucgaggaugcagugagccaucauugcaccacugcgcuccagcuagggcaacaaagcucaaagccugucucaaaaaaaaaaaaaaaaaaaaaaagcaaauaaguauuucuuguaaauaucaauuguauuauuucaaagacaauuuuaaaaaaauugagaugcuuuaaaacuuuugucuuuagacuuuaggcuuuaaugauauauguuuuccaaagagucuucucccuuaacccaaauuacgcccucagaauuaggugcaacccaccacuaucugccaugcuguccuuggacaagacuuugaaucaggcagcccucccaguagaaccuucagcguggguauccaugggggucucucacucggccuucuggcuuguuucccugcaugcugcaguugguucuauccccuccauugcauucccagccuagucuuauucauccuguccuuccuugcuggcaauccacugcuucccccacagcaggcucucuguacauguucccguauuucacuaaacuugugcucaguguauaggaaggaauaaaauuauuauuaaugaucaaacugcuugaaauuacuucguucacacagaauguagaauguuaaauuguacugccaauaauuuaauuuaauugagagucuuugccuuauagaacuugaauacuguaaaagccaccuuauauuuaguaaacauaucccuuggaagaguagcuagaaaguauuguuagucaaguuaaacauuucacuauauccugugcccaguccucuugagaaaaugaagguaauacauuuaaaaugccaagaaaaggauggcucagagagagcagcuggcucuucauaauuuguuuucucaggauuugguuuuaaacagaaaaauauaaaaugccuauuuaucuaaaucaaacacucuuguaaccaguuggaauuaauagagguaaaaauaugugagugaguucaaagccagguugaucuauaaaauggguaggcuauagcauuauagucucaggcuugauuauuuaagaaaguaaauuuccuguagccaaggaaugccuggaaugagcccaguugcuaaggccagagcugccuguuggaaaugauaagcgcgcaaaugguuguggagugaagaaauugcaugucagaggcaggucuucauggcccauagacgugauggaguacucaagggcagcguggacguuggugaauggaccugcuugcagggcagccaaacaugugagcaaucuaaaagcaaaacccucaggacaauuuaucagaccaguuccuuuuuggcucacaaaagaaaagaaaagaaauguauagaguuucagcucaagucauggagcuaauaugugggaaaagauaaagaguguuauuucugugaacuucacauuauuuagaguucugaucauugcugaagaacaggaaauaaaaacacucaacaacauauacaaauaaaacacucaggaaaaaaaauucagcuguguccccacacugguggggauuagaaaagggcacacacuuggccaggcgcgguggcucacgccuguaaucccagcacuuugggaggcugaggcgggcggaucacgaggucaggagaucgagaccauccuggccaacauggugaaaccccgucucuacuaaaaauacaaaaauuuagccuggugugguggcaggcgccuguagucccagcuacucgggaggcugaggcaggagaauggcgugaacccgggaguuggagcuugcagugagccgaguuugugccacugaacuccagccugggugacagugcgagacuccgucucaaaaaaaaaaaaaaaaaaaaaaaaaaaaaaaaaagggcacacacuugaaacaaaaguuauuuauccuacaaccaaagccaaauccgaacacuuuguccuguauuagauuuagaacaguuuacggaggacuugcuuuuucugcacugaauuuuuaaaucucuuucucuaagaaaguuaauuggccagguuuucucaaauaucugggaccccaaagagaaccucaggcuagggggaauguuauuuuaccaccacaaaauucuauaacaaagccacuuaaacuuggcagcuaucucugcagcuuugacuuuucugaauuaagucaaaauuauuuucuuuuuccauacauauuuguggacuucuguccacuuauggauuuucauccauaaauauuuucugacuuuuuggcucuuccuucucucuuuauuuuuuaagcuuuuaaucagauuauuuucaugcguuaugguauuaggguucucucuagagggacauaaucaacagacuauauagauauagacauacgagaggggauuucuuaggggaauuggcucauguaauuguggaggcugagaagucccaugauacguccucuacaugguggagacccugggguaccagugguguggcuccguccaaguccaaaggccucagaacaaaagaagccaaugguguaacucuuagcccaagcucaaaagcaugagaaucugguauaaguucuggagcccaaaggcuagggagccuggaguugccccaaaacaguauaucucaucucuaguagauagauagacacuaccaccuuuucucuguuuuuguucucugcagccccuagcagacaggauaaugccuucccacauugaggguagcucuuccccaccucauccacucagacccacaugcuaauguucucuggaaacagccucacagacccaccucaaaguaaugcuuuacagauuucuagguguaggggcuaaagcaccuccuucuuggaugcuaaugcaccaugcuggcuucugaauaacccaguugcagaaugccacuaaguuuuccaccuuaucuacuguuuacugcaaauucugcucuaggguaacuugcuucugaagcauguagacccuuucucuaugguauauaggcccugggucugaggagguaaaggaauccaccaucucaucuuguagauaccagagacgcaacuucuguugguaagucccuauucaauuuguuuuuuuuuucuucugagaaacuggcuuugucagacuguuucuuuggccucucagcucccuuggccuuuggagguaggcuugcauagaccugcucccuauggaacaccagucaaguugacacuuaaaauuaaccaucacaguuaccaugauacuuuuaaauugcauccuaaggucugaagauuuaagaaauacauuaagagagaagggauauuuucucuacuugaauaauucucuaagaagaaaagaaaaaaaaaggguucuauucuuguuccuuugggccuucuuccaaaucugucaaaccuccuguuccaacugaaaaugaaaaagaagccugugaaaaguuucucucccuacugaugugaaagugucuuccaagcugggauuauuaagacuggauagguagaccugaggaaaaauggccauugucacuaacagcuuagcugauuucacauaggggugaaauucuaagaugcauacuuccaacauuucucuucuuuuucucccuauuuguuuauauauuuuguauuaauuaauuuucucuccaaccugcucuaaaaggguagaccaugcauuuauucuggucccuguuucauacugagagcuguggaacagaauuuguucagucuuccaaccgcuuuuggcaaacccacuaccucacauccaacaagaaauguuucucuaggaggcaaguggaaaacccucucuuccuuagagguauaacguggacuugagccugaggucucuuggagcaaaaaggagucugggaccuuucuuuucuuuucuucucuuucucugcuucucucucucuccuuccuuccuucucuccuccuccuucuuucucucccucuuucuccucccuuuucuuucuuucccuuucuuucucuucucucucuuguucucucucuuucucacucuuucucucuuucucuccuuccuuccuuccuucccuccuucccucccucccucucucucccccgcaccccgccucucucccucucucucccucucucccucucucacucccucucucucccucucucccucugucuuucuuuccucagucuugcucuguugcccaggcuaaagugcaguggcacaaucucggcugauugaagccuugaccuccugagcucaagcaauccucccaucucagccucccaaguagcugggacugcagguaugugccaccacaccuggcuaauuuugucuuucuguagagacaaguucucacuauguugcccaggcuggucuugaacuccugggcucacaugaucuucccaccuuggccucucagagugcugggauucaggugugagccagugugccuggcuaaucagcgcuuucuugucuccugaugggccuugagucaggaagggaugcaggaguuacuaaggugacccaacuugguucuugaaaggacuggauacauugcuccaagacuugcgcuauugacaaaaccaguccgauauggugggugugguuuccaguugcaucuuccagaaucucugcauacuucucagcccuucagggcuucagaauacuuuuacugugaccaaaauuaaguagaaaugacauuuuaggacacugccacugcuccugaaguaccgaaaugacaauccaauacucaaggaucaccgaaauaaugccaguuaggcauuugacauuuaaagcuauuagggaaggauuaaaggacaacaugaauuaaguaaaaacaaaaacacaaaccaaaaagcaaagagcugcuaagaaugaaaaggacauuugcuguuggacugcugugugccagguccuucauguggaaauucauucacauuauucugugugauuuucaagguauccuuaagagguaguuacuauguauuccugaagauaaggcucagugacaaacaauuuuccuaagguuacguaacagguaugugagaaagauggauucaaacugacaucuaauuccaucaucaucuuauagguugagacuugaauuugcuauaaacaauuucuucuaccaucuuaauaauacagauuauaaaauauuagcuaacuucacaauacucauagggagaauaggagacuuagcuggaacacagggaggguggcacauuauuugugugacuguaaaugauggaaacacugcaaugauugaaugacuauucaaaucuuggucacucaguaauccugugacuuuuauucuucaaguuuuuucuaagcaauaaacaaaugaauguuugagaagaaaacagaacucccuaacucagaaaaugguuucagagugauuaaagaaauguauuuuucaacugcaguccugguuuggcauaugaacaugaacauuuuuauaguuaaaaaaagugcagaugagugaauuuggagauaucuuugugucucuugaugauaaguucuugcuuaacuuggcuuggugaaaggaucauaaugaagaacuguuuucagcagccugggugauauccaauucacauguauuccuaucauauauucuagacuugccugauuuuguaucuguaaaccauuaaaaugcuuuggaaauuucaguguagucagauucaacuauacauucaagacuucugggcacauuagguguucaaugaauguuugcucaauaagagucaauaaaugaauaaaccuuacaccuagauguagcaaaaaaaaaaaaacagugucuguucaauucuuguauccuauuuuuuaugauaaacucugcauccaguaauauucuaauuucuuuuuacucaaucacaauaaucaaaaagcuuuaagacuagaggcuaugcuuuuaguugcuacaaaaugaaaggaaagggagucuugccucuuacuaauaugugaaccuuggggcaggcuacuacaaccaucuccuucuugguacaauaggagcacuaguaauagcaaucauuucaccagguuguggugaggauuaaacgaugcuaacacaauuagaaagcuuagcacacugccuagcagacaaguucucaauaaauaccagcugcuauccuuguuaagagcaagaauuaagaagaugguagguuuuucuucgaacuuguauuauuuuccuaggaagccagaagucugaaagcaagguguucucagggcuacgcuucuucgaaaacucuagggaagaaucuuuccuucacucuucuagccucugguagccucaggaauuccuuggcuuggggcaguguaacuccgaucucugccuccgucuucacauggcuuuccuucuaugucugucaguaccucugugcccccuccucuuccuaugaagacacagucauuggauuuagggccaaccuccuaguaugaccucaacuuaccauaaucacaucugcaaggacccuacuuccaaacaacguuguauucugaaguccuagguggacaugaauuuugggggacacuauucaaucuacuauggcauucaaccacgaaaaguaaacacagaaauugcugccucuacuauagguauguuauuuucucucuugcuuaaacacacagagaagacacacagagaguguacugcaaauuaugucucuaauuucugguuaguaauaaaagugacauugauaauuauagaauucuugaguguuuugggaucugacucuccaagaaggagcaguuuuaauguuagaaaacuaucuuuggcaugaccaagcaacuauccauucgguccccaauaauccuggggaugacagacccacaguuaaaccuuccauguagucugggaugauucuccccucagccucagccgauggggugccaaggaauucugcauuggaagggaccuaccuccacugaguuaaacugcuccucauugaugaacgugcugagaagaugggaugcugcucaguuaucugccgacagaugaggagacugccugcauggucuaguuguaggguuuccacaacgcccuugugcuaucuccaaaccaugaaauauuccccagucagcacuccuacuaaagauucaaguagcccugggagagcuaacacuuuaacugguggucaaaucuuuaggcaucucuuugaaaaagggcucugggcugggugugguggcucaugccuguaaucccagcacuuugggaggcugaggcaggcagaucaccugaggucaggaguucgagacuagccuggccaacauguugaaaccgucuguacuaaaaauaaaaaauuagcuggauguggugaugggugccuguaaucccagcuacucgggaggcugaggcagaagaaucacuugaaccuaggaggcagagguugcagugagccaagauugugccacugcacuccagucugggcgacaagagagaaacuccaucucaaaaaaaaaaaaaaaaaaaaaaaaaaagagaaagaaagaaaagaaaaaaggguuuuggauaagagguuagaggaaguccccuucuugugugguuuugacuagugcggaauagugaguaucagugcaucaucuacaaagcagaagagaugaucaugaggaaccuacucaaauccagcccugucuuccuaguucaacaaagugacaagacacgguaauuucacuuacauauucaacuauacacuccagcaaaagaaagggagagagggaaaguagguauggaauauggagagacagagacagagacagggauugauguagaaauaaagauugugcuuauggugaacggagaaggaaggaggaagagaagggaagaagaggaggaugauaaggaggauggggaggagggggagaaggagaggagggaaaaacagaauucaaacaguaugggcugucugcccaccauucuccuggaugggcuaauaauauacaggggugagacuuagcuuaucugucccccugggcuauuuuaugaccugggcuauuuugggucccaagccuguccuagugugagccucucacauagcugagugugauacuagugucuugaggucuuuauuuucaugcaaccugaccccaacaaggcagcccuuccuccgaugcccaucugaagggugaucucuucagcugcuuguggaaaaugaguucugcuaaauguauugagauuuaacaaaugcauuguuaaauguauugagauucucagggacaauauaauuacauaaaauuuucaccugaccaugcuucuccauuccagaaaguacaacuagaugguccaauaauaucuaauaaauagcuagauauuuuaugaccagagauaguuaucccucaaaugucugggguaagaacuuggcuuccuacuauuauuuuuccaaagaagaaaaaauaaugauguuagaggaaauacaucauugugcaaagacuggaaaauguagcuaagcaaaaacaaaauaagaaacaugcacauguauguuuauugcagcacuauuuacacagcaaagacuuagaaccaucccaaaugcccaucaaugauagacuggauaaagaaaauguggcacauauacaacauggaauacuaugcagcuguaaaaagaaugaguucaugucuuuugcagggucauggaugaagcuacaggccaucauucucagcaaacuaacacaggaacagaaaaccaaacaccacauguucucacucauaauugguagcugaacagugagaacacauggccacagggaggggaacaucacacacaggggucuguugggggguuggcggcaaggggagagagagcauuaggacaaauaccuaauguauauggggcuuaaaaccuagaugacggguugauaggugcggcaaaccccauggcacacguaugcuuauguaacaaaccugcauguucugcacauguaucgcagaacuuaaagcaaaauaaaauaagaaaaaauacuaguauuuuuauccuccugcaaaaaauaaccacaguuaauauuuuggcguguauucucacaguuuguuugccucaucucugcguguaugcauguuuuauuuuguauaaacacguaguccggcugugugugguagguugggccuugcuucauucacuuggcaaaauauuagcgauguuuuccacaucugcaagcauagaccuauacucccaaaggaaggccagagaaggccuugcauggagcucauucuucggccaaugccaaagcucuuuguagaggcugagcuguuuggcugaagcaccagccugagguggggggcggucacaggaacugcugugcaggcaccaggcuaccuggagagugagguccagagcagagacagcaucaggcugggagauccuuccagucccugauggagcuugccucagugcagacaaagcuuuccuggacagcugugggauuccucugaaacaguuccacugucauucuaccaagucaaggagguacuugacucagaaggaugcucauaaaugauuuccaaauauguuuugcagucuucuauuuaaauuuuuugguuaaagucacuaauugaaucaaaugaaaacucauucugcuaaacagauaauaaggaaauauuuagaugucuuuuguguaaacauguugaaauaaugucagaggcaacacacaggcgucauuucacuuuaucugcaauguggccuaaccuggagaggauaugccccugccuuucuauucaugacuauugccuauuaaucuccagagguuuugcgugagcuacuguguuuaaccuaacucuccaaaaauaaagggauggugauuuucuuuaaacugguacuuauguaguggaaucucgcaggcauuagugcuuacuugauugcauucagacauuacuuuggcaaggaaaugacugcauuaaauuagcaucaagcacaaugaaugguaauugcaagacugucauuucuacaagugcaaaauuaauguguucugcaggcccauucaauugugugccgcaggaaaaucauggaaccauguuguucugaacagaaaaaugcacuguaauagcacuguuaaugugcuuugguauuauucugcaaugguguuccuuuccaccuuuguuguugucucaugcucauuuuucauacccugucuggccuaauuuguaugcucauauuauagcgcugccaaacaguagccuggagguacagagaauguuauggaacaauuccuccuucuguguguggcaucuugugugaauaaugccaguguaaacaacccuccauguauucaucagagucugaacaggcuacuuauguaaagcuucuuauuaagagaugcaccaaccgcucacagaaaacuuuacccauaugcuauacauucauuuagaaagagaggagugauuuacaugcauuucaauuguggcuuaggaaaagcaccagcuccuccucucuucaucccucauuuauauaugggaaauuaagccacagaccaguugagucaauuucuucuucuggucaagcaggaucacaggguauaguucaaaugauaacaugcauaugcauugggcucuuguacucugcucauuggcucugcggaaucuacuggggauuaaaggaauuauucaagacuaaaauaaccaaguaauaacagaugcucuaagcugaccaauuaaaugugguuuuucagcauuucugcaguuuagcuuaggcugagagccacucaaaggcauccugaguaagaguaauaauaaugauguuaaugacugaccagaggagcuuucuggugaguguagcuugaauccagucucuuagcaacugcagggggugggggcaucaagaccacuggggugcacuggcugauucacuacagaaauugacugaucaauugaucuauuggagauccuaacgugggagggucaggccugauuccccuuuugaaggccaccuauuuuaucacucaccauuaagauguaaugagacugccuuuguaguguuucgggcagugaauaauuugcuagaaucuggaagaaauucugcaccauacacagagcuucucucauuuuaucaaacaaaaaugauuaggaaaugauuuugguuggaaaauuccuaccuaaguugagagaaaaauucugaucaucuuaaccucagaauaagguacacuuguuuacauaugaaaaaucauuaaauagaugauuugggcuuaaaaagacacgcaaaaguggcucuggaaauggguuccaccuuaccuuuguugcaaaauguuccaucauaugcaguauuagagcaaucgcaggaguaaccgugguaucucucuaggcauuugccuccauuuucacaguuuguuccauagcuggugcaauggcccgagcauccggauaugaacccagaugugaccuuugcucuuuccuccaggucaagugucaccccauucauccucaaggagcggaugcagcccaggaagcccugcuggcccccagcaccaccugggaaugacagaaggcacagaguucagagggaauaaccucugcuauugcuuaauucuucauauuuugaacaacugugguaggagaugacacugcauagcacaucuaguauugucacuaucaaguugguccuaucuaaauagagaaaguugaagcuuuucucccugcaggcuauaaggccuaauuaaaagagccaucuucugagaagcaacacguuuccuacagaaauaaaauauuuggagaugcacaaaaauuauaucagcuguuuuggaagucuaaucugguuuccuauagaaaaagcguuuacagaaaucucuagauucuuugcucuuuaaucucacaacaucgaguucuguagcauuacuuauugaaaaaauauaaaggcagagacaugaauguauuagcauaguuaacaagucaauuaguuggaagacauaaauccguuugaaaugugauuguagaucuugguucuugucucaagagaggcuuugcuuuuaaguucaugucaagacuacccaaggcuccuugucugggguagcuggaagcuggaacugauaacuuuacacagaaaucagcuauaccacauuuauugcuagguuagaucagauuucauugcuuuugucuaaaugucauuacacgacauauagcacaauaagcacguucacugugauuuuuggaguaaguuauagaguuggacugagguucaugagcaugaaaauauuaaaauauucccaagaaauuucacagaaagauucauugaggcauucuaucacaaauggauuuaauugugucuauaguauucuuagcuauaaucuuuuuaaagcagcugguauaaaaggacgaacucaaauuuauauacaugcuugcaucuuagaguaacaacuuuucuggaaacuaaucuaaaaugaauaguagguaaaacuguugaaagaaauaggugaugagcauuuagaaaagaaaauacuguuaauaaaaauaaaacccaaguuucuccuucauugagggcuacauacuaggcacucuauauacaguaccuuauauaugcuacucaccugguccucacaacaacuuaucaaaguagauauuauuugcauuauucccauuguacagauggagaaacugaggcuuggagaaguuaagaaguuuacucaaggacucauaguuccugaguggcaacuguaucagaucugucuuauuccuaaggcaacaaacaggguuuauugucuuaagcccuguucuguguagaccacuuaauaccgagaagaacuuuccagucaggggucucauagauguacauguuucugagauguagauuuggaggucuuuaaacauggaguagucaguaggguuacuggaauucagguaagaucaguaggcuggggauugauucugaucacuuacucuauuaucuuaagaaaagucauaaacuccaguagauuggucagacaggacuggaauaucaaaggcuuuaguggcagagaugaauuagcaucugcuuaugccugcaaaaccccaucagugaaguggcaaaugaguugcuguaccaucucugcaaacccaagccuugcaguucucucacugggugacucauugguuuuaaucaugacucccuugggaguauuugauuucuucuaacauauuggaauagagaagugaagagaguccagugccuuuuuugaucaaagcuaugagagaguagauggcaaaagaaguuauuaaaaacaacuacuuugaaggauuucccauucugccaucuguuugucaacugggcuucacaccucuacgcugaagagaaugagggccuuugccugauuuggaagaacuucaacccucuaguuacaccuuguguguuagaauuucaauuuggcuucuauuauuuuagccauuauggcuuuuguccuugcaauaagggcuuuccaaaagacauuuuauuaaauaaaugucuggccuuaaaaauuuuuuaucacuagucaauuaagacaauuauauucuaucaaaauaugcuaaaauguagaaaucauuuuuagaucuccccaucucuuucugccuggugaucaauguaauagucauuguggucacuauaaacauacugagaagcagaauacaaaacagauucuguuacgcuacucagauuuaacuacuuucacuuuuagggaacagccuuuuucauuuuucuaugaacauacuauguguaaauaaaaaggaagaaauggaaucauaauauacacauuguuuugaaacuugcuuuuugcacuuaacauaucaugaaacuuuuuuuuuuugaggcggauuuucacucuauuguuuaggcuggagugcaguggcaugaucucagcucacugcaaccuccgccucccggguucaagcaauucucuugccucagccuccccaguagcugggacuacaggcacacgccaccacacccagcuaauuuuuguauuuuuaguagagaugggguuucaccauguuaaccaggcuggucucgaacuccugaccucgugaucugccugccuuggccucccaaagugcugggauuacaggugugagccaccgugcccagccuuugcaacauuuuccaagcaauaaauguacaacgagaacaucuugcuuaguaucugcauagcauccuauucugugaaugcacuaucacuuauuucgcucuugcaccaccaguggacuuuuaaguuuuuaaaauuuuccauuuuauaugauacuauaauaauauaaucuuuaugaaaaccuuugcacacuugucguccaguuuuuccuuagaauucauucuuuaaaauuaguuaaucauacuuuuaagucuaauugcuaggaugaagggcauauacauuuuaaaggcacuuuaaauauguuuucuucuaagaagaauuuaccaacuucuaauucaccaguaggguaugagauuuucaucuucuccacacaauucuaauauuggucagugccuuuuuguauucaugccagucugcucgacgggggcaaaaaggauucacuguuuaaaucugcaucaccucaaauacugugagcugaguaauuuuaauguuuucccuuuucuuauuuuuuguuucuuuguguucuucgcuuuuugcugggaauacaagagaauauauuucuuauugauuaauaacaauaugagcuuuaacucuugguuauaaauaacucuuuauugcagcuguaucuuuccaguuugugucuuuugacuucucuaugguguuucuuuuucccgaugaaaguuuugcauguuuuuguagucacauccaccugucuuauuugugugauuccugccuuuggucagaggcuuauaaagaccuucuacaauacaaaauaauaugauuauucaaccauauuuucuucuaacauguuugugauuuugcuucucuccacauguuaaccuuuugucuaucugggauguauuuuaauuuggaaacaauugguauuucauggaucuucagcaaugauugagaguuugaaaagacucugaauguuaacaugaugaagaauggagauauuuuucuuuuuuuaaauuauacuuuaaguuuuaggguacaugugcacaacgugcagguuaguuacauauguauacaugugccuuguuggugugcugcacccauuaacuugucauuuaacauuagguauaucuccuaaugcuaucccuccccccuccccccaccccacaacaggccccggugugugauguuccccuuccuguguccauguguucucauuguucaauucccaccuaugagugagaacaugcgguguuugguuuuucguccuugcaacaguuugcugagaaugaugguuuccagcuucauccaugucccuagaaaggacaggaaaucaucauuuuuuauggcugcguaguauuccaugguguauaugugccacauuuucuuaauccagucuaucauuguuggacauuuggcuugguuccaagucuuugcuauugugaauagugcugcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugagaauggagauauuuuucaaagggucaauuggcagagcaaauaaaucuagaguaaaucauauuuuuauuauaucauuaaggcagauauuuagaucuauucauggauacuuaauuauuuauauauacaggguucauuucagaaaggauuuaguggggcggaguuuucucccucugcuucugucuugauucuugggucuuuggacuucuuagguucuacauggauccaucucucuuccugcacuuguguuuguggaucuuuccuucucaggaucaucaacuauuucuacucaguuguguggcuuucaucaaauuacauagucucucucagcgucgguuuccccauccacagauaaaggaggcugaacuagauggugucugugacuccuuccagcucugaauuacucuggcucacgguucacaggcucucccucugggccugugucuuuuuuucugaauuucaguaaacacucucaaauucuauuaaaucucuuccuugcuugcuuuuucuuucuuugcaccgaugucugacuuuuuuuuuucucccucuuuuaacuggguguaacauaugacuguagucuaguuuguauuuguuguguucauuaaguaaaguuuugcucacuccuguaaucccagcacuuugggaggccaaggcgggcagaucaucugaggucaggaguuugagaccagccuggccagcauggugaaaucccuucucuacugaaaauacaaaauuagccaggcgugguggcaugcaccuguaaucccagcugcuugggaggcugaggcagaagaauggcaugaaccugggaggcagagguugcagugagccgagaucaugccauugcacuccagccugggcaaaaaagaaagaaacucugucucuaaauaaauaaauaaauaaaaaguuuuguccucccucuucauaauuuauaaagcaggugagugaaaugccauuucucgcucuauaaaggaaaacuaaauaaauuaggcucuuuucuugcuuagguagucccugauuuauuuaaaugggacagugagcuagaagguacuuuuccugaucuagucaauaugaagaaaaaucuucuguccugaaaacggucauuauauauuauguaaaagacauuaaugcacuagaaucagugaaaauuauuugaguuccacuucugcgcucuguagaaaucuuucuuggugacaaacgucauaaguuuaaauuauaggucuucaagcaaaaacgcuacuuaaccuuuguuaauuagaaaaucaacacauugucauuguagagagcccccugccaugcaagggcuucacgcacauuagucagaccugugauaauuauccaaggugagauguggguuuaauuuguaaaucauuuuuucuugugaaaugcuuugcaaguauugcaauuaaagauuaauuaugaaaaugcuggaacuacccauaaugaauaauacaacuguaaaaugcacagaagacugggacaaaauaaucggcuauuaaauuaaacaaaaagggcaaaaacaaugaucaagaggaauuauaaaaaaaaaaacacuguccucaaauucagaacuuaauaaagagcuaaguuggguuccugaguacuuuugcccaaagagacuggccacuaauucaccauagaaggaaucacacuaaagcccacacacauaaaaucuaauuuauucauucaaaaaauauuuauuucacgccuacuaugagccaggccuuguuuuagauguuuuguuugucugcuucauaguauugaagcaaaacacacaaaagucucuguucuuguagagcuuauauucuugcaggcagaaagagaaauuuaacaacaaacucaauaagaaaauaaaauauacuguguguuagaaggugguagccacuauggagaaaaaagucaagcaggguuagcugggauccagaguuggaguggggugggggaggcugcaauuucaaguagggugguuaggauaggccccacugaggaagugacagaaaggggaucaugagcucguccauggagagagggcuucaggaaaaagguaaggggguaccauccugcaaguaggggaggccuguuggaagggaaggaggcaugagaugagagcgguugcaggaugcucagaagagcaaagcuguugcaugaucaguucaugagugaaaggcgucaggaaagccauuuguaaaaugaugaugaggacgugcuucuugccugcagguuaaucccaaggugaucacaaauagcugcacgaugaugccaggcacaauuugauguaugggaggcagcaagcagggaugaagaaagcaugaacuguggucacaaagaucuacuucuauguguuggcuucgccgcucauggcaugugagcuucccagguccuauuugggccucagucuccuuauguguggcauuggcauaacaauaugcaccgcguaggaguguguuaauaacagauaaugcacuucuuugcacuaauucuaguuacugguagcuguuacgauuauugcuauuauugaguauaggcacauucuauagaagcacauaguuggaauaaauuaaauauggcugagaugauguguauauaaaucugauacuagagguaucaggagugcuauggacugaacuguguccccucaaaauuugucuguugaaucccuaaccuccaaugugacugcauuugaagaugggaccuuuaaagaaguacuuaacauuaaaugaggccauaaaggugagaccuaauccaauagaacugguguucuuguaagaagagggacagacacuggggaugcucuugcacagagaaaagaucaagugaagacacggcaagaagacagcagucugaaaaccaagaagagaagccucagaagaaagcaacccuacggacacacugaucuuggacuuccagcuuuuagaacugugagaauguuuauuguuuaagccaccagacuaugguauucuguuagggcagcccaagcagaccaagacaaugaggaaggguuaucaggcucgggcugaucuagaccucccugagaaagugaccuuggggucccucuucucacugcacuguuuccauggaaaguacagaguuagagccagguaugguggcucaugccuguaaucccaccaguuugggagaccgaggcagguggaucaccugaggucaggaguuugagaccagccuggccaacauggugaaacccugucuguacuaaaaaaaaaauaaaaaauaaaaaauaaaaaaauacaaaaauuagccagaugugguggcaucugccuguagucccagcuacucaggaggcugaggcaggagaaugacuugaacccaggagguggagcuugcaaugagccaagacugugccccugcacuccagccugggugacagagugaaacuccgucucaaaaaaaaaaaaaaaaaaaaaaaaaaagagagagaaaagaaagcacagaguuaggaugggugucguugcuaucuuaucauucguggagggcugugucuggacuggagagcugugaauuagcauagaggucuugagcccgccacuggaauggugugagugacuggugggaaaaagagcuaggacuccucugugucuaggugacccacccugaccuuggcucucuggcauggcagccacagcugcccuggcuaggucagggggcaaaagcagcuauguguuugggcaggcugggccuucccaaguugcaauucuguaccugcuauuucuccuguucuauaugcuaccauuguuucuuaggucugaagcaucaacuugaacccguuaaaaaaaaaccuguggugggcugggugugguggcuuaugccuacaaucccagcacuuugggaggccgaggcaggcagacagaucacugaggucaggaguucgagaccagccuggccaacauggugaaaccccauuucuacuaaaaauacaaaaauuagccaggugugguggugcccaccuguaaucccagcuuguugggaggcuguggcaggagaaucacuugaaccugggaggcagaggcuacagugagccgagauugugccacggcacuccagccugggcaacagaacaagacugugucucaaaaaaacaaaacaaaacaaaacaaaauaccuguggugucagugcagguguguaaaauauaaacccaguuaucugguugaacugagaacagcagaauggccaagagucuucagugguguagagaguuaaaggaaauugcuccauauucuuuagugcagagcugcaugauugacaaguauugaucaguaguuucucugucagcuagauauuggagggcaaguaugaaaaaagcuuucacauacugagagaacugggguuuggaaaauugcuuuuucagaugacacucaugagugcucauucauaacuccaucaauaggauggauuuuuuucaguucauuauuauugcauggauuuucuuguguccucagaguaaaggacaugcagaacaugugaauccaaacuauuaaacuagaagaaagcuucaaaauagagacugaagggacacuggguuuccauaguauaaagcacuccuauguguccaaaugugaaauguuaugcaauggggguggagcuaaguggucugauucauuguagaggcuaugguggcaggauaagcaugguaaacuauugguuauuucaaaagcuaauauuaauuaaauacuagaaguaucaggcacuauuccagaacuuuacucucagagcuagauauuauuaucuccauuuuacagacgagugaacugagaauaagagaguuaauucauuugcugucauauagccaguaaguagccagaacucacacccaggcuggauagcuuuuaagccugcacucuuacuaugcucuggccaccguuugauuuuugggcuuacaucauauaaggcacuuucuucuccuacgucugauaugcuucuagacauuguuguacuuagguauacaaaaugcugauagagugauuaauaccugaggcaagacauuuaccaccugccagaacauugucuuauauuuauuuauuuuuuuuggcacaguuuugcucuuuggcucaggccgagugcagugacgcaaucaugguucacugcagccuugaccuccugagcucaagcaauccuccugucucagccuccugaguagcugggguuacaggcacaugucaccaugccugguuaauuaaaaaaauuuuuuuuuguagagacaaggucuugcuauguugcucaggcugaucuugaacuacuggauggaagggcuccuccugccuuggccuccaaaaguguuaggaucacaggugugagccccugcaccugggcagaccauugucucuaaagcuacaaggauggcugaagcugaaaggggaaaugcaauacucacagagccaggaaugucaauguccaaauuaaucucuaagccaacaaagagaagacacuuuuuugaugcugucauuaagaucauauuuauuucuuagugcaaaagcucaguacuacaguuuugaaaccaaggcaguuaugggcuuuggccacugcuaaaaugguggaugauggauacuuucccuaagcucagucugacagcacugauuucagaagccauugcuuuacugugggaccuacaguuccaaguugcaucugaaaguggggauauuuucuaguuggauccaaauuucaaaauuauuaacagcuauuuuaguaaacuuuaauaaacccagaugucaaauauaucagccuagaacucuugucuaaauacauuuuugcaaauaucuuuagguuauuguucauauuaaguguccugcuggugaguuuugucaucuuugaaguaaaauaagcauccucuuucugcugaucuucauguaucucccccucccccucuccugcuuccaucugucuuuuaaagucucuauuuaaacauuuguaucuagucuuuuuuuaaauccggagucaagaaucccugguguuauuauccaagcuggcacccuguucucuucacucucagacuucacauacaagccuuugcggaugcuagucccaggucaagccugggauggauccgugagggauuaguguagcucugaugaccaagccucauggguaugucagccauccaagcaaagggguggaggaaaaagaagagaagcuuggggauugaggaaaagggaaaagggaggcgaguuggcagagaggcugagaaaacagaagacuggaguguuuugaugucaagauuucaaggagggcacagugacaauuguuaaauaagagcaagaagucaaggaaaaucagacaacaguaacaggcuauuggauuugguuauuuuugagacagacacuucaauauagcaauaagaugcuuauuaguggaggaacggguagugagaggcuagauuuagugguauagauacaccacugguuuaagaaucaaugacaguggaagauggcuguccccugucuaggugggagugagguacucugaaguuguguguguguaugggaggugggugagggacauggacuggaaacaagaaaggguugagagggaugacaaugccagagguuuguccugaggcaggaguuuuucuuugcccccucaacuuuccaggaggagcucaaugcaggcccugaacuuuuguuuuucauuguaggaagacaauaacaaagguggcauuuggaaaucucaagggaauaugcuugaacucagaaggcgaaaugacaggaccucugaggacagcaagcacugcgaaauaagggcaagaagcagcgcugaagacacagaaccaaugacagcagaaaacuguaggauuugcauaaaagacaccugcguuauggugccgacaugaagcggcagcaaaauuagcagaaucccaccuuccugauauuggagacacaggacaaugacaaacuauaagaauaagaauuaguuggagauauugaagugaaaaaucuauaacugucaaaauaaagauauccuuggaggggcugaauggcagaacggauaaagcugaugaacauuuucguggguugggauauugggucaagaaaccuuccaugaagacaauaggaaugaauaaagagauuagaagaauaaaacaaaagucaagaauuacggaggguagaagugucaacaucugcacaauaguagcuucauaagaaaagaauaaacacaggcaagaaacuaucugaagaaauaucugguauuuccagaacaaacaauauuagaguucaaauggaaggcacucaugaaguguuuaaacaggguagguaagaaaaacaacaacaaccaccaccaaaaccaaaaaacaacaccuucaucaauagcuguggaucugaaccagagacccccagccccagggauccuuccgauccauguacaggagucacaagucuugagaacauagauggaaaaaauauugcaucuuuauuuucacugccaagucaaaauuauaggaguaauugguccaaauggauuuuuaaaagguucagcaauaugaaaucuaagaggaacauuuaaacaaaaggauacaaacaccuguacaaaaaauaccagguuauaacaggaauauuagcaacaacaagaaggcuagcauaguaguuuguucauuuauuaucuuuuuucuuuuuuuuuuuuuuagaguuagggucucgcucuguccccaggcuguaguacaguagugugaucacggcucacugcagcuaugaccuccuggguucaagccauccuucugccucagcuccaggguagcugagacuauaggcgcacaucauuaugccuggcuaguguagucauuuucucuuucuuuugagacagggucuuacucuguuacccaggcuggaaugcagugacacaauuacggcucacugcagccuagaccuccugggcucaggcgauccucucaccucagcuucccaaguagcugauauuacaggugugugccaccacauccagccaauuuuuguauuuuuugguagagaugggguuucaccauguugcccgggcugguccugaacuccugggcacaagagauuugccuaccucagccuuccaaagugcugggauuacaggcgugagccaccgcgcccagcagugugguaguuuuaagagcagagacaaaacugugagauuuaaaaaaaaaugucauaaggaacaaagauggaaauuauauacugguacaaggaacaauaaaucaagaagaucaugaacacaucuaacuagcaaaauagacuucaauuacccgaagcuaccacugauagaacuauugauagaaauucaguaaauaaaguuuaaaauuuauacucagaaacugauaggucaagcagugcuuagugaaauuagguacacacauacucuaugacucaguaauucuggggacacacagaggcacacacacacacaagacguccucacacagguggcagagaaugcacauaaauauauucccuggaggguuauucgugguggcagaguugcagaaaaccuagguauucaucauuaggggauagaauaaaugaugcgugguaaauacacauaauggagcacuaugcacauaguauucagagaacuacucaaauagaucuuaacaauguaaggcagagggaagagaguaagaaacagaaugggaucuguaguacaaugccacccauauaaagcauggcacacaagagacaacacgaauuuccacaaugauauguauacuuugaacaaauauauagagggugggacuagaagaccauccauaaaauacguuucagugggugucggcgauggcgagagggugaagcuggcaauggugaagaaaaaacguaauaaaaugaaauuaaaaugaaagaggaacauugucaggaugugacaauaggaccaugaaaggaagagagacccacgcaauauccugcacaucagggggccuugaaaacacgaaggagcagaaaccaaacugugagauaaaaacaugagagggaagcgucugaugggaaacgacccuguuuaucugaaugcggaauacuaaaagugggccucuuuuuucucacgcucauaguguacugugggaggaacuauggggcugcgaggaucuaucccuucuucaauauuugugucauugauacuaauuuauuuuauuacaaucuuuuucugugggacaguugccauuuauuaucaugaaguuuaguucaguccuuaucggaaagauaaaaaaucuguauaagaaauuauuuauuuguugaaaaacauuuuuccauauugauugcaaaagugguaccguuacauuaaaaugucuucucugcaucagaccauuccaauugccaugaggauguuggaagaaagaccagaguuccugaagcauuuggucuugugacacaugagaaggugaaccuuuaguuucuuagguucagaauguucaccguaaaguuucuacccauauaauauaguuaacagauuaucuuuuaguuaguugggagcucaaaagacauuaaaaguacacuguugauuugauuauuugggagcacauuuuaaaaaaagcaaaaauuguccaggcuugguggcucaugccucuaauccuagcaccuugggaagcugaggccagcggaucaugagcucgagagaucgaggccauccuggccaacauggugaaauccuaucucuacuaaaaauacaaaaauuagcuggguguggugacgugugccuguagucccagcuaccugggaggccaaggcaggagaauugcuugaacccgggaggcggagguugcagugagccgagauugugccacugcacuucagccugguaacagagggagacucugucucaaaaaaaaaaaaaaaaaaagcgcaaacauuguaccuaucaucacucacuuccuaugguaaugcucugacugaaagguagcuggaauugcaaaagucaauuaguuuugaucccuaaagggcaaagggcagaaaacauacauggcaacuguaagugggaaggggcuauccuuugcccuuugugggggucguagguggagaugguucuauugagaagauagcagccgacugagcgugguggcccagcagguucagaaaagaauagagggcugguaacccuuguagugaacaacugugaaggagaaggcauuucuuggaggagcuucuauauuuuauuugcauuuuugcuuugcauauggucgauugauuucaauguaguaauuuuuuuugcuagauuuuguccagcaaauuaauuuacucuuuaauguauggcaaugguuucuaauuacgacaucacucccuauuucuaucccagagagaaccaagaacuaguuacaaagguugggguagaaacucugcauuaggauugcagccagcaucacagcuaccgccaaacaggcaagaccccaauuugauaucaggaagacugaaaacuaugcucaggcucuagacugauuugaaaugcugucuuccauaauaugcugacuuucucugugacuuuuuuuuuuuuuuugcugcuucugcuucugucaugcuugauuucagucugugguucccaguaaaaagauauuucccaagaugguaaauaucaucacauuuugagaaaagaauucuggagaaaguuuauaaggaaaaacccuucuugcuuuggaaaggagaugaucuaauuuugaauauggauauuaacccagaaaaaucacaaucacuuauuuauucauccagauguuugcucagcaaauauuuauuggguaaccauugaccaguuguuauuggacccuauccuccgucuaugcuguauguagcuuacguucuagggggaggacacauaaauaaacguauucauuuauuucugaauaauaauaauuuucugggguuucaacacccucuagagguuucccauugguuacuugguauaugcccuauguaaaugaagaagacgaagucaagugacaaagucauuuacucaguaugcacccuauguaaauggcaaggauguuacucaguguguggcauaaguaaauggagaggaugaagugaagcuacacagccguucaccuuccugucauugcugaagcguucccauuugauuuaguuccaagaagucagcaugaaucugccuaucuucccugccuccagacccuauucuccugccucagcugcauuugagggacagucuggagguagacucacagggcuuacuauuggauaggaagugaugagggaaagagaagaaagaaagggaagaaggaaaucaaggguaacuccaaauuuaggguggauggguggauuagauggugaugccaccuacugagauggggagggcuuuuggaggaacaaauuuccaggaggcaucaagaguuguuucccaucauguuuauucuaagaugcccauuuaauaucuaaguugaaacacaaaguagaaaguaggauaaguggaucuagaguuccugagagaagagaggccuggagauuuaaauuugagagacauuggcacaaauuauuaucagaagccauuggauggugggcugaaugagaucauccaagacaauauucggaugagaagacaggaaggcucugugacacugcaaugcuuaguggucaagcggaggaaggagggaaugcaggagagacuaagugauggccagcuugguaggaaaaauaagcaggacagcacacggcuguggaaucugugggaagaaaguauuucaggaaagagcgcaggagacaugcugcugagagagucugcaaagccccgaagaaugugucugagacuuagagauccaugcugacuuugacgacuuuauaaaagcuuuaccaaaggaacucaaaacaaaacaaaacaaaaacaaaacauuauuuccaugucauagagacugucaaguaagaagucucauucccugagaagagugcuuuugcauuaacuucucguuaaaccaaacccuuugcguuugacaguggcccucugcaggccuagaucuuugccauggcgacuuuauaaucugcauaauaccagccagggcugccugauguccagccucaccacugccugucaacuucagucucucccauagacuccauaacugggagagugcuccacaaggggccgguauugcacguggggccugcaaaucuuccuugggauggauucuccugcacguugugggaagcugugggagcacccagugucaccgcaccuuuccacauacccucugggccacagggucaucucagucaggggacgcugguauagacugaccaagagggccugaacuuugccuucagcuugacuaaacuuuacauaggaccccuccauuccacccuagaccccugaccucacuuuuuaagagcacuuacuuuagaaaauuuguuauuguuaauucuuucucugcccuuuugagauauaaauuuuuuaaaaagcuguuugccaguuuuacaacccaggaauggcuuuuucaaaaacuugggagucaucucuuugaaaugguaauugucaaggaaaauagcacccugucuccccuccacgggagggugggagccuaacuccaaguugugaaaguuuacuuuuccuuuggguagagccaaucagcaaacacagacacccuaugaucccuccuaucccagcuuguaaaaacuuucccauuguauuuuagugaaauaaaaaaaaccaaaaaaucaaaauaaagaaacaaaauucuccugcccuuagcugaaguggaggcgagcucgacugcauucuggcuucucuacccugucgcaacagcccugaaugaagaucuuccuugccuguucaacuuugcccagugcaauuuuugcuuugacaagaggaaugauuaaagcgcugagucuuuggagucagacugucuggaaccaaaucccaucucugucucuuccuaaaugcacgaccuucgguaagucaacuaaucuuuaaugugagaauaaaacaagaauuagcaauguuaucuauguuauagacucguguggacucauugaggggaagcaugggaagcacuuggcccugggguucaccggggugucucagucagcauucacgugguugcuuuugaggcagguuugcaggaaacaggggcaggcacacauucucuagguuauaauuccugcaauuugagauguacauuuuuuuuuuuuuugagauguggucucacucugucacccaggcuggaguguaguggcacaaucuuggcucacugugaccucugcccacuggguucaagcuauucuccugccucagcuucccaaguagcugggauuacaggcacccaccagcaugccugaguaauuuuuguaucuuuaguaaagacagaaauucaccauguuggucagacuggucucgaacuccugaccucagaugaucugcccgccuuagcauuccaaagugcugaaauuacaggcgugagccaccaugcccggccugaguuguacaucuuuuauuaucaauuucuuagauaugagaaacagccauuuuauucauacauagauuugggugaauuucauuauuagaauucuauuuuucuccuucacacacaaaugcgauuuucucuuuggucucucaaugauacugcauuucagauggcacuggaaugauccauuugcaauuuuggaauacagagaguaugagaagcagcugaccaaacaagcuguauuuuagaauuuggggagguuggacucagagaaugguuauaacauuucagucuguaguugcuuauacguccauuuaauaaaccucaacucuuccauaaacucagguugccacccaggagaaaaaagucuccugauagacaaacugucagaggaagaagaggcugcgggcuuccccacucucagguagucucugaguccuccugaagacagcgugccuuccacugagucucagucaggcuuucugcccaacgcaaaagagcuugaagcacugagggugauuuuucaacuccuuuuuggacugcacaaaagagaugguucccuuuaaccucuagagagauaucagaagaggccagagccaaguaaauugagcacggacauuugucaugaguuaagaugaccuagccucugucaaggagccacuuaggagcuugacuucuuccugaagcugucugaaauggccuccagaucuuguaacucugaucuccucccuuaaugacugccaagagcaguugcaugcucuggcuagugucuagcuugcugcaugcuaacccuguccuagcucccugaccugaacagccugcuuggcuccccgcagugguguuugcuugccagcuccuggccaugcccugggcuggcagccagccucccaggcugggggcccagcagauaucuugccuucucccacuccugccgcugcuaucagcugucagggcuccaaacuccuuguaugucucugccaaagcuggcuuugcucaauccagccuggcauuguucaugcuuagacaaugaccaugagcuuguuugcuuucuccaccgccuaagaaaaaucuggcccacggacagcccagguccgaacaccugggcuggcugaggcuucagaucaacauguggcuuaagugcuucugcugggccauccagggagcucgucauaugcuggacacucauuuuggaucaaaaaaugggaaaaguuuccugcacuuuucagacaaauaccagcaagugcuuuuuuucuuucugugucucuuaguuuuuaaauguauuuguuacuuuuugauuaaaccagaauaaucucuggauucuuacaacuuccaaaagaccuguguuaacccuuuugggaugacagcuucuaauuauauuuuagaugugcagugaggugaacugugucuucucuguuuuuuuuuuuuucgguuacuuugcaaaaggacaugugagccuggccucgcuaaugacaccaccuuugcaaagaucacacagcaagaaaagucuagcauggcugacuccguccugcuucuagccucacagccuggcugucccugcuccuuccugggcauaggucaggcuaaacuaaccaugggagguauuugguuuagaguuuagcuuuuuuuuuuuuuuuuuuuuuuuuuuugagacggagucuugcucagucacccaggcuggagugcaguggcgcgaucucggcucacugcaagcuccgccucccggguucaugccauucuucugccucagccucccgaguagcugggacuacaggcgccugccacuacaccuggcuaauuuuuuuguauuuuuaguagagacgggguuucaccgugcuagccaggauggucucgaucuccugacuucgugauccccccaucucggccucccaaagugcugggauuacaggcgugagccgccgugcccagcuagaguuuagcuuuaaagcaaggaugauaauugucccuccuuaaaacugguucccuccuggcuggaagauugaaacugccuuuguaaaaccaaugaaaggccaugagauuagaauuaugggagaggccugaacucuguuaaaauguagguguaguuucuagaaucccuuaaugcucaggagucauguggccggaggucacaagauuuguggcuuccucaguugcuuuuauagauaacaucacuauuguagaacuuaagauuggucuuuugagauuuuuuuuucagauuuuugcauucuggaaaccaccugccuccauccagacuugggacgcagaacucaaccaguucuguggcugucacccugaggcagacucagcacaugaggacaauuuuccacaccccuaugauuccaucuccaaccaaucagcaacacccauucccuagcccccugcccaccaaauuguccuuaaaaacccuagccucugaguccucagagaggcugauuugaguaauaacuccaguccuucugcuuggcuguccuuguguuaauuaaacgcuuuauuuacugcaauaacauugucucagugaauuugguuuaccuguguagcgggcaagaaaaacccuucaggcaauuacauuaacacagguuaguggguggaagguggccuucuguagagcucugugugcaaagccaagaacuauuugcagucuguuucagcuuuaauuuguaugaaagcccuuccuuccggaaccuagguggagcucuugggccauucugucacauaucuuagcuguugcagggaugcuggugugauguuuucagaugaacuucugauuucuuggcugacugugaaaaaauccuugggccuuaguuugcugcucuguggccucugcagguaagcugaggacuagcagaauaauucugaauauugagggacaucucugcaugugagcuuuccuguaggguuggugaguggaagugaucacauuucaagucaauauuucaagaaagaaguaaugagcccauugaaagaggcuucuuuaagagaaggguaacuauuacauggaggaagaagaaaauaaagggaauaaaagguaaaggauaguaaaggaaaaagaaacucacauuuaaugagaauggaccugcugggcauaguggcucaugccuguaaucccagcacuuugagaggcugaggcgggcagaucacuugaggucaggggucugagaccagccuggccaacauggugaaacccuuucuguacaaaauuagccagucacgguggcacaugccuguaaucccagcuacacaggaggccgagagaggagaaucacuugaaccugggaggcagagguugcagugagcugagaucacgccacuuuacuccagccuggaugacagagaaagacccugucucaaauacuacuacuacuacuauuauuaauaauaaugauaauaauuaugggcccuaggcgaggcacucuccugagugcuuagcauggaauaucucauuuaauacugugguguaggagcuguauuccuaauuaacacagaaauauuaagcaauuugucagugguuucucaauuggcaagaggcagaggugguagucaaagaccauauuguuaaccacacaccauugugagaagacugaccacuuggcaacccugguauuguucaaucauuaccaagcauguaauaaaaaaugucuaauauuggaagaggccaggcaugguggcucaugccuguaauuccggcccuuugggaggcugagguggaaggaucacuugaucccaggaguuugagaucagccugggcaacauagggagaccucaugccaggcaugguggcaugagccuauagucccagcgacuuggggacugaggugggaggaucccuugagccugggagguugaggcugcaguaagccacgaucaugccacuguacuccagccugggcaacagaacaagacuccauguaaaacaaacaaacaaacaaacaaaacauagaaauagaagauacucagagagggaagaugguaauaguuggucaagaaaaugcuuuuauauuagaggugaacugagacuaacaccuaagucccuaaauucuaacugaauaguuuggagauaaguggcuccagaaauucauagcuguugaacuagguguuaguuuuagagucuuguuuuuuuuuucugagacagagucucacucuaucucccacgcuggaguacaguggcgcgaucucggcucacugcaagcucugccucccggguucacaccauucuccugccucagccuccugaguagcugggacuacaggcacccaccaccaugccuggcuaauuuuuuguauuuuuaguagagaugggguuucaccguguuagccaggauggucaggaucuccugaccucgugauccgccugccucagccucccaaagugcugggauuacgggcgugagccacugcgcccagcccuaauuuuuguauuuuuaaauagagacaggguuucacuauguuggccaggauggucuugaacuccugaacucaugauccgccugccucggccucccaaauugcugggauuauaggcgugagccaccguggccguccuuuuuuuuuuuuuuuuuuuuuuuuuuuuguaacaaccccucucacuucaccugagguagacuucuauugccgaacaauauuucacaaauuggcuaaaguagcucauaucugagagaugugccuugugccucccuuuaaggugacaggaauuagaaacugggacuagagacuauuuucuagucaaaagaaauugcugacucaucacgucagccuccuguucugaaauuucuguuucugcggucaucaaugguuuuacaauugcuaaauuaaaacaacacaggccaggagugguggcucaugccuguaaucccagcauuuugggaggcugagguggguggaucaccugaggucaggaguuugagaccagccuggccaacauggugaaaccccuucucuacuaaaaauacaaaaauuugcugggcauacuggcaugcaccuguagucccagcugcucaggaggcugaggcaggagaaucaccugaacccaggagguggagguugcagugagucgugaguugagaacacaccauugcacuccagccuggccacaggaugagacuccaucucaaaacacacacacacgcacauuucuagccuuauuuuacucauggugcuugauauuauuugccauuaccuuuuuaaucaaauccuccuccucuugugacauuacucucuccuaauuuuccuuauuucuauuccucuucauucuuccugagauauucuuuuucuguuuaucccuuauauuccaugguucuguagaauucugaucucaggcccuugcucuuuucuuaaguuauuauugggucaccuucuuuaagugaauugauguuccuuccaagaccauaauaaauacucuuccaucucuucauuuuacaaccuuacuaggucuucaaaauucuuacacacagccacaguuagccaacagaaaggaacaaaacuaaaguuggacuucuauauccaggggcagggucaaaaaaacgagaaguugagucaaguagggucaccuguuaugaugaaaaccagauagaaucuacccagcauguucagaauuaacaguauuuaggaagaaacuuguccuagcuaaucugggccacacauguugaugaagugaaauuucuucacugugcucagcagggaucaauggaccugauauuuagcuaauuaaaaaauaauguguaauuuugugaucuauaacuugagggaaggauuuggaaagggcugauuuccaguuguaauuaggaaauacuuuauuucuaaaucuauaacucuuuuauagccccagcugaugugguuguuaaaagucagucucacuuucaaagcucauugacccacaccuuuguuuuguaguuggccgacaucacacaaaaugaauggagaucuaauuuuaccuuuccuuuaaugacauucuaccgcucuucaagcuucccaacacaacuaugaaagacacuguggggacucugccccuuguuaaaauuaacuggcucucagugaggcuguaacguaggguggagcccaaguggcagguguuaugaauaugaacagcaaccaagucacauucuuaucuugcuuugucugagacuuccacaguugacugcacugaucaauugacccccuagagaggggucuaagaugaugcauccacaaaguccuucaaacucacuucuuuauuucauucaacagaggaaaaguugcuaauuuccuaacauaugaauauucucaaaaacaaaauuuaaaauucaacuagccaugggaagcagguaugaauuugaaguaauuuuagguucaucugaaauaugucaguagcagaaagacaggugaaaaagauuagacugggugucuggauccacuucuugcauagguaguuuaacuuuuugaucuguuuaaauuucuuuuuuguacugaucuuuuuuccuaugucaggaaaagucuaaaucuuucucugccuagaaccuugagaauaggcaagaaaggaauggcuuuauauuuaucauuucaaaaaaaucugaacuuagcccauuuccucccucccucccucccucucucccuuccuuccuuccuuccuuccuuuccuuccacacaguuacaagugccccaaaugaucaaauaacuuuauacacuucuaaaaccauaaaccuaaaauugcagauauuagagagaccugagagaugucucagccugcacucugauuuuauagcugaggacagugagcucccaagaguggaaguggaacgagaucuaggucuccugaaacuucuuccuuauuccauucugucuugaaggagacuacaagaggccaacaccuuuacuuuuggaaggaucucuauaucaaaccuugcauaggcugauuuuuuuuuuuuuuuguauugugcaggcucuuaaaaaucaacagagggaagccaugguuaccuuuccauuacuuacccacaaauaacuggcuguagagcuccaggcggguguggccuucuguuggggccuugcggaucugcugcgguagccgguccaccuguaggcuggccugcuugacauuccucucugcagugacccggugccacuggucaucguugagagggguuggugaccucacuacaaucucuacuggcccauuucccacaucaaaugaaaaggacacuucuguggcagcuggaggagcagaaagcaugaaaaacaugaguauuuuucucccagauaccaaauagcaguaaauucuagacgacaaacaaagcagggagaggaaaaaucaucuaagccugucacguccuacaaaggucgauggcaaaaucaauggaagaaggauaaaaugucaaucauuaaccauuaauaaccaaggguguuuuggggggucuaugugucagguauauauuuauuuccuuauuuaauuuuagaagccuuccaagaugugaccaucauugacccucuccagauaaggagacugaagucuggagaaguuagcgcauguugagugucuuagauucaguaaguuaguggagucacgaacugaaccaagguuugucagauuucagagccugauaucuucuaauuccacauacaauuuaccuuuucaguaaguagcuccuugggaagugauucauagucaccuggagaucucuugaaacaccuguguccagagauuuggacucaguuggucaagaguuggcacugguauuuuaaaaaaacuccccaggaaauguuaacacauagcuagaguugagagcuacugcuuugggggaauuuaugaaacuugauuucauugaucuuuauacucuuuugaaaguuggggacccuugaauuguugguguaaugaggguaaccuauuguugguguaaugacggugaccuauuguugguguaaugaggguaaccuauuguugguguaaugagggugaccuauuguugguguaaugagggugaccuacauuuuaugaccaccugugccuaccugaaagguagcacaacauuucuggagaauaaucccugucguacaucgucuguugcaaaccuugguuauuccccaucuggguuguaggcuccuucucauaaccuacccucuagcacugaccacaaauucuuuuuuuuagagaucaccuccaaaucaaccuuccucugcaauuagucaccucucaacaauuggcaaauggauugggugguugcuuuauuaacuuuagcuauaaguagcuuucuaauuucacauuuuauauuuuauguuaaguuccucagugaccaccuagugcuuuauaaacaagcuuuuuaaauguauauuuuuucuugugauugacaggagaggcagccucaggcugaagcagcacacacgucuucagcucccuuaggcugggugaauucuucucaacauuaaagauguggcacaccagugccuaacuuugcuuauaaagauauucagccccucuguccaucaauaagcuuuccaccuaaucucuaagcaguuuaauuaaauaucugucauuuuuuuuuccugggcuaauggaaaauucagcuucuuuuggcugguaccauuuuaagacgaugucacaagcaaucaaacuucuaauuuagaaaccauggugggccagauucucucaggaccuagacuguucccugccucuguguugggccccuuggaaagcugcauuaacuuuauugagcuacagggauauuagacacagagcucaauuuaaucaaccuaauuguaccaaggaauuuugauccuucaugucguuagcgagagaacuuucauuucaacaccuguggucauuggacacacacuucagaaaaauaucucaucuaaauuagaagccccugccuccaggggucauugggacuggauugaacuugcaggccagugaccuccaucaagguuuccauggaaguaugaucagaaugcaggaagaugauaauaugacccacaggcugugugaucuuucucuguaguucugauacagcagaugaggaaaaaguagccuugguuucagauuaaaucuguucuguucucauaacacuguauuuuagcaggagcauuuuuuaaauguaaguugucagaacagcaagagaacgaggguuccugggcuaaguaggaaagauuguuucauuuuaaaggcaucaacugccaucaaggaaauagaauuuagggauaaauugaguuuaacccuaagguuugacucguagggauaaaugcuguucuaauuuccucugugauucuccuacugcuaugaugaauucguguccaggucuucaaacugucacuacuuggaaaaacucugagugccagaagucgcuagaaaauaucuauacuuuuugcuugucccaauagauccccuauuucuucaccgucaccuuaacaucaauauuuuauucuggagaagggaagaaaguugccaggacgaugccguagcucagagccucucacccuaaugggauacaguaagagggacucaaggccaaaggaccccacgagcaacuuucuucccaaacagccuccauucaggcucugcuggagaaauauuuaugaagucagcacauuccacaccccuuccguugcuuccucaggaaggaucugaaagacccacugugagagccaaggaaagggcucuuuuuucucagccacucaaugucagcuucccugacauugcugcgggaagccuuugagaaaucccaucccccagucagacagccaguguguuuuaaaagcuucuaaguucaguuuguggcugauugcucuuggucuucugggugagagcaacugacauuuuaaaagagauaauuauagagagagugagcgaauaaaagggagacagcauaaaagacacuugagccaaugacacuguccucgcuuaaugugugucuccaguuggagacugaaguguugcccuguuucugccugugaaaaaggaauuucuuauauaccgaacaaauucucauuuccagaaauaaguauuugagaauuggaugcauauagccuggcucauuggaaagaacacugugccaaacaugaaugguugccuuuccaugaguaucaagaacugggaagggucugagacuuuaccccacuugcaggcuaacaaguuagccaugguuugaugaugcuggcagaaccauaguuuaacauggccacagucugaugaugcuggcagaagacaugaaacuccugggucagagacaaaggacuucuuuacucacaacacagcaggcagccugagcuucccguucacauugcuuucccuugcaggggaaugcagggcaucccagguggaugcugcacaugcaauaaguuugcuucacagcugagggacccuggacuuaggaaaccccaaucuuuuuacaguagcuacuagcaaacuugcucaauuucugccccggagagugacauuauauuucuuacucuggccaugaaauaaaucuacccucugucccagaggaagacacuaucuguaucuuccaaggcuguuagcuauacacacauccuuaaaaaagguauaaacaaagcugucaaugcuucuugcucagaaggcaggcaaaaguggaagagacccauggagauuuuucucccaauaauuagucacuuucccuuuuuucuuugugagcuaaccggauuuugcccuggaaucucuguguuuccagagucuugcacuuugcauaaggacagcccuacccaaggcccacaggauggaucuggauuuaaugaaggcaaagauggcaauuccaggcuccuugccagcuacccacuuuggaugagacacauaauucccuucuagccaaugaaacaugaguggagucuuuuggugaguuauaaggaaaagacagucccuuuucugccccuuaauauugggugggaagcugugguucuuaauguugcuggagcugccucacaaaugucagagauacagaggacagagaggacagaggaugagccugggucauggcugacauuguucaacuuuuaaaaauucuuuauuuguauuuuuugagacagggucuuguucugucacccaggcugcaguguggcagugugaucauagcugacugcagccuugaccuccugggcucagaugauucucccaccucagccucucaaguagcugagacuacaggaguacaccaccacaccuagauaauuuuuguauuuuuuguagagaugggguuuugccauguugcccaggcucaucucgaaaucgugggcucaagcuauccacccaucucagacucccagugugcuaggauuacaggcaugagccaccacaccuggucuacucaacuuuuaaauuaaucccagagccaucuaccuuaggauuucuuaugugagauaugcuguuauguuauugcucaagccauuuuuauuguaacugaaagcaucuuaacugauauagagccucagcuguuuggucuuuucacuuuucacgcuucaggccucaguuugagguccaaagugaggauuauauccauaguuucccaaaaguuccuguguccaaaauguguuugaaacuacggagaaccucuaagguucuuucaaauggcaacauucuauaauuuuucaagagauucuaagagaaauaaaaugaaauacagcuggucuuaaugguaauuuuagauacugaaucauuacagggagaaaagagaaauacuaaaagagaaauacauaagguggcauauugccaucagaaaagaauauagguggaagaaauuacuuucuaauaaagcaggcucaugacuucaucugaaaggcuuaaaguaaugauugggacaaaaccauggagagcucuuggcauguucacgcuuccccuuccaaguguaauuccagcagguggcacuauuugcucucauucuaacucaacaaaucacuccaagcuuaguauauugagcgauaaauuuaacaacugaccaauaccagguguuuuuggcucuaaguuuucucagcaggugagggagcauuuagauauuagaccacaguuucaguugaaguagcagaaaaaauuuggccauucaguacagaacaggauaagagaaaagagaaggaaaguuauauagcaugagcaugaugggcagaccagcuaacacuguuuaguuuugguaaugauacguuuuuuccauucuaaaauaagguucgagggguggcagcuuccugggggaucuucuguacaauaaaucucauuugagucauacaacaaaacugguaauugguagaacagauauuucagccucacucuauggugaacaguguuaucaauaucuuuuuuuguuuccuguauuuuuuuucugaaugaaguacuaacuguacaucagaagauaaaaggauuuauuuaacacgaaagggucaugagaagaggcaggaaggcugaaaauaaggucgccaugggaaucagagagauaaggagaaagaaguaaagaguucaucuauguuccuaauucaaggccaacugcugcaccuauacacgggaugccauccuuccuaccagcucaaggacaccacucugacaauucuccccucccucuacaacuggguuguuauacaaacacacacacacacacacacacacacacacacacacacacagagacauaucucuacucuuaacaaccacuggcacuauaaaaccuuucuuuugaccuuaucuaucccaaaaguuaccauuucauuucuaugcacccuuuuguuuccaaauuccuugaaagagaugucuguacuccccauaucuauuuccacuccucuuagucuuccucuaauuccaccacauaggacuuucuccuucacaacauuugaaacugcuccugccccagggccuuagaacuugcuguucacuuuacccaaauaacucuguggcugagcguuuacuucucugcucacaagucaucauauuagaaacuccaucccuaaacauucuauguuaaauaacaaacuucgcucucagcuguccuuuccccuuuaauccugauuuuuaaaaagucugcauagcauguaucacuaucuggaauaauauauaugugguccuggccucaggaaggcagaggcauuuucuguuuuguucauuguucucuccucagcacugagaacauugccugccacacaguagauaccaauuugugaaugaaugaaaggaugaauagaaacuacuccugccuaggaaggcaacagugaucacauggauacucugaaaagagaaauccacucauuuucccaaggccagccgaacuagauggaguuccaucuuguauuccacaagcaucuuucccaagagcacaaaguaacucaaugaauauuuucucagucuaagagcaugcuacauuaguuaugucuguuuaaaacaaauguagcuaaacguuauuuucaaacauaugauguuugaggacuaauggcuugcccaagauaaacucaccaguggaauaagaagcagaauuuucucccuuugcuuuauugcaugcuaguuucacucuacuuguaggaacagggaccuuggaucuuaauuacaauucucaaguuuuggccuacauaaaaaacugcuaaaggaaaaugcuuaaaaugcauauuccaaugcuucuguuacagagaaucugauucaguagguuugggguggggcuuuggagucugcauuuuguuaaugccaggugauucugacgcaagugguccuggaaucuuacuuuaagaaacauuaggaguuucagguuuccuucuaguaguaaguccuaggaaucuuugcuuucuuguccucaacagagagauuuucagaacuguguaauagagaauuuagccuugcccucaagaggucuggcccuugccuuuggcuuugggaagguaauaucuaagcccuugggauguccugccugguaagcaugucuucauuugccugggagccuuggguuauuccagauagucuaacauuguguuuuagggguagggccacaccagauggcauuuaagauggggccugggcugggugugguggcucaugccuguaaucccagcacuuugggaugcugaggcggguggaucaccugaggucaggaguucgagaccagccugaccaacauggagaaaugccaucccuauuaaaaauacaaaauuagcugggcgugguggcagaugccuguaaucuggcuacuugggaggcugaggcaagagaaucacaugaaccugggagguggagguuguggugagccgagauggugccauugcacacuccagccugggcaacaagagcgaaacucugucucaaaaaaaaaaaaaaaaagaaaaagaaaaaagauggggccuuaccaugccagauugaccaacaaugugaugaaggguguggggcuuuggcuuauauucuccagccuucugaggggcuggaaacugaggucagccaugugggcaaucaaucauuccuauauaacggagucucaguaaagacucugaacauggaggcucaggaagcuucccucauuggcaauaccccaugcaaauuguuacacacccguuccaggaaagaaaugugcuccugaaucuauauagagagguugacuguaaacucagcaucugguacuguuccuggacucugccaucugugcuucuaccccugucugauuuucacgugcauucuucacccauaaugcagcaugaguauagcagccuucggcagcagaauucagugaauucugugaguccuucuacagaacuaucaaaccugggggugguuuggggaacuucugaacuugcaauuggugucagaagcauaugcagucuuauggggaauguggucucucuaaauuugcaacugguuguaacuccacaaaaacagaaacaaucacaucagcuuagaaguaugugauugaggcugagcacgauggcucaugccuguaaucccagcacuuugggaggccgaggcggguggcuuaugaggucaggaguuugagaccagccuggccaacauagugaaaccccaucucuacuagaaauacaaaaaauuagcugggcaugauagagggugccuguaaucccagcuacucgggaggcugaggcaggagaaucacuugacccaggaggcggagguugcagugagccagagguugcagugagccgagaucacgccacugcacuccagaccaggcaacagugugagacucugucucaaaaaaaagaaguaugugauugaauccaauaauguuaagaccuaaaagcuucagugaauagacuucgaccccugagcccacccucacugauuagucaggaaacugaggcugagagacacuaaaauccaguaaugacuagauauagagcuuuaguuuuccuaacuacuguauugccugucauauuaugaaggaaauaaaaaaugaccuauuuuucuuuuaguauaguuuuaguuucugaauguagagauuuuuagagucauauaugcauauucacaccagaaaacuugguguuaaacacaucugaaaaugaacauuggcaagaaaaauuuauuugaagucuucuggaaauucuucaaggaaaugccuggagcuuaggaaucaauguuacgaacucauuuuaaaaucucugguaucucgauaaccucuugaguauaagaaguauuucucuuuauguauuuuggccuuuaagcuuuuuauuaugguuaaaaaauaacuucacaaacaaagacauccacagagaaaaggaagcaaaagggagauaccauuggccauacaaaaacagaaagcugucuuuaaaaugcaaagcucuucuaauuuuaguuuuucuaugcauuuaaccaccuuuugagaauaacuccuugaauauuaauaggccuauaugauuuaaaaagaaagaaggcaaaaauaguuccaaaaugauauguggcuggcaacaauccccuguaccccauguaggacuugcaguuggguuuuaaauacccucuuguuuggaaagagcacagcuguucauugggcagacaguacccauuuuggaagaauagauaaaggucccagaugguuacucuggggauagaguguuguaauaaagggaaacccagaagcugcuuuagagaaacucugaaacucauaccuaaggauccccuagagaugaagaggagagcagauugaggaggggauggacuucaaagaaguguuucuuccgaccauauucagguugugcggcaaaaugagaaaacucauuuaaggaaaugugcuuugguagaagacuaggggugauuuauuaaguugguuugaggugaugucagagagagccaguucaucaaaauacauggcuuuggagagugcaaggagaaaggagaauuuggcauccaaaggagguaauaaaacugcagguugaaacaacaugaauugggggaaaagcugacaaguuucaacacagaccaagcugaagcuuacaaggagacagcauacaagucaauuaauugugccuucuaaauaacugugcuaugcauggcuaucuugauagggacacugauaaugaggaaaagccaaagaugaacucugaggaugaaaggcuauggcuuuggaaggagcaugcuugcuagugagagcuuuagauaagucuaucagaaggaaagcagccaaggggacgucuguuuucugguuucuguggacugacuugugacucugccgauagguuguaucacagguaguauuuuucucucucuguuuugccacaaauuguuuccuuucuaucaaauccuuucagugucaccuugauaugacuucagagaagaucucuguaaugaaaauuaaaaagugccaaaugaggacauauauacuacaugcuauaggcucagaguauaaaaagagauugauucuguuuuccauuacaacaacagauucucuucaacuacagugcauuugcaguauuggacaaauaguggagaaaaaaguaaaauuaugcugcagaucaacagagacuuuaaaugggaauggagagacauuagagaggaaaggagaaccuuccuuccuuccuuccuuccuuccuuccuuccuuccuuccuuccuuccuuccuuccuuccuuccuuuuuuuucugagauagacuuuugcucuguugcccaggcuggagugcaauggugugaucucagcucacugcaaccuccaccucccagguuuaaauuauucuccugccucaaccucccgaguggcugggaccgcaggcacgcgccaccacaucuggcuaauucuuuuguauuuuuaguagagaugggguuuugccauguuggccaggcuggucucgaacuccugaacucaggugauccacccgccucagccucccaaagugcugggauuacaggcgugagccacugugcccaacugaaucauuuucuauauagcaagcuuucuuaaagugugaaagacuucuauaaaagugccuuuugccuuagaaucgucacaagagaugcauaaccaauuuaaauuauuuuauuaguuuuucugaagcuaugcuuaacuugaucuuuaucgucuacuuaguaaugaauauuagaaaugaggaaacuaaggguugaacauuaaaaauauagaaucucagaaucucagguuugaaaguaucccaggauaagugcuccuuuaaaguuguagaagaguuaguagacccuugaguucauauguuuccauguaugaaaaaugacagaaaucacuucacagcaucccuuaugguugugucagccaacuucuacuuaagaaaagcauuccucuggaaauggauauuguuaaacaauaauaccaauuuuucacagaguacgcuuccuuuguuuuggauaacagcugaaaauauaacuuucuuguauagauugcauaaaacauuuuugccucccuaaagacugcgcauauaaaauacgugagaacccuuuuaggacuaguuuguacaauguucaaacaaguacauuuacuuuuguuacgauuuagugaacuaauggaacaugauuuuucuguagaguagcuccaucgagagaacaguugcaggugggguuaaacucaucuccagccuccauccugggaugguuugacauacucucaacaaagagaaugaauggaaacagcuuuggggauagggucaucgguuagcaguacuauccagcuguucuaguccauuuugccuugcuauaaagaaauacuuagggcuggguaauuuauaaagaaaagagguuuauuugacucuuggcucugcaggcuauaugagcauagugcuggcaucgacuucuagagagggccucagaagcuuaugcucaugacggaaggugaaggaacagcagcacaucacauggcaagagaggaagcgagagagaggaggaggaggugccaagcucuuuaaaacaaccagaucucauaugaacucauuaccaugggaagagcaccaagccauucaugaaggauccgcccccaugacccaaauacuguccacuagguucccaccuccaacaucgggagucacacuucaacaugaaauuuggagggacaaauauccaaaccaugugaccugcugagcccaucuuugcuuggauuucccaaugugguuuccuuguuuguuuauuucuuuccuuccuucuuuccuuccucccucccucccuucccucccuuccucccuccguucccuccauuccuuccaccucccccucccucucccuuccccucccuucccuuccccucccucccucccucccucccucccucccuuccuuccuuccuuccuuccuuccuuccuuccuuccuuccuuccucccucucuucccaaugugguuuguuuccuuccuuccuccuuccagugugguuuccuuguuuccucccucccucccuccuuccuuccccaucccucccuucccccccuccccuccccucugcucucuucucuucuucucacucagccacccaggcuggagugcaguggcacuaucuuggcucacugcaaccucccccucccagguucaaacuauucuccugccucagccucccgaguagcugggauuacacgcaccugccaccacacccagcuauuuuuucaauuuuuaguggagacaggguuuugccauguugaccagguuuuucuggagcuccugaccucaggugauccaccugccucggccucucaaagugcugggauuacaggcaugagccaccgcacccggccugucuuccacuuucaucauuugagcugcccugcagcuugaggcugugauaugugaguaugugauaaaaagcaaucgcauaucacauacuuaaaauagauaguaugcuaucauauguuaugauugggaaugagcaaccagaagccaguggaucagaauguguggaaauuuaucuuucaaaaguuaagcccaacagcaagggacuguggguuaaauggaaugcuuggcaguugaggcacuguauuucacaaucuuucaaaaucugugcucccauuuguugacauaguaaucuaaucaugccccauguaggaggcuaaugguaauauaacaaaccucagaagaucccagauaaacauccgaccagccaauuggaaauuucuaugcuuuauauucuguagguuauauuaccaaaacaauagcuauuuuuggguuuucuuucuaaauauaaaauuauaaguuuucaaacuacacaugcccucuuggagauucugguaugguccuuguucucaguugaaaaaaaaauauuguuauggagucuuaagaaaaaugacaugaaaauguguucuuaaaauauuauuacauaaaaaaguagguuacaaaacaguauguacccuaugaucucauuuuuguaaaaaaaaaguauauauaaaugcauagaaaaauguuuagaaauauagacaccaaaaugauaauuuaaauauauuggaauaugggauuauagcugaauuuuuguuuuguccuuuuugcugcucugaauuuuuaaaucauucaacgauaaacaauacuugcauaauuuuaaaguuacaaucugauaauuuccacuuucucuggcaaagauuggugacuuuauaagcaacucuauucuguaacuuuaacaacuauuuaaucagaaaguucaguuuaucaaaauaagauauuauuuuauuguauacgauuuuauuuaaauacagaaaauuagagggcauuuaaaacuagacugaaauauuccucauuucuucccuauuuuuagaaacuugagaagauuuuuuuaaaaaacagaguggucaaacuuuaccauaaaauaauuuugaacaagauauaaguucuuuuuuccuguuaaaaauggcuaaaaacaagggcaugcuauuuuucaaaguaaaauccucacaggucugaaaugccagcauguucugauguuuaaacuaauguauacaggaaccggaaugcaggaugagcauaauucaguguuauaauuacacuugacagauauacacugcuucuauuauucacuggcucugguuacacuuacccagaaagacucuguagaauacuaaauaucaaccacucuucauaaaaagucaguuggcauucgcaucaguucucaucagaggaaucaaacucagagaugcagaaaaccaaauuugaucauuuuaacaccauccgcaaaggcaagcaaaaugacuaauuuccgacaaggccugagguucagccagauuucauuugucaaacucuuaacagauaggcggugggucauuucucuagagagagguaucuuugaagugguccuugggcuucggcuuuauuccuuucaauugcuucuauguugcacggucuuccucccccaccugcauuugccuaugcuguuuucucuccagaaaaaugcccuuaucucauuuuugccugucauccuucaaugcaaaucaaaugcugcaucuccuggaaacuuaccuuggugucuuuaaaguuuacuccuuuuuggugucauaguaccuguaaaagagaccacuaaccauucacagaagguuucuuuccccuuuucaucaucacucccgcaaagcugcuacccagccaguaacugccuuccuggucccugugcauccagguggagacaugugacuagcucuuaccaaagggaggagggcaaggaauguguucacgcugguucaguguggucaagaagagagaaugcuucucuauccucccuuucucucuuugccagcuagacuucccgggcucuagacgaugguggagccacagagaaaaggagucugaaccucuaaaucacuguguggaaggucuucauggaccagagcauagcaugcauauuauuauuauuauuacuuuauuugagacagauucucauucugucacccaggcuggagugcaguggcgcgaucucagcuuacugcaaccuccaccucccagguucaagcgauucuccugccucagccuccugaguaguugggguuacaggcgcacgccaccaugcccagcuaauuuuuguauuuuuaguagaggcaggguuucaccguguuggccaggcuggucuagaucucguggccucaggcuaucugccugccucggccuuccaaaguacuggacuacaggcgugagccaccgugaccgaccauagcaugcauaucagacugucauauggcugcagaaaccuaggguuuuacuggguagagcagcuuaucuuauuuuuaaagaagauuacauaauguuccuaacucucuuaugaccuuaucacauuuuuuucauuuauucguaugauuaaaaaaauggacaagaggauguucaucagggaugaagggauaauugugguguaaugguuuuacucuauuuucaauacccaacugugucagaucauuguaauauuaaaaaaauauaggccguaauauauuugaaugaauuagggggauucucuaauucauagaaguuucagaguggagagaaguggcuggaagccacgugggagcccuuuaaacaaaugcuccuaugaauguuggagauguucccuuuacuaacccaccaaaaugaggcucccaacaaaaggagaggcaggaccgugauuugacuaucaaaaaggcaaauaaaaacuuucccuguggagaaguuugucaugcucaagcuugaccuucagaaauacaagaaacaauucuuuuuguucuucaacauuucuauucuacaucucauggccuccagaagccaggacccagaucucagccuguccuguguaccuugaaucaacacucaacuacagcaacagcagagcucuuuacgguuagcuauggaaugugagugcuauauacaaugcggugucuacauuaaaauacauuucagguucugaacaacuagaucagaaacuucuagagcacaauccccuuaaaaauugagaaguaccuaaacuaaaaaaaaaaaaaaaauuaaaaaauuaaagguaaaacagcaauacaaaagaaauagaaacaucuuuuuaaagaagauauauuuuuacugugaccacacucccguauaagauuucauguaagucuuuacguuuccccauuucuccucaagguuccuacuugauugcuauuaaaaauugucuuguaauuucaguaaaaugcaucuugagaacgauaacuuccugaaaauuuucauuuauaacaaacuguuuuuauuucuuguugcuuuaaaacauguuuuaaaauuuuuauagauugaggggauacaaguacaaauuaacaaacuuuguauaaauuuuccaguugacauccaguuggccaguauuuucuuucaugguuuugauuucaguguuugauagcuuauagaaaccuagcacuuguuuuacuuauaguugucuuuggccuuuugagacaaucuuugguucugagcuuuuucaaguaaucuaucccagucccucacuauauuuaaaugaagcucuacucccugauuuauuguaucuacuuuuuuuuuuuaaagccagcuuugaauuaauuggucccaagugucaucccuaguugaaucaauucuccagcauuagcaacacacacugacugacuguuaacucuuuucuugaagcacuuguuuuuauaaaaauaucaagccuauggagauacuguuagcuccuagaauggcagauggaaagucucuaaccuuauuauaauuuaaauuuuucauauauauuucugcuuuucucauaaauccauguguucauuauccagcaauaauagcauaucuuucuuccgucugucucagaaugugugaauucaaacuucuuugauuucuucucuuagagggucuguugucuuacagauggucauaggcaggccaauucuaguuguuggucuuuuugacacuuuaacaggccaucuuuuagaagggaaagguuucaugaacuaccacauagaguaaauaauauggaaaguguuggcagggcgugguggcuuaugccuguaaucccagcacuuugguaggucaaggcaggcagaucacaaggucaggaguuugagaccauccuggccaacacagugaaaaccugucucuacuaaaaauacaaaaauuagcgaggcgugguggcgugagccuguggucccagcuacucgggaggccaaggcaggagaauugcuugaacccgggaggcggagguuguggugagcugcugagauugcaccacugcacucuggccugggcaacagagagagacucugucucaaaaaaaaaaaaaaaaaaaaaaaaaagaagaagaaaagagaaaagaaaacguuagaauccaagagagugagauagaagaaaaauuacaucaaaaaauuuuaaugaaacuucaguaugucuuuggaguaaugauaaacuacuccauucagacaaaugcuaugugaagaugcugacuaaugaggauuccugcuacuuuccaggcaaugcaccuaaugaauugucuuguaaaaauuuugguauuuuuggggaaaugaagucuucugucuuauuuuuuauauuauaaaucaagaugcaaaaugauaaaaaaaauuuugugugggcaggauuucaaugaaggggaagcaauuccggaacaggcagacacauagucagucuuaggaaacuguagugguguccagggaauaucaguagcuggacauagcugaggcuguggcacauggugcuggugggugaggggcaaagcuuguauggaguaggggaaaaaaacuugaaaauuaaguuaggccguaaaucacuuaccaagcuugggauuguacuuugucuuauaaggcacagggggaaucaugguggucuguaaggaaaggaguaacuggaccagaucuguagaaauuuggccucacuagggagggugguuaucaggauagagggacuggagugagggagucaaauuaugagccugucugaauccagaauccagggauuucaacuagcaaagccauccugggagguagagacauuugguaugauuucauuauguucacaucuauguuccagcugccuuuuaugacuaguaggaauugaugcuuucuguggcauuguucugguaugauggcuuacaggaagaauagcauuucuuuauauuaaaaaugcaguguucuaucaagauaaaacagucuauccccuauggggagguuaguaaaacuuuaaauaggacauugaguuuucuaauuugaauaaugaagaagauggccaugacauuaacuaagugggagcacagaagggggcuuuugagugaaaaugauggauuucaguuucgauauguugagcuugagguaucgugggccauucugauggcuccuuaguuagcauuuacaauuagguggcaauaauguuaggagaucuccugacuacguuuggugaaagcauauaugcugacuggaauuacuggaagcagauguguuuuauuguggcacaucccuccccccaucauccuuaggagaacugagaacccuggcaugaaaaguuaaggugcugcuuggcugugaguucacuuagguugggaggugguaagccacacuggauggcugauggucuccggcagguuugccgaauuguucaugguagacgagaccuuaaauaccaucuuguucaaccuucuuguuuuacaaguggauaugauaaagucuggagagguucaaggacuggucucuggucagucagcuuagaauccuggucucucuaaguguaguugaaaaauugagugauuuauuaacuuuuuugucauucaagauuuucucagagcagaguuuuucucuuuuucuacuuuuccauucagcuguaauuuauacacgguaaaaugugcauaucuuaaugcacagcuggauacauuuuuacauaugcaaucauuccuugcauuaagauaaagacuauuucuaccacccagaaaguuccuuugcacccccuccuaguugacaucagcuauccccaggaauaguuacucuucuggcuucucugcaguaaucgauguggauuacuuagguuauuuucgagcaucgcaugaaagaaaucaggacauaccgucauguauguacaauguaaugucuuugaggaaauccugccucugauguuuacuuucuuuuuauuguccuaaaaugcccgugacuauguaaauaagcuggaguuuaauagggagagucuaaggacaccagaucucuagugaggucuuggggagccuguguccuggacuucagcugguuuccaaagcagaaguugagccccagccgagggacaagccaucucuuugggugugacuggaaguagccugcccuugguuacuuggaauccaggaugugggcccaaggcaaaggaauuauuaccaagaaggcaguuguaucuucaaauggaagauccuuccugguaccaggaagguacccuccacgauggggaggaaaggcgauguggagagacugcgguuauguggcacccauaggagcugccacgugagagggcuggucaggaggccuggguggucuuucaaagccaccucugaaguguagugggagagaggcagaacucuagaaucuguagagagaugucacucugucuggccagcuuaggaggaauucccaaucuucucuggaaauuuccagaucaggacaugaguggaccaguaaacucuaaaguaacuugaaauauuuuuauauccagaagacauucuauucuaaaauccaucuucauaacucuaggauaccucuacuguacauucaaauaacugucccuucaguguaauuggcaaagaaaucuggauaaauuuaaucuaaauugauuuaccaacuauuuauauaucuuuuaauauuuauuaagaacaaaaagcuauuauaugaaaagcuuuaauauagcacaaauuucauuuuaguuuacacuuccaaacuucuuuuuggucuguaauucaaaucaaagguuuaaaucgagaaguuagagaauuucuuuuuaaucacaaguguuguuauuaaauauucaggucuucaaauuuuauuuuuggggagagaauaguuuuuuuucuuauguauaguaaugaccaagucagaaucacuuuucagauuccaaauguugaauauaaauugaaaccauaauuagacuugcaaaguaguagaaacacuaaaauucuuccuaaauccauguugauaacccaaguuggcuuggauaauuaaaaagaaaaauccagaggcccggcaugguggcugacgauuguaaucccagcauuuugggaggcugaggcggguggaucgcuugaguccagguuucaagaucagccugggcaauauggcgaaaccccgucuccacaaaaaauacaaaaauuaaccgagugugguggcgugcaccugugguaccagcuacucgggaggcugaggugagaggaucacuuaagucuagaagguggagguuauggugagccaagauugcaccacugcacuccaggcugggcgacagagaggcccugccucuaaauaaauaaauauaauauaugugugaaaaauccaggugcuaacaccugauuuguacuaauaaaaaacacaauauuuuuuaaaacauccuaaauaacaccccaacagaacaacagcccaguuaaguggaauuagacauucuucacaucuacaagagugaaacuauuuaaaaauaaaaaguuguuccaauuuugaaauacuggaagauaaauugccauuaguuuacuucuucugacucaucaguuucuguauauugcagaauauuuucuucugacuuucuugagcauguauauugcauaaggcugcaucuugaacaugaaaguuuuuccucauauuauuuccuaagauuaguaggacauuaggccgcugccugcacauuuuuguggagauaugucugcuaaaugcaaauauucccuccaaguuauccugauaccuuaaaaaucucaaacuugggcaacauggaagcuuauguuaaaguauuacaacaguuucugguugcuuuuccugaauguuaccuacucagugagcuuuuccuucaaaauuucccuccaaaaauccccuucacaaauguccucuaaaaucuuauuuauuuauuuauuuugagauagggucuugcucugucaccugggcuggagugcagugguacaaucucagccuccuggauucaagugauccuuguuccucagccucccgaguagcugggaucacaggggugugccaccacgcccagcuaauuuuuguauuuuuaguagaaaugggguuucgccauguuggcuaugcuggucucgaacuccugaguucaagcaaucugcccaccucggccucccaaagugcugggauuauaggcaugagccaccgugcccagacuaaaaucucuuuuaaauuguuaaacaaaaauagacucuauggucacuauuuguuguaucauuaaacacuuucaaacacuuccuuccucugauugcaguccacccuaaggggacccuaacuuacaacccuuagaauuguaaccccuuuucugaguggcccauaucuuggggccaggcgaacaguuggccuauucuucccuucuccguacuucuuccacucuauggcuccagagucuucaaacggcuucgcguccaccugugacucguccucuccccguucauauuguggucacuguuugaaccccaggacaguaaaguuugggucauggauucccuguccauuucaccucuugucuucaccauugaugaccucaacagugacauaggugaccaaccaacacuacucuggccucccagugcccugacuuucuccgcagccuuuugauacaaccuacaaaauuccauuucaauuuucauucuucuuaccgcccaaacugcuuuccugugaaaucgugaguuccaaaauuucacuaaccgugaccuguccuuccaccuuuccacauauuauuccuugucuauauuuggaucgccagcaccucagucguggugaucugcuucuccaccuagauuuucuggggcucuccauucagacuagcaccucauucauucauuucauucauucaacaaaugcuuauuuaguuccuaccacaugccaggcauuguggugacccuggagauauaaugguaacuaauguuccguaacccucgcagcauggguguaugacggagccacaccuuuuugauguguucaugccaucuaugaugcugugcuuuuuuccuuuggcauucuaaaccugaaacuuccuuuuccauuuacuuuguggcucuuuuaaaauguuagcaucuucaaggaaacuuuucuccuucuccagucagaaguaaauauugccucaucuaaguaaccacagcauauuguucguaccucuaauauuauccuauccaaaauauuauuuuauaggcuggcuguaggugguagcuuauaccuauaaucccaguucuuugggagguggaggcaggcagaucacuugaggucaggaguucgagaccagccuggccaacaugaugaaacccugucucuacuaaaaauauaaaaaauuagccaggcauaguggcacaugucugugaucccagcuacuugggaggcugaggcaggagaaucacuugaacccgggaggcagagguugcagugagccaagauugugccacugcacucuagcccagcuggcagagugagugagaaucuguccaaaaaaaaaaaaaacuauauauauauacacacacacacacacacacacacacacacacacaguuuuauaauaacagagauuacuagucucaaauaaagaaaaugugguacauauacaucauggaauacuacacagccauaaauaagaaugagauaauguccuuugcagcaacauagaugaagcuggggaccauuauccuaagcaaacuaacacaggaacagaaaaccaaauauugcauauucucaccuauaacuggaagcuaaacauugaguacgcauggauacguguacuaagcguggagggcgggaggagggagaggauggaaaaacuaccuaucagguacuaugcuuauuacuugggugacaaaauaaucuguacaucaaauccccgugacaugcaauuuaccaauauaacaaaccugcacauguaccccugaaccuaaaagagagacagagagagagggagagagagagaaagagagaaagagacagagagagauuaagauuacuagucuuucccacuagauggugugugccucugggauggggccaugucuucuucuuacguucauuuuagguacacacauagcagguacucaauaaauacuagauaaauauuuagaugaccauauauuuagaaugagaucugagacuugaccccaaaucuucacugccugugucauacuucacacucuaacaauacaaaaugcuuguaguuucccaaacgcccaucacacuccccauuccuguguuuuuguucgcauugccucuuccuccuagaauucuuuuccccauuccuuuaacuuuuuugccugauuuuuaugacccaacugaagcauucccucaucuuccccuucauucccaggauaggucacauaccucuccaccgauuguucauaauacuuugugccuaucauuguaauuuacuuauuuuaacgauuaaaugcaccauaucuggauucggcagugucaacucuaugcucucauuuccuuagcuguaaaauguguauaaaacuugcuguguaaacuacaaaaguuaauaaccuacaaaagcuuuagaacagggccuggcacuugcaaagcucucaaugaaauuauguauccacacugucacuaauguguuugucuccuucacuaggagguggaugcuggguucuccuguuuccaccucagcuuccccagcgccucccagcaccagcaguagggcaggugcucaggaggugguggcccgagguugggacccugguuaugauggcccucucagucagaaaaaggaucuagagcagucaagcuaaucccuuagggguaacugaaaaaauacauggacagauccaugguuguuagugaugaagaaaaguuuagagucuggguuuucugauaucugcuccauaaauuuuuuuugaacaauauuucuuugccaucucaaaaauacuaacaaacaaacguccacacacaacaacaacaacaaauucugauuuggaaaggcacuuccuagugggcgguuuacgcuguucucuuuacuuccgccucuuccucucaccccugugaggugcugcgaugcugggucuaccucaugcccacagccauggggaccuugcuccuucagccagucccuuuaucuccuguauuaccaaucccccuucucuaccauaguuuucuccuucaacuauaugaaugcuaaagucucuaccauccucaaacuagaaugaacaaaaccacccucucuugaucuccaaauccacuuccacucacccuagugauaccugacuuuuugaccgugaccucuacauguuaaaucugauggucacuuuauguccuuguuuuagggaccucucagcaauaucuaacccucuuuuuuuccuuuuugaaaugucuuuuucauuugguuucuggguaccacugucuuccuacuucucuguuaguuuucugcaaacuaguuuucuuccuucuauuccuugaaugugguuuucuuuucuuucuuucuuccuuuuucuuuucuuucuuucucuguuucucucuuucucuuucuuuuuccuuccuuccuuccuuccuuccuuccuuccuuccuuccuuccuuccuuccugcucucccuuccuugucucccuuccuucucucccuuccucgaggucucgcucugucacucaggcuaggggguacagcugugugaucauagcucacugcugccucaaauucuugggcucgagggauucuccugccucagccucugggcaggaggcuaagggacuacaggugcagccaaccaugccuggcuaauguuuuauuuuuaguuuuguagagauaggguuucaccauguugcccaggcuggucuuaaacuuuugggcucaagugauacucccccuucagccuccuaaagugcugggaugacaggugugaccuacugcuacucccaaaguacugggaugacaggugugagcugguugucuuucuuguacaucuugcuuccucucucuacacauuuguuuugggcaaucucauccaugcugaggguacugaaugcuuauuuccugauccucuaagugaugaugacucccaaacugaguuucugagaccucucuguuggguucuggacuuguccauucagcauccucuagauguguccacuugauuagauccuccuauagcccacagagacucagucucaaaauauccagaaugcaguuuguauuuugcucuugaaugucagacuccuucaugaaaggugccccacucacacaacaucaaaacuagaaacacugguuucauucuaggaucuucccguccacuuaacccucacgaguauuuguugaaugucuguggaaucuaucuguuaaggaucuuucuuuuuuuuucuuuuuuuuuugagauguauucuugcucugugcucugucacccaggcuggagugcaguggugugaucucggcucauugaaggaucuuucauaucuacaaugcuucaucacugucuuccucucuuucuaugcauucugccucugucuuaacagaggcucccauggcugguugucuggcuuccagucuuuucucuggugaaugcaaaccugaucaaguuacgcccuggcucuccauagccuucagggucauguugagucagaugcucccccuggcagagugcauugggugcucaucugugcccaccuugcuauugcuggccccugccccuccccacugcaccuguccccuccuggguccuucgguucagucuccgacaccuucguucauuugguguuauccugaaacuuccuuuuuucccuggcuccuguucuucccccacuucuucaccuuacuggcuucuacuuauccaucaaaauuuaauuaaagcauuccaucccugggaggcgcuccuugucaagccagucagguuuaaaaauuccccucagugcucccggccucuuucuugcuaucuguucugugaggcagugugcuuuaagguuagcagcaaugacuuugggacagacacauaauguuuggggucaaacaccagcucugccacuuccuggcuguaugaccuuggccaggcaacuugcucacccugugccucaguuuccucguuuguaaaauggagaugugaaugcuaguaugcacuucacagggugguuaggagugugagaugauucacguaaaacgccuggaacgaggccugaaagucugaaugaagcugagcuauuuuuguuauuaucauaacuccugaguuacuugccugcuuucuaaaacaaacagaaagaucuuugagggaaagaaaucacacuugauuugacuaaauuaccucagcacuagcacuguaccugggacauaguagauacucaguaaauacucauuaaaugaaugaauaaauaugaauaguaaauacaugaaguauaggguuaaaauguuaccauuaaagcaugcuaaugagugagauugcccuaauuuuaucucuguguuuuucuacuugugcauaagaugcugaugguaucucauuaacuuaguguacacugacucauuguuuucugagucgagaaucuuccacucuugacagaagggcacaauguaauuaauuaacagaacugucauucuggaaagcaauauguagucaugaacugugaccaaauuccucugagacacgcuuagagaaaaaaaaugugaauuccuaucagaaagagaucagaaggccuaacaagcuaaaugggaaaaacauagagacaguucuaaagaguuuaacuucagaaucaacguuuccugaggccccucugguagcccgccacuguugugaaaacaauuagguuugcagagugauuccucacacaaggaagugggccugagagaauucucuacccaaugucucaggaauccugauggcgaagugucugacugaaaaaguaugaucagcggccaggcgugguggcucacgccuguaauccuagggcuuugggaggccgacgcggguggaucacgaggucaggaguucgagaccagccuggccaagauggugaaagcccgucucuacuaaaaauacaaaaauuagccaggcgcgguggcgggccccuguaaucccagcuacucgggaggcugaggcaggagaaucacuugaaccugggaggcagagguugcagugagcugagauugcaccacugcacuccagccugggcgacagagcgagacaccauaaaaaaaaauaaaaaaaaauuaaagaaaaagugugauugaugagacagcgacagcaacaagccuccaucauggccauuuuuuucuccauguucuucaugaaagcaccacuuuugguuugcuuuguaguuuuucuuaaauacagaagucugccucccucuccaugaggcuccuuugaacccugauggagaugacauauaaugaugggcaucuaauaugugacauuuuggggaucgugaaaaugucuuuccacccucucugguuauuaguagauacagggggcucugagggaagauuagaggcucgaaucugggucuugaacguuucacauguuuuugcccagaguaaaggauacagugaaaguaaagguauuugacaaaaggaggcuguaauucauacugugaaccaugggccacaugguuuucauacuguggaaagaccuggaaaacucugaagacagcucuaaagauuuuucauaauuagaaauuaguggcugggugcaguggcucaugccuguaaucccagcacuuugggaggucaaggcaggcacacugccugagcccagggguuugagaccagccuggccgacauggcgagaucccgcagugacaaaaaccacaacaauuagccaggugcagugccacgcaccuguagucccagcuacuugggaggcugaggugggaggaucaccugagccugggaauucgaggcugcagugaaccaugauugcaccauugcacuccagccugggugacagagugacacccugucucaaaaaaaaagaaaaaaguagaagaaaguagagaaauucuuugaccccgagggcugaguagaaacaccugcucucccucuaucuaguauguguuccuucuuacccaggcguggcuuuacaaaacuugaggacauaaaauaaagaugggggaauccaagcacuuuuauagaaacuuacagaaccacucaaauauagaacuggcaauuuucuuuuguggccauaaaaucuuucuaaaauuugauccaacuuauguagaagucagaaaauaguuugauucaguuaguuaauuuuaacugagggaagcaagaauccccuuucaauuauucuuauccagaauucaguaaaggggggauuuuaauuaauuaguuaauuuuaauucuaggaccaggauagccuuagccucccuuucaaucagaccuggcucagaucagaucugccaugggcauccucagaagaugauaauuacaauaacuacuagauaccaaaauaaaugccuuaugaguauuuaaauucuauucucaucacaaucccacaaauuaacauuuccuuuuuauaaaucagaaaauuaggauucaaagagauugagcaauuuaccugacgguguggaauugaaccuaagaaugcuacugugaauccaauagcauuucagcagaaaugggaaauggauuugggaucauucucagaccagacccaggaacauaagcacucauuuaaaggggacagacuuggcaaagggagacuuuuuuuucugagacggagucucgcucugucacccaggcuugagugcaguggcgcaaucuaggcucacugcaagcuccgccucccggguuuacuuacgccauucuccugccucagccucccaaguagcugggacuacaggcgcccccgccaccacaccuggcuaauuuuuuuuuuuuuguauuuuuaguagagaugggguuucacuguguuagccaggauggucucgaacuccugaccucgugauccacccaaaucagccucccaaaguggugggauuacaggcgugagccaccgugccuggccggaagggagacuuuuugauaugcugaguguaaggcugagguuuuguaaagggacaggggacauagccuggccucguccuugugguugaucuccccgacucucacagccaguggagucucccugacucucacagccaacggaguucaacauuugcaaauaaucaacuggccuggaagucaggggauuguaacuuccuaaagcugaauuggggcccugauguuuaaaggguccagguagggcaagcauugcgcuucucaagucuugugcagcuaacccccaccuuccacugacggagcuccccaagccugaacgcccccuuaggauguuugcuccaaggccagcugagcugagcuaagcagcauccucucuugcucugccucuuauugucucuguaucuuuggcuaaguacaugacauccagaacucacuugcagagggugggcagguguggguccucuguaggaauccugcagacucugugucauggaauugcccaguccuguggucuccguggccuccugaacucacacggaugucacuaguuaucauuccugucuuccuugaccuugacaugauuuuccucacucccugcuccucgggucaaugcacacaccccucaccuauuuuugacccugucucuuuggaaaacagccacacaagacaugaagcugaagauaaacauuccucucccacauucucagggcgguguguucucucucaucuucuugacuaauugcuugagaaucuggaugugccugcuucccugagagcaucccaaggacagggacugagguuggagcccaaacucaggcuuguguguccaccucuaguccugcuccuggaacaaaggaaaccuuccacguuugaaucaaaaggccuuccacaaucaggacccggaccacccugaggugacgaaaguggcuccccaugaguugacaagcaacuuauacucacacuucagcuccagcuugaugaaaucuuccuuucccauauuuucaagaaacacuccccaggggguuaauguuuugaaguagaaagaaaugucagcgcuaguuuccccuuggaaaguagagaagugcagguaggaggauggguuugggaaagaggcggcauuccaauaauucccugugggaagaaaacaaaaaaaucagguuaacucacacccugaucagccuagucauguaacagauacccauugcuugaguuuaauaaguaccauuagcaauagucauuauuuucucucauucuguugaacaacauuggaccaaauccucacaaauauauuuuugacuuuccaaaaguuauaugugugucuauauaauauucauuuacauauaaagauauuuaaaguauuaauauauacaaucuauauaaaauuaaauauuaauauagaauuucuauaaauuguacaauaaaauauuuuauaauauuuaugauaaacaauauuuuauaauuauauaacaauaaagauugauauaguugggguuccuaccaaggaguccuaugggacucuaagaaguaaaugccaauagacacaacaauugggagaagccccugggguuacucugugggugggugggggcuguuuugaacuccugcauauguacugguagcuuuggucuggugcaagcagcaucugagauaaaccucaggaugacaaaguaagaacaaaguuuuugguaguuugcucuugcuuuucauccaccucugccuuggaagagccagugcucacuccugugucaacggccacccagacaccuggugcaggugcuucaggaauacaacugacggagccuggaggaggugaggagccgggaacgaggcagaagugaccagacuaggcuagggcaguuuccucaccucuccugcgccaaacucucagaggugaguugccuucucuucccuuccuacuuccuccuggggacugcaggugaggcucuggccugugggauuguuguauaguauggggaugaggcagugagcccaccaaauggcucucagccagccucuguccuugagcucuuggagaagaugugauuguaccagcugccucuccccacucauugccugacagagcagccaguguuuccaggagaaaagcagcucgcaggaugcaauaaaaacaccaaacugcguuacucagacuccauuaggacagauggacuaagaauuuaauaugggaucaagaguuggcucucaacuucaucuucaggggagaaauuccuuuuuaaugugcacauuucugaguacacuuacugucacagcuaaagacuaaaauauaugggugugauuuaaagcaguuacuaaagccuugagcucugauacuaaacuccaaauguaugcuuuuuaaaaaacacgguauuugcuauaucuuuucuccaaaaggcacaaugaaucaacuaagugcacuccauuaguuucuauucauacacaaaugauauuuuuccuuccuuuuaugcaaauuauacacauaugcaauauuaaauugagcuacuauuuucaaauaaaaguuacuuuguguugguucugccaugcuuaagucauaauuuuaaauuaugaaauauuaaaauauggucuuauuuaauuaaugcuguuuguuuuuguuuuuagaaaugucuagaauauagcaacaucuagauaaguccccaggcauguuaaaagauaaacuuaggcauauuaaaaucuuaacauguuuauuuggacauucagugauucgugaauugggcagcaccagaauucaaguugucuacuggggugcgggguuggagagagagaaauguguuuguggaugcaagacaaagaaaccguuugauugguuaauguggaaagucuuuaguuagagguuagguggugguuucugauugcugauaagcuuaguuucguuucaguauuuacauugaagaggauuuggcuugcuucccuagguaucuagggcucugaagcugucucagccaauggcauuccuauuaauuacugucgcagguaauacauaaacagggaacuagugcaaaauauguuuguaaauaucuucauuaggguaaaaacuguucuuaauguguuccuaaucuuagugcagucuuaagcuucuucuuuuuuuuuuuuuuuagacagagucucgcucuguggcccaggauggagugcaguggcacgaucuaggcucacugcaaccucccccucccaggugcaagcgauucuccugucucagccuccugaguagcugggauuacaggcacacaccaccaugccaggcuaauuuuuguauuuuuaguagagacgggguuucaccauauuggucaggcuggucucgaacuccugaccucaagugauccaccugccucagccucccaaagugcugcgauuacaggcaugagccaccaugcucggcugcuauuuuuuuuuuaaacaaaguauaaaaucauagauuucaguaggagaaaauaggcaaauagguugcuuucuucuuggggaggagaauauuguaugauguaguguaggcuacugguaacaggaacagaaaggcgcuuugcaaagcucaaguugcuaguuaucaaggguaagccuuccuccccccucaacaucugccuuacuacacagcaagaggcguucaggugcaccucugugagaaaaccuaaaucuacgcucucgcucaucagagaguccugaagcugggagggaauaaagaugaggcccagggccagaaggauucagcucauccuaauugggugagagcccuuuaaggacccgagagccugcagagaucaaaguccccagccagacuucagccuuaagcaaagcaauucugucucuuuaggcuguauccccaggauacgaaugcaauuaacauuuuaaaauuucaauccaaucaaguaccuucuuauuuucugagguggugauguauuaacagaagggcaguugucuaaaaugauucuagaaaaaggaaagcuaaaaguaaaacaugucaguauuuauuugaggcccagcacugguuauucagacagaaauauccgcagagaggagaaaaguaguuccaucaguuauucaagugugaugaaauaucucuauagaccacaauuccauuuauucuaauucuaugcucacuaagcaacuucaaucuaauuugaucucuugaauagacucauucacggggaagucaugccuuguacaaaugguuuuucccacuauccuggaaacaucuggauuaucacaugaugcccuuggaguugucaauugugaguuaucucaaaucucuggaugagcuuauuaaauccagauucuucagaagcaacagggaggacuccacucuggauuagacugaugguaucaaaguaggagugcggcucaggaggugccaagggugaucacuggggcucaggcagaugauguuagaacuucugcuuuuacuuauuuuaaaaauguuauccuuuaauaucgauuuuaguuauacuuuauaauguacacuauauaaaugcaguggcacauggaugggauuuguaaguaaacaugcuuaaugggauguggacuuacaggcuuucagugagugugguacaaauaauaaaucauggaugcuucugcuccagcccauggucaccaucucugaguccuguucugaggaaucuguugcccaaucucugggauuuuuuuauuauaacaagauuauaugcgugccuuuuccagugcugauagcgcuucuggaugcaaagaguuauuauuguuuguugauacugcucccaacugaucauagacuccaugaaagccggcaugaaaacauuuccucucaguaaucuucagccucagaauauagucaccauucauaaauaauuauucaaucaauacauaaguaacucauugccccucucauuuauauccauuuucacuccuuuuacaaaguccucaugagacagaauguucuuuuugguaaccuggguguuaaagaugcuaaauaaauauaaauaaaaacuaaugcugcuuuagcaccuacugauaacuggauacugcuuccacuagcacaccauaauucuccuuauccauggcuuuauuucuauaacucccuauagacuucauugaacaauaccaugcauuugcaagacugaugguaucauaaccuuaagguuauugaaaucacugcaauuuguacuugcuaccaaggucagugcuauggagguaaagugacaaugggugagaaugccaagcugggaauaagagauucacuauauggcaaagagagugccaaaggagguggcagggaccaggccagcacggauaaguggaggaggcaaggcuggaaacugagagggaagauaugaaagaugugagacagaacagaaauuagugucugagacuggaagggucagucaacaguaacagaauaaugaggcagguagagagggacuggagacccagcccggggcuggagucaaaagcuuuacagaaugaucgagaugacacugaaggcucugcagcuuggaagugagucaaucacaugagaagcuuugugacugcauguuaggcaaggccagggcucaucacguguggcaagaggaaccagggaggcaccucuagcuagugcaggagagcggggcugagccugcaaagcaggcuugcuggucuccaucaucacaucauuuuaaaccccaauuaagcaucaauagaaaaugcacuaucauaucuucacacaaauuucauagcagccacuuacuugaauccgaccagugauuauuugguauuggauaugguuuaaaucuguguucccacccaaaucucaugucuaauuguaacccccaauguuguggggccuggugggaggugauuggauccugggggcgguuucucaugaauaguuuagcaccauugcccuuggugcugucuuugugauagugauugagugcuuaugagaugugguuguuuaaagugugcagcaccuucccuucucucucuugcuccugcuccauccacgggguauguguacauccccuuugccuucugccaugauuguaaguuuccugaggccucccaagaagcggagcagaugccagcaucaugcuuccuguacagccugcgggaacugugaaccaauuaaaccucuuuucuuuauaaauuacccagucucagguauuuuuuuacagcagugcaagaacagacuaagauaguauaggauuccaacuucaagcuuucugagcacauuuucugauggacagcauuucauuuucaaccuaauuuuuguuucuaacaaaguauuacauguacauaguuauaaaagucuaguggugcuaggacuaaagcaaaaagcaguucccugcuucccgccccuucccaauuccuuagagacaccuucucacacuuuuaacucuuucaauuaaacagcuguauuuuuuuuuaaaaaaaaaaaccucuggagcuacuuauugauuuauaccuuuuagauauucucuacugauuuuccugaauauaagaugagaauuuagcacuuuuauaagccugcuuccccagccccuuucucuauauucuccccaaauagcuaaaucacagauuuuugguuauauugaaauucaagcuuggcauggugccucacaccuguaauugcagugacuggggaggcugaagugggaggauugcuugaggccaggaguucaagaccagccugggcaacacagugagauccugucucugaaaaaaaauagcuguguaguucuagcuacuuggguggcugaagcaggaggaucccuugugcucaggaguucgagguugcagugaauugugaucaugucacugcauuucaaccugggcaacaguaagacacuauaauaauaauaauaauaauaauaauaauacuaaaauuuagcacaguauucauauuuuaggacuauguaauauuauuuaaaagccaaccaauaaaaucuacuuguauuuucuuuaaauuguauuuucuugcauuuuguuguauguaauuguauuuucuuauauuuuuguuuguugcaauuguauuuucuuguauuuaguuucuuuaaaauccauaauuauuuuuuucauuugcuuauuuuucuauguaucugccacgaauucucuccagauucucuaacacagcaguaaaacucuucucaaacauuuuccaacauugcacacaucaggccaucugcagucacguuuuuguccccuggaggcaucuucuauggcucucuuuccucuguucccaccuggacggggucuucucaggguuccugcacagcccuuguccugggaccucccucugccauuagugcagggacuuccuuuugccacacuuugguauuacauccccaaguuucaggaucucaugacauccacuuccuaggucuacacucucauuuuccugaaacacauucucagguagcuccuugagaaaagagauacucgagguuaacuuucuaaacccauguuccucugaugagucauuauucuacuuucgcacuuaauugagaaacuccagaaagaaaauugucaggcugucagggcugcuaccgggaaagcaacugcuuucuguuuacgaagccuuauaugcaaccuacauuuuuuuccuuucuggaaacuuucaggaucuuuucuuuaacucuuuuaauuggaacuucaugauugccuugauauagauuuuucucccauaugaggucugagacuuuaauaauuucucugaucccuuuucucaaacaccuauuuauuuuagauuuuuuuuuuucuaauuuuguuccacauuuugaucuuuuuccuuuguguucuacuucuuuggaaauuuccucagcuuuauuuucaauacugucauuguguuuuaauuucagcuaucauauuuuaaauuuccaaguauuauuucucguucucugauaguccccuuuuucauagcaccccauucuaauuuuuuuggaggcaauaucucaauaucuucucuugucucucugagaauauuaauuuaauuaucaaaaguuuucuucugcuuucucugucgccucuguuucuucccagaccuccugccacccaccccuacccuggauugugaguuugggggucccuucuuuuaugacaucucugacauuauccuacauaguuggugacucucaccugucuguuuauaccgaacagucaaguacuagacagcugacugcaaucuggagugugugugucugggauggugguggauuugauguuugggcuucaugaucacauggagaguccccugucccauugaagggacuccgaaugucaguaucugugacuuguuuuggucacugaauguucaauaucuugagagaagaauccgcuacuuuccucaugaggaauauaugucuguugcucagugcuugggaagcugacaggaagaaggcuaaggagaggggucaaccuuauuaagucaauuuccucuguuuuuauuaaggagcuuuacccccauuuuuuggugccuggugucuggagugugaacccccacuuccugcauggguagaguaggacagucacuggcagggucauagcggggagcuggggugugacugacccucacauagacguuccgccauuccuccggcucugagcccggcccuugccugccuccgguuccugggccucuuggagcuccacagcuugcuucccaccugccugucaacagccuggacuuacagauuuuccuuuacugccaguagugaaguaacugaacuugugaugugcugaaguucuuucguggagaaugaagagaaggagguaacagacugaagucacaguccaccuguggguccagcaagagcccuagaagcauuggcgcgggugguacuaccaggaugaggugguggggggugggagugaugacaggaagugagucccugggcugcucugggcugucaccuggugaagcuucccugcacuguuuccgugugcaggcugaggaagccgaccuccagguucccauucuggcucuaccaucuccaccuacugggcaacgugaggcagaucauuuggccuuccuaaauccucauguguacaguggaauuguggcagaccaggucuuacuaaugcaggccuccauaacaacuguuucagcacugacugaaugguuaaguuaaauauuaaaagcugaaagaagcagugcccuuauacaaagguuaggauguaacaaaagcccaccgagaguuugccuaggccuuuucuggaccuugaaacauggcaagauaaugaaggaauucuuaacaggaccuguuuaggauuaaacaaguuucauugggggucugaagaaacuccccaggccuccacaaacaaguuuaaugggggucugaaggaacuccccaaaccuccaugauuuagcaggagacaagggucauuaguccagcaucugaacccauuuagauuaaguaaauuuacugaggcuccagaggaaggucuucaggacucagaucuuaguuauaaauuaaaagaagugagucacuuaugucuuuagauaaaugcacacuuacucauagacauauagcuuacaagguauguaagcucuggaaaacuuuguaaguuugaguugaucuggcgauaauuuccagguguucucccuguacccaguuacagaaauagaaucucaacgccuguaaucccagcacuuugggaggccaaggcgggcagaucaccugaggucgggaguuugaaaccagccugaccaacauggagaaacccugucucuacuaaaaauacaaaguuagccaggcaugauggugcaugccuguaaucccagcuacuugggaggcugaggcaggagaaucacuugaaccugggaagcggagguugcggugagccgagaucgcaccauuguacuccagccugggcaacaagagcgaaacuccaucucaaacaaaacaaaacaaaacaaaacaaaacaaaacaaaacaaaacaaaacaccucucuucuuucccaguucaucugcaucucuuauuggguggugagaauaagcagcucgacccuauuugguccaggaacagaauaacaguggaaccucuuuuauaggguaugguaagaaucucaggagauaacccaugaaauacauuuagcagagugcuaggcacaaaacaaaagaucaacaaaugugauuacuuacuacuacacugauauucuuuaauuucacuuacagucagccugugcaagggcuuggccaaggaauggggaaagauggaagaggagccucuuuuccuucaaugugugaacaguaagacgacaaacccugaggcuuuuccccugagccugauuuaccacagguacuaaugcuuuuuuagaaaucauaaauugacaauguauaauuguauaaauucaugggguacaaagugauguuaugauuuaugaauaugaagugaaauaauuaaaucaagguacuuaacauauccaucaccucaaauacuuaacauuuugggggauaagaacauuugaaauucauccuuagcaauugugaaauauacauauucuauuacuaacuacauucaccaagcugugcaauacaacuuaaccaaccaagcauguuccuccuaacugcacucuuugaccaucuccccauucccugcaccuuccagccucuguacccaccaucuuccucucugcuucucugagucuguuguuuuagauuccacucaugcaugagagcuugcaguauuuguuuucggugccuggcuuauuucacagagcauuauguccuccaguuccaaccacggggagcagcaaaccccaggauugacagcuaagccugcagcggucacuuccucagcugguuuacuccucucaaccucacccaugucugcccuuuuguccucgucaucucuuuccuuccucugcucccucacuagcuuccaaaacucuguacucccuaucucuucaucuccacugauuuuuuuuuuuuuaauuuuuugguaauuccauucaggacacaugaaucagagcuaucauccuugagcaccagcccuguguuacgcuuuguagaguagccauuaaguaaaaaucugaugaaaggaggagggaccugacgacuaagaagguagaguuacccaagcaauggacaugauugcauuugaacaaauguuuacgggagauaacugcagaguagcagagacaggugaugagaaguagaggcccugccuggugugccugccccugcccugucuccucccuccccagaggggagauggggaauuaggaagggggaagagaugguggcuagaagagucugcguuuggcucgcauggagaagacugcgugaaggcacucugggcugcaguuuggugaggagugucgcugccaggcuggcuccaguggccaauggucuugucauuccccucccagauugagugauuuccucaggucaccaaauggcucacacuggggcugcaccuagaagaauaucuauagcuucugcuguaaauggcaaacaccuuccaauguaaauagcagcucugaagagacuaauuacucugaaaauuauuagugacccaaauguuagagauuugcagauucucugaguuaugcaaagggccuucuauuguuuccugugagcuggggacuguggacaacaaucaaccagauggcuucauuugcaugcaaauuugagucuauuugucaagauuuccuuacgggagaaaaaaauuacuuccuuaauuaaaccuuuuuuguacauucagguuagguaagaggagcuuuguucagcucuaggccucauuuuauugggcaagcuucacuuagaaugaagggcugcaaguuauuaauaaaaugcuguccauggguuugagucagccacucucucugcagcauuucuucccguccagcaagccuguuucacggcugcaacacaaaaugaucagaggacaaguuugcgggaggagucaacaacauaaauauuucacccugugugucucugugauucggguccuuugggcuagaauggggauggggucccacagagaaaaagaauaugcuggugaaagcaguugaggugcuuccugcacugcugugagcugaccuauagccagguucuggggcuugugguaaaacgggcuuguuccuagucauggaaauucuuacaugucaaucccauuauuagugcauuuaaauauaaaggguacuuaugagguaauuucgguacauuuaaaauguuugaaacaguuguguguuucacauguuuggagggugggaacaagucuaagauuuuuuuaugaagcucuucaggcucuccacauuagggcucuacaauuucccacuuuucauuuggggggcuauuauuuaugccugaguaauccuaggucuaccggggcucaaaguuaauaacuagaagcggagacgugaauagcuaggugugucaugggaacuuguggccuuccuguccucacuccaauuucuguccuggguaagcccuaaagguugcuaugugauugauuccagaaagcggggaauaacaagacugaaucuuuuacacccuggcaaagaggggaagaagauuuagcaagaaacaaaguuuugauuuaguaaaaauaagacuauguaguauuuuuugcauguagagguuguaaaacaaauugaugucugcuuccuguagguuaaggaguagacuaucaggcuggccauaguggcucaggucuauaaucccagcacuuugggaggcugaagccgguggauugcuugagcccaggaguuugagaccagccugggcgacauagugagaccucgucucuauuuauuaggaaaaaaaaauauguauauauauauauauauauauauauaucucaaagugugcaguacacugaagugccaugggggugggggugacucuggggaaugacaacuucaaaauguuccugugucccagggaugaauauuuaugcuuuuuuucuuuuccugaguaauuuucacccauuucaugauuucaaguacuaaucauauguuaacgauucccaaauuugugcauaaguuagaucuucaguauaaaucaucaagguaaagcuguccaguaagaaaugccuauuuuagccuuaaacucauaguagagaucuaacucuaaauaucugaaagcaagcauuuuucuuccaaauuaacuauauccacaguauucuccaucucagaagguagagcuuuucccacucugccauucaaggcaggaaccugggagcccuuccuuagcauccagucaauccccaaggccugauagccacaccuucuaaauagucugugcugugucuccuccucuccauuccuucugcugccuuggcucugcauugucucuugccuggauguggcagcagccuccuaacuugguucuguuccugcugcugcucaucucaaauucauccuugauaaagccaacagagaaauccaucuaaaaugcaaaacaaggccgggcaugguggcacaugccuguaaucccagcacuuugggaggccgagguggguggaucaccugaggucaggaguucaagacgagccuggccaacauggugaaacccugucucuacuaaaaauacaaaaauuagcugagugugguggcaggugccuguagucccagcuacuugggagaugaggcaggagaaucacuugaaccugggagguggagguuguggugagccaagagugugccauugcgcuccagccugggcaacagagcaagacuccaucacaaaaaaauaaaaaaaaaaaauaaaaaauaaaauaaaaugcaaaaccgaccauuucacucucaugcaucaaaucccaacgguuccaaauagcuugcagaauauauaguauugcaagcucggugacauggcauaguaagcauaggccugcuuugccagccuuaucucuuucuacuccuagccucagaauguauauuucagcaacaugcagcuaccauuguucccaccaugacaaugguguguguggauuccagcuuuauuugcacuguuuccucuuuuuggauugucuuuuucuacaacauccuccccuucucucucucaguucauauaccacauuggacuugauuucuacucauucuuuaagacucaguucagaugccaccuccuccagacagucuuucugacguauccccggacugggcaugguacuauuucccuguccuccuaggauaucuuguaucuaucauugcaucuaacuuguuauuauaauuacuuucauguguuccucuccucugcuaggcugcaaauuucagagagcagagauugugcuuucuauauauuucuaacuguaauaucuagcuugacacacagguauucaauauguguuucuugaauaaaugaaaauaguguguuuuuuuuaauaaauuugaaccaugggaauuccacuaccaguuauuaucauugcuugacaugaccaucugcaaagccuacuuuugacaguuucagaauugaagagcuauuuaacccauauggacagaagcuuuucuagguuuggcauuauuuguuuggauguuuggacacacucagcauuucccuucucagauaucugauaugcuagucaucuucaccggguccucaggugguacugacaaugaugggugacaaugguucugagaacugccagcccugugaacgucacuucugucuuuauuguaucuccuuuuggcaucuaauuucucuuaccuccaucucucuucauauaauuggaauucaugaucuaauagcauuaaguuuccauuuuaucaucugcccuguuguaaugaaggauggucauagcugagcuguaaaaagacugagcugcauuuagcuacacuccaccacugugcagagcaggagugcuguaaugccaggcagccuuuauguguugauagacuacaaaaccuccagagccucacauccauagaaaaacagguuuuauaucaaauccaucaggugaguaaaauguggaaaaaagccacccauuucagcagaaugacggaugugaaacugggaaacugcucuauacccaggguaauggguugauaugauccauacgauuacguuacacaaaucaaaguuuccuuuuugugcucuuuucauuacaggaaauaaaaagauucacauguccuauuaauagaaccaugauuuuccugcugaaaacaguaacagaguccacaugucucaggggagagcaggaucaguaaagcaucaagauaacccauagugcaaagaaagagagacgaggaaaugaauucagucuucuaagaccucaguuucuuuauuuguaaauuagaaaaauaauucuuucuucacaggguuugugaugauuuaaagcaauaacaucauacagaagcauuuugaaauaccaaagaacuauaaaggccaaaaaaucuugcugauauauuuuaauaauaauagaaaaauaacaaagacuucuuuguaggcaggggugagauaauugguuuggauuuuuacaaaaugugcugcaguuuccuuagaauucauauauccucaagaagaaggaaauacuauugaaagaaagccugcaaacaaauuccauucaacugcuaagugaaaauaauuucugauauaaaaauaaauagugcauccaaacggaaaugaaugcucugauuuuaaggauaaaaagaacacaucugagagcgagaacgauucuguuuugcaacugguggccuuuguugcuguuuuuagugugaagcauuggagcuuagacacacugugcuuugcucguaaucauccugaggugaggauugaaaauggaauucacauugaugacacaggacauauaugagucuauauuaagacuaacagaaguuuuacaacuuuguguuacauaauuaaaauaaauauaaugugaaugaaguaauauccaguaugcagauuuagaacaguuuuaauuucaaagaaaucugagaauuuguaucagggaaagacagacugcauaaguggugccuggaauaaugaacaguguguucaccagaaguugcugcugcguggaugaugugaaaggagacccccaaaauuacuaagccaaagggaaaagucaagcuggguacugcuuagggcaaaccugccuccacuguauuccuaaaaacgauagcuacuaagauaaaaaaaaaaaaaaagcuacauaccucccucacaaggaauauccuuguggacaaaggacagacacaacucaaaaucacuccucugcucacugagauaaacgcauaccuguuugccuccuuuggaaaggcuaaucagaaacucaaaagaaugcaagcauuugucucuuaccuaccuaugaccuggaagcccccuccccauuucgaguuguccugccuuucuggacagaaccaauguauaucuuacauauguugauugaugucucaugucucccuaaaauguauaaaaccaagcuaugcccugaccaccuugggcacaugucaucaggaccuccugaggcugugucaugggcccgcaaccuuaacuuuggcaaaauaaacuuccuaaauugacugagaccugucuuggauauuugggguucaacaaugguuaccacagcacuacaggccccaaagcuauaugcaaacugcacugagggucuggcugggccacaacauaaaagauuuucacugcacgaagagguacugcugcaauccaaaauggcggcacuuccuucuacauuuauugagcagaaugugguacaaaaguacgugcuuggauaaucaaauauuaaauaaguuauuacaauaacauuuaguauggcaugccaauuugggauuucacuuacauuucccgcuucaauauuucaaguuguaaaauugagguuuugcauucaacccagcaaucccauuacuggguauauauccaaaggcguagaaaucuuuguauuauaaagacaccugcacacaaaugugcaucacaggacuauucacaacagcaaugacauggaaucaaccuaaauguccaucaguagcagacuggauaaagaaaaugugguacauauacaccauggaauacuaugcagccauaaaaaagaaugagaucaugucuuuugagggaacaugcauggggcugaaggccaucauccccagcaaacugacacagaaaaucaaauaccacauguucucacuuauaagugggaguuaaaugaugagaacacagggacacaaagaaggaaacaacagacccaggggccuacuugaggguggaggcuggaagaagggagaggagcagaaaaaauaacuauuggguauuaggcuuaguaccugggugacaaaauaaucuguacaacaaccccccgucacacgaguuuaacuauauaacaaaccugcaccuguaccccugaaccuaaaauaaaaguuagaaaaaauagaaguuuugguccucuuuuuuugccuuagacauaauugauagcaauggggaagacugcauguucagaaucuggcuguuugagaaucuuaauauuuuuaaaagugaauuuaaaugauaacaaaaagcaaagauuauagcuuccccugccauagcauggugcuguggguuacgcuaaucugaaacugaguagaugguggcauacucuggguuuugaaagcaauucucuccaacagucugacagccacccagagcacagcagcuuugaaacauguugcauucugaccuuuucccagucuaggggcucuggacgaagaacaagggcucuaaaauuaagauuggaagaugcacaaacaaagcacugaauggauuccaagggaaccaaucucacauuucacuucugcagaacuuuaugggaaguuuauggggauuuauuguuucaagaacagaaggacauuuaccuacagaugcaggggaauaaauuucaagugcauuuaguacuggagaauggucgcuuuauugcagauuucaauccacuugguuuucuccuuaaucuuuuaccuucuaccucaaguagaacaccacacacacacacacacacacacacacacacacacacacacacugaacuuuuuaguuuugugcuuccauggugugagugauuuguuuguuuguuuuuuaauuuuauuauuauaauacuucaaguuuuagaguacauguguacaauguucagguuaguuacauauguauacaugugccaugcuggugugcugcacccaugaacucgucauuuagcauuagguauuacuccuaaugcuaucccuccccccuccccccaccccacaacaguccccggugugugauguucccuuuccuguguccauguguucucauuguucaauucccaccuaugagugagaacaugcggugguguuugguuuuuaguccuugcaauaguuugcugagaaugaugguuuccaguuucauccaugucccuacaaaggacaugaacucuucauuuuuuaugacugcauaguauuccaugguguauaugugccacauuuucuuaauccagucuaucauuguuggacauuuagguugguuccaagucuuugcuguugugaauagugccgcuauaaacauacgugugcaugugucuuuauagcagcaugauuuauaauccuuuggguauauaaauguuuauaaagaguuucaaauagcaaaaaauggaaguaaccacaauguauacauuuauuacuguauguauuugaagaaacaugcauucauuuggacaaaaaaugugacauaauguggcauaaaccauaaaaucgaucuauguaaauuguccauuguauguuguuaagggacaagcuauuuucagaauaaaauguauaucacagcuccauuuuauuauaguaauauuagguuggugcaaaaguaauugcaguuuuuuugcacaaaccuauuaaguaugugugcauuguuuaugugccugauacaaagauauguguauauaccccacauauauaauaugcacauacacgcauaugcauacaugcaucuguauguguguguauuugcuuaaacucagaauaaaggacuaaugucuagaagccuucacacacagcuuuaaugguggucaccuuuguggaugguaauggaaaggauucacacugggaaggaccuagguguuucguucauugauuuauuuguucuguaggaguuuagacagaacaaaaggaaaaggaaagaggaaggagaaggaaagacaagaguccaacaagucuucaaaagagggaggagcguggccgggcgcggugucucacaccuguaaucccagcacuuugggaggcugaggcgaguggaucaugagggaaggaguucaagaccagccuggccaagauggugaaaccccgucucuacuaaaaauacaaaaauuagccaggcaugguggcauaugucuguaaucccagcuauucagaaggcugaggcagagaauugcuuaaacccaggaggcagagguugcagugacccaagacugugacauugcacucaagucugggugacagagugagacuccgucucaaaaaaaaaaaaaaaaaaaaaaccaaaaaaaaaaaaggagggaggagcaaggaggagcucaggaccugacagggaugggaggggcaggguagagaagcgagggcccugggaauggcugaaagaauucaagagugcugugugcuaugcuaggaacuaacugguuuuugaugcuccucaugagauacaaacggaaguuagacccuuuucauuacuuuuguuuauuggacugugauuuugaggagaaaguccauccuggaacuacgcagaugaggguagagaagaccucauccuagaccaacacugcagccauugggggaaaaggggaccuucucauuuauacugaggaagaguaaguuuccugagguuguaccauccacaagugaggccugggugcugcugagguguuccacacuacaacugcccauauccaacacacacacacacacacacacacacacacacacacacaauugcaaugcuuuuuucuugcaaggaauucucacuggccauagcaaauuuuucuucuccaauccuuauuccauuaacauucuaaauucauggaguuauuaauaaauguagcuaaaaucuaugauaauggcauuauuaauaaauaguagcucagacccuucccauguucuaagcaguauuucaacacagguuuuaucucaauuaauucucacucaagugcuguuauuauguccacuuuucauguggggaaacugaggcacggaaaguuuaaugugaacacucgguucuauuuuuacacaccuggguuucgucgcuuccacaauagugcucuuuccacacacaaaagaaugcagcuacucuuuuuuauaaagcaauuucuuccuuccucucacuguccccggcuguucucguaaauagagcaugagcucuuaagacauuccuaggggacagauggccaauaaacacuggauguugaugcggcugugucauccugagccuuuuauucugggcuucccuggcaccugaaacagaugcuacuuuauccuucucuucaaaguucagcuaaaagagauucaaaagaagauuuuucuguaagauucagaaagccugaucuaaggucacccucagccauauuuugucucauauguuuacugagaaccuacucuauggcauucauagcucuggacuucauggaauacauagcacguaaagaccuuauauuuauuuuaaugaaaauuuaaaaaauuuuuuuaaagagauggggucuaucuuaccuaggcuggacucaaacuccugggcucaagugauccuccuugcucagccuccugaguugcuggaacuaugaugcacaccacugugcccagcuaggaccuccuuauauuuugucucugccucugaaaucauccaauucuauucucucacuugcuuauuaggcuccagucacacaagcaugcuuuuuuuuuuuuuuuuuuuuuuuuucugagacagagucucgcucugucaccaagcuggagugcaguggcgugaucuuggcucaaagcaaccucugccuccuggauucaagcgauucuccugccucagccucccgaguagcugggacuacaggcgugugccaccacacucagcuaauuuuuguauuuuuaguagaggugggguuucaccauguuugccaggauggucucgaucuccugaccucaugaucugcccuccucagccucccaaagugcugggacuacaggcgugagccacugcgcccagccucuuuucuuuaaaguaccaagcuuguuccagcuucagaacauguuuucugcccagaacacuucccacauaccacugcagggcugucuuuuucccaucguuuagaacucagucaccaacuugaaccacugccaccuacucaaagaagugguaaauucaaucuagucaucuuuggucauucucuauccauguaauuuuuauagcauguaucacuaccuaaaauaccuguuuuaaaaauuuauguacugcuugcuuauccugaccuaggauaaaaagugauauauacaaucacuuugccuauuuuguucuuugcucuguuuuugacaccuugcugggcacauaguaggugcuuaccgaacgucacugaauuagucaaacauaccaccuugucuccaccaguuugagagcuguggguuaugcacucuaacagccgaggagggcuucaaaagaccgcuauccacauggagacagaguuacugcuugaugaaaucaagccuuguuaucacaucaguaauauuuguugaaguuauuuagaaagaguagcuuccagcuacucaggaggcugaggcaggagauuggugugaacccgggaggcagagcuugcagugagccaagaucgcgccacugcacuccagccugggcgacagagcaagacuccgugccccgcccccccaaaaaagaguagcuuaaaaaugauaucaugugacaaacuacucaacauauuacuaacucuuuauuccaaagucccugauuuaucuugucaaacuauuuaauuuuuuuauuuuuauuuuuauuuuuuaugguuuuuuuuuuuuuuuuuuuuuuacaaaugacacgagcugaauuuaaacaacacauuuucugguugcaugggacacauggaaaggaguuugguagcacugacggggaaugcucauguuaaagagaccaguuguucuaaauuggccgggcugguucaacuuccuaaugcccuguacucauaaagaaguugucugaaaaugugcaacuggguuuucacggaccacgugggaaggguucgguuuucccauaugaacugaaguuugucccauaauaccucacaaagacauguaccacgaugaacaauugaucuuuaguuugcaacucugugcccauuccuggagcauggauuuggcugggagaaggcauucacuagcucuaauaucuccaaguagcuuuauauuauaggaaggucaggcacuaaccagacccuuccaacccuucuccucagacucagagccuguccucuucucucagguuggcuaaugauuauuugaguuauauuaagggauauuaagaucuugaucuuucccaguagggaagcucuuuugcucgggacagggccuugggcaagguuugugcuucaaugcccagugaggguaaauccuuccauuuuauuugccuucauagaccaggcucuuguauaaaugggaaaauuacucacuggacagucuuuaggagugugggaaggugggguuugguuucgaugcucuccugucucuugcagcccugaccuugccaaugugucuccugcuuuaccucuauucaccccuacucucacuauucaucaaccaaaccuuuaugacgugguggcuucaugaauauucaccccuguuuuuucaaaaauuauuuuaauaagggauuccugaaaauugaaauguuuuuauggucuaaauuaaucucuaugugauuaaucucuaugauacaugaaauuucuaugauuucauguaucaacacaaaauggggguacuuuaauauccauggccuauaucuauacuuauaauaauuagcugguuguuacuucucagccuuaaucuauguuucacugugaccacacacacacacacacacacacacacacacacacaugcaugcaugcacgcagaaaaacguucagcuuaagaaucuugacaaacgaggagaugagguuggaauaacauaguggaacaaaaacucuucuaauuccuccacuaacagaaaucaaguaauaauuuccaaaguuuacauuugaccaugaaguuggacauugguguuuuuaaguaggaagauccauuuuuauacuugagaaaaauaaaguauaaauuggaaaguacuuaguaaaaauaaccaugcagaagcaacucucugcgcccugugaaaaaaauguuaaacuacuucaugacucuuucuuuuaauauuaaacuuuaaacaucuuuuucuuugaagaaaauacaugggaaacuuuucuccugcucuaguugacaugcuuaaagagagcaauaaagcauuccacuguguauuagaaaauucugggcaggaggggagaacauuuuaacagaaauaauuugaaaggugggagacuagaccugauuaguuuccacaaagcauaacaacucuuugaaggauuagggaccaggacuaaaaauguaguauuuucuucauauuauuuuuccccgauggugcucuuuuuguguguuucagccugauauucuauuucuguagucaucaguggcucacaaacuuuggugagcaucagaaucaucugcaaggcuugcugaaaaggcagcuugcugagccauaacccuagcuauuuccaaucacucagucuugcaguucuuuuucauuaggaucucagcugccucugaugcagaugaucuuuucuacagaagcucugcaaacacuguuuuggagucuguguacuucucagacugcuuauuagaagccuggcuaauuucgaaguaccguuauuuugaacuuugugaaggguaaacaugacauuaguucuuguuauuggugcagccagaucagagaccucaugcagagaacacagggacgaucugccaaggaauccucgcuccugacugagguuuccaugagcaggaguagcuuggcaagccccacagauacugaacagcgcaggcucaucagcauugaugcagaacgacauugcuuucuuugcaggguuacacuaggaggcaaacuggcguuucugugggucucuggggaaaacaggacugagcuugguccaugguccaggacggaggaaguucagaggcuuggcauguagccuguagcccugauuucugugcuuguugacucaagcucauuuaacuuucaggacguuauucucucucaucaucuuucuacuuuacucucgguucaucauuucauugguuccacugccucuuauuaucucuuaaauauuuacauuccucugagcuccacuaugccacugugcucuucucucuguguaucauuuaucuaugugaucucaacuaucuucccauugauagcuccaucuaugucuaaucaggguccuuccuagagccaagugccaaaauucuaucagaacgugcuuaacuauuaagauuuccuaccagaagcuugcaagagcaagucuaaaaccaaacucauugcgcucagccaagaguggcuucucuuguggucuucaucuuaguaauaucaccguccauauuaugaaacuucagggucucuucuaagccagaaaucucaugcccaugcaaaaucaggugccaaauucugucaauuccagcuccaaagucucuccagucauccucuguuaucuuuucccacugcuuuugucucccugacucuaguaccaccccuuccagaucauccuccgcagagccaacaggaugauuuaacuaaucuauuaaccaguuaaucacagauaauuagcaacacacaucacaaaucuugccagcagauuugccccccaucugcaaggacauucaacuucugucuuccuucuuuucuucuuagucuuaguuaccaaaaacacuauuauuuguaaagaaaaugaugauaaaauauuacagcuaauauuugucuauguuuaauaugugucauuuacugugcuaugcacuuacuaugcauuauuccauauguuucacaaaacauuaaaaaauagaugcugucauuauucuccuuugcagaugaagccauugaggcuuauagagaaauuaaguaacuuguucaaguccccaugggcaguaggagggacuucagagaaaguccgucugaaucuggagccuguacucuuacucccuuucuccacugccuaguuuuauaugguuuaaguaauauuagccacugggugugguggcuuacaccugcaaucccagcacuuugggaggccaaggcaggcagaucgcuugagcucaggaguuugagaccagccugggcaacauugcgaaauccugucucuacaaaaaauacaaaaaaucagccagguacgguggcacuggccuguaguuacagcaucuugggagguugagccugcgagguugaggcugcagugagcugugauuguaccacugcaccccagccugggugacagagugagacucucucucaaaagaaagaaagaaaaaauaauacuaucaagaguacucuuacuauaauacauacauuuaaaauaauuuucuaugaugguggguggacaacgguaauggguuucagacaauccaccuacauucaguugcugaugugaccucaguugggucagggugaauuugucauugugaugucuguaaaacgaagguauguguaagggacaaaauccauggccccagcuuccugacgucauguuuuccuuuuucugcuaacaaucuuucaaguguauuagcuguuaaugacugagggacuuuauagcucuucccauuguaaauagauuggcuaguuaaguauuuuccaaguauguugaacagaauacuaauucuagggaaugacaauagucgucauaucagagaagguuucuacagucaaauauguaugagaaaugcuguauuaaaaauguaaaaauguuaaacacauuucuuuacugcaagagucacguacauugugauuuuccgaaaggaguauauagccgguguugaugcacauauaugaucacaaggcucuauuuauuauuauuuuuucuagcuuuccuuuuuaaaaaaauuuaauuuuuuuuuuuuuuagcagagcucucagauauaucuauuugggaaaugcuguaucaaacagcuaucugguauuucuguucacacagacucaaucuuugguuuaaagcauguggacugugcuauuuauuuuuaucuaaacccuauauauauuauaaaggagcaucauuuucuuuuauucuauuuagaaaguaugauaacuggaacaaauugcugugcugaagaagaagaugugggggauuaucaacuaaacuguuuaucuguguugucagaaggcaggcaccuggaccaaagcuuugugguuguuuuuuuuuuuuuuuuuuuuaaauugagacugugugucuuucuucuuugcaacccucuuugcaugucuaauaaaucauuuucauacuuuaaacaagcucuuuaauuggcugggacagaagcugcuuucugucguccucuuccucuaauguuaaucaaagcauuuauaguagcagcaaccccagcguuacuaaauuaugucuucuugagagauuggagguacaucgagagaacaaaagcugggcaugcucaccauggaggauuuuuaaaucacaguaaaauguuuugaaguucuuuucuuacucaaaaccacuaggcuucggacuagccagugaagccucuaacccccagcagggcaggaggugcugguucacucagagccccuagacuuuccuuuaaguuccuaagugcauuugauccauggucccaauggggcaccugcuuccauuucuucauccauccaaggcaagaacaaaacacaaccagccucuccauuuuuucagggaagcuuuagagcucuccuggccuguugcccuucuggaaucaugccacucauuaagauggaaacacuugaugcauauuccuguguggauugauguaugauuccccagacuagauagaaaacaaggacuuuccccucccaucaaacacaauguaacauucugcuuuuguuggucaacauuuaaccaacaaaugucguggaagaauuaggaaaccugcucccccaaggaaauaaagcagacuggguuuccagguccaggccagagacuuaugcaagcuuucucugcuuuccuuacaugaguguauuugaucuucaguuaaaucacuggcaaaauaagacuuccaggccacuucggagcuauuaacacaugucugccuccuuccucguuuuuggaucugugaugggaauuucagcaaauuaccuccuuccugauaacuauaaauucuuuauuuucaugucucuggaacccgagggaaguuguuuuaucuggauccugugccucuuggccuagucuuuuaacuucuucaugucauaaauacaucaauuuccaagcagucagggaagguuuuccuccuucucccacuacacugcuggauucucuuuugcuuguaguaucuuugaggcuacagucugacccauggagauguuccauggaaacaguucaauauaagauguaacagacaugcugauaaaugguauguauugaagucacuuaagaugaagacuauaaaaagaaugaagaaagaauacuucucagcuuuggauguucuuuauguuuucauguaucauaaauaauuuuuccuuagaauaacaaacauugcuauuuguugacauuuuuuaaucuaaagaaaaauugccuuuuuaauucaugauuuugucccauaugcaucgccuucucuggaccauacaucagccaaaucagguagcuucauccuuacuucauuacuuaucagcuuugagagcugggauauuuauuccaaaaggaagguguaaauuuuuaaaaauuaaaaacuauuugauugacaaguaaaaauuguauauauguaugguguacaacaugauguuuugagauuauauacauauacacauguacauacacaguacacauuguagaauggcuaaauaaagguauuuaacacaugcguuaucugaaaaauuuaucuuuuuuuguaauggaaacauaaaauccacucucauagcaauuuucauauacacaauauguugucauuagcuguagucacuaugauguacaauagaucucuugaaauuacuccuuuugucuaauugaaauguuguguccuuuggcuaagaucuaccuaaucccaccaccucccagucucugugguaaccacuauuuuacucuuuguuccaauuacuucaacuuuuuuacccuccacauguaagugggaucauaggauacuugauuugugccuaguuuauuuuauguaacauaauggucuccagguacauccauauggcuggauuuccuucuuuuugaagcuuccaucauguauauauaccauauuuucuuuaccuguucaucuguugaugggcacuugaguccagaucuuagcgauugugaauaaugcugcgguaaacauaggagugcacuuaucucuucuacauacuaauuucauuuccuuuggauauguagccaauagugggauugcuggaucauaugguagcucuauuuuuaauuuuuugaggaaccuccauacuguuuacccuaaugguuguacuaauuuacauuucuaccaacaauguguaaugguucccucuucacauucucaccaacacuuguugucuuuuaucauuuugauaauggccauucuaagagguuugaggugguaucuuaugguuuuaauuugcauuucccugauuagugauauuaaaccuuuuaaauauauuuguuggcacauguaugccuucuuuugagaaacaucuacucagguccuuuguccauuuuuaaaucaaguuauuuguuuucuuacuacugaauuauuugaauuccuuauaccuuuuggacacuaaucccuuaucagagguaugguuugugaauacauccucucauuccauagguugucucuucagucuguuggauuguuuccuuuguugugcagaagcuuuuuaguuugaugucauuccauuugucuauuuuggcuuuugcugcuugugcuuuuggggucauagccaaaaaaucuuuucccagaccaguaucauagagcauuuucccuauguuuuguucuaguagcuuuacaguuucaggugucacauuuaagucuuuaauucauuuggaauugauuuuuguauaugguguaaaaugagagccuaguuucacacuucuauguauggauauacauucuugaagagacuguccuuuccccauaauuuuggcaccuuugucaaaaaccuauuuaccauaaaugcauuaauuuauuucuggggucuuuauucuguuccauugguauaugugucuguauuuaugcuagucuaugcuguuuuuauuacuauagcuuugugguagguuuuaaaaucaggucaugugauaucucucuguugcuuaaaauugcuuuagcuauuuagggucuuuugugguuccauacgaauuuuaggauuacuuuuccuauugcuguaaaaaauguuauuggaauuuuuauaggcauuauguuaaaucuguagaucacuuuggguaguacugaauucuuaacaauauucuucaaauucaugaaaaugggauaucuuuccacuuacuuguguucuucaauuucuuuccucaauguuuuauaaauuucauuauaaacuuuuaccuccuugguuaaauuuuucuuaaguauuucuuuuuuaguauuguaaaugaaauuguuuucuuuauuuccuuuuuggauaauucauguuaauauauagaaaugcuguugauuuuuguauguugauuuuguauccuacaacuuuagugaauucauuuuuaguucuaacaguuuuuucauggagucuuuaugauuuacuacauauaagaucaugucaucugcaaacagagacaauuuaacuuuuuccuuuccaauuuggaugccuuuauuucuuucucuugccuaacuguucuggcuaguacuucuaguacuauguugaauaaacauggcaagagugggcauccuugucuucuuccuaaucuuagaggaagagcuuucaacuuuucucaauugaauaugaugucagcuaugggcuuguuguaugugcucuuuauuguguugagauacauuuauucuguaccuaauuugcugaguguuuguuucaugaaagaaaguuaaauuuugucaaaugacuuuucugcaucuauugagaugaucauauggguuuuguccuucauucugcuaauguggugcaucauauuaauuauuguauauugaaccauccuugcaucucugggauaaaucccaccugaccaugaugaaugauucuuuuaguaugcuguugaauucaguuugcuaguauuuuguugaggguuuuugcaucuauauucauuaggaauaugggcauguaauuuuuuuucuuguggugcuuuuucuggcuuuguuaucaggguaaugcuggccugguaaaaugaguuugagaauguuucuucaucuucauuuuuugguaaaaguuugcaaaaaauugguauuuuauccuuuaaauguuugguagaauucagcaguaaagcuaucaggucuugggauuuucuuugauaggaggcuuuuuauugauuuaauuuccucacucauuaaugguuuguuuagauuuucuguuucaucaugauucaguuuugguggguucuaugagacuaagaauuuauucuuuuuuuagcuuauucaaugugugcuguguaauuguucauaacaguuucuugugauccuuuggauuucugugguauagguuaugaugucuccucuuucauuucugguuucauuuauuugagucuucucuuuuuuuuucuuagucuagccaaaauuuuauugauuuuguuuauuuuuuuccagaaaaccaacuuguaguuuuguugaucuuuucuguuuuuaaguuucuauuucauugauugcugcucuaaucuuuguuuccuuccaucuaguaacuuuggguuuauuggagagguuguagauuuuauuaaggguuugaaguagcugauucauacaaauauaaaaacuaaagaaauaucaaugaaggucauaguuuauacuaauucauuggaggugggaaagcaaaaugcaaaacauauugaccaucagugcuagauacaaggauucaacuugcugcuggaaauagcaugugugcuauugcacacaugcauuuugugaaaguauacaugguuuggaacccuacagaacuaggcauaagaaaucuuuccaaauaauuccccuaagcagaaagaagagggucaaauauuucaauuccaaaauaaaaguuuucauuuucaauaaaaucacauaauuugagaaaaguagagcauagcaauauauaaucuuauuuggaaaaaauuacugugagcuuaugacauuaaaauaacuuguauuuuccaucucugacauuaguaaauauaguuaagcagcagcacugguuuuacuuaccaucaacucuccuguuuaucccuaguucccagauuuuggacuuuaauaguauucucuacuacucuuuacuacuuaugguagggaagcugauuccauguuuuggggcaguaaaacaaaacaaauuggaaugagucugggacaucuuguuauugcuagaaaacaaauauguuuuuaagaauguuggagacuguacuaaaacacuaaaaaaucaauggagucaaguuaaagagauuccugcugaucaaauuucgaugauuugaugagagagagggagaaagugagcaugaauuaugguugacugaaagaaguugggucuagucugaaaggucauuagcuuaaaaugaugcuugagagagaaaaguuaauauaagccauauaaaaagauaguuauaauuuaaagaaggguaaaugaaauaggguauguuuaauggggauuuaauauauguggguauuuuauuuccuaugaaaacaaauuuauauuccuuacuauauagucgcuauaguggguaguacaauagacacaaaaauaggaagucaaguuucccuuaaaacuuaguaucauaaugaaaucagaaagacuaacaacauggggccccacauaauaacuggauaggaaugaagacuagcauuuuauugguaccagugaccacgcuguagaaagaaaucaauggugaucucaaaaaugauaguucgggcacguguucugaggaggaggacugaaagguagacucaaugcauuaucuccuaggaggaaauucuucaauggcccuaauaaucuuaauaaacuauuuuuuuaaauuuccaagaagguauuccaacaggccaagucuauauaucacaacgaugggauaaugaaaugggauuugcaacacugcucaaaucaguugugaagacaucaugguaguaacgcaccauuguaaaaauaaaaaaaaacaauuugauauauguggauuuaagugcagcuuaaucugaugaugacuggcuagugucugaaucuccuuagacaccuggaucuguguccucaccaagaaucagcuggauccugacacagauccugcaguuggcugcucucagguaguuaguuuucauuuggauaugguaauauuuuugaacccuaagaagcuauaaaaauagaaaaauagcugauauguuaagaauauaacccaggaaaagacuaagaagaaaaaugugaguccggacaagggucacauucacuauauuagcacauuuauaacugauuuuaaucuaaaaauacugauuaccuuuguauuuacaacaauuuugugagaguuuugcauauugaaaugcauuuaaaauauuuaggaaaauuagauacaucaaaauuuuuauuucaaugaaaugcuuagagacauugugaucaauauuucaguguuuggaaaauuuaauuuguuggagcacuaguuuuugauuguuaguugcauugaguagauaaguaaccuauagauacuugagaaauguugauacuuuuguuuaaauaaauguauauuauuuaauucauaaaacuaaaaaaugggcauuaaagaaagugcaaagagaaguguuucuaaaagcaaaagaggucuuucuaaaaccccuuugucaucaauuaucauaacuaucaauuaucauaaggacauaguuucaaaucccccucaacacaccaaguaauugugcucaauuucuaguugggcaaacuaaacuuccugagacuccuuuuucuucuguguauuacaucugaagguuguuucauaagaaaauaagacauuuaauaauuuaagagagacagaucuaggcuuagaacugguaaaaaguagaaauucaauaaaugcaauagaaaggugacugaaaauuuaauauggcagaauaacuugauugaaaaaugguugucugugucauaguaucauuuccuucauuuaauugguuauaaggccaggcuugguggcucacaccugcuaucccaacacuugggaggccaaggugggaggaucacccaggaguucgaggcugaagugugccauguucaugccacugcacuccagccugggcaacagagcaagacagacugacaggaaggaaggagggaaggaaggaaggaaggaaggaaggaagggaaagagaaaaaagaaaggaagaaagaauauauuuaaucauagaagauucucagauugucaaaauuucaaaauuauaaaaugaaugaaaauuugauuaaaaguucagaaaucacgguacuaacuaauaaucuuuucaauuugggagcugaaaaacacggguauucuuuuaaaauuaguucagauacagcacuuagagggguuagucaauugguguauauguaauauguauguauauauguauauuuaauagaagagauuuuacaaggccuuuaaacuugugagaauaaaaaacuauuuugaaaagcuauguugaugcuuaacaacccaagcuauauccuuauaaaauagaaaaauucacauuugaagcucaauccuuaagaaucaucauuuuucucauaaaauuuucugagcuuuauauaauagcccuaggcaggaacacaucugacuuguacugaauuuuuagaccucgauguauuuacauaaauaauccaaagggaaauagguuguuuccaacagcuuuaauuaguuuuccauauauauaggucauaacuggguuuuacuuagauauuacauuuaguaauggcuguuaaauauaaauugaguguguaccugggagcauuaauucauagacaucucacaaagaauauggaacaucaacacagcuuucccauuacucaaacuuuuaucacuagccugaaauugaccgacuaaaugacugucguggguaacacauaaugcuguaaaacuuauuacagaauaaaaagcuugagggaucauuggaguguuuaacaucaggacuggcuuguuuucccauuacacuugauaaaagaaccagccaaauugccuugaaugaaacuuuauuaaacaaacaaugucaguucuauaccuaugcacuccucuaggagaguguggauuauuuugaucauaauaagagcacuucccagcccuuccucaugauuucucuggacaagagacccaaaugauuagcauguaaaugaccugucauauuauuaaauuguuauugcagugaauuaauacaauuaagcaaguaauauaauuucagugcaaucuucuuuacauuaaaaugccauucccuucuuucuuccugucuagcauagcaaaaaagaggaaagaaaaaagaaagaaagaaaaaaggaagaaagaaaagauaaugauuuuaaagaauuuucagcaaagaauuauauucaaggucugagagccacaagagucuaaagauaaaagaagagaaaaaugcucugggcuuccgaccugugacauucugcacagucccggggcagagagccaagccucuacuguuuugcugccagggaguuuaauagaaagaucugcucuuugaucacugugugggauucugugacugaggaagagcccuggccccucuccuagcaccaccaaagccucuguaaaacucuuauguggcuuccaccagguggcagcaggaaacaagguuugcacaaaaauugaugucuuggucuagaguaaugaacgcauuaaaagaaaaaugaauugccacaguccugugagaauucauauuaacaaacucugcuuuaagaaaauaaagucuccugugaaaauuuuucucaagugugaguuguugcagcaaaagagaaauuucaacuuucaggggaucuuaaaaucagaauguaacauuuuggaaacagacggaucugugauacuacaucuauggucaccuacggagugucagauccugguuuaaaaagcacuggcuuaaaugguaaggaaagaagguauuuuuuucucuuucccucuuaagaaaacaagugcaauucauggagacucuuaguuauguaauuucuagaaauuaacacaagugacagauaaaggauuugcugaguacacaguagguauucauuaaguaauuguauuucuuucugcacuuuugcagaaagugugagucuccaaagacuccugcguccccagagacuucugagaggcucuagagauaagucacauaacugccaagcuugaauguucuaagaaauaaacauuaucaaccucuuccuucaaaugccaguauuuuauuucaugcauaaaaggaaagguaugcagaauguuugaauguuucugcccuugguggaaauagggacugcuagucucuucagggaguaaaacauguaaaucucaguccacuuucuccucucugccucugguuucagucaccuucucuuccacaugcuaaccuaccugugacuccuaauucuucacucccacccucggaaugugcaucauuccugccucguuuucucccuuacaaauguguucaugcuaugaagggaaccgaaguggagucagaagaaacccacugccccccacucugcaaccuuaugucauuucucuaauguuauuaugaaagguaacugagaaaaugucagugucagccauaaauuaucaugugcauuuaagaaaaucauuauuuuugagcgucuuccuauguugcuuuccuucugcuuucagguaucucccaucucgacaaagcaacacaacaaagcaaugggauaaaucugcuguccccuuagggugcagauccucuucauccacugaucuggaguggacaguauacaccaguguccuguauacccucuuuauuuccccuugucuuuuauaaugugacugucccagaaucuaaagcuaaugaagugcauucucuacaaccaccaagagaaucccaaaguucaggccgggugcagugggucacgccuguaaucucagcacuuugggaggcagaggcagguggaucacgaggucaagagaucgacaccagccuggccaacauggugaaaccucaucucuacuaaaaauacaaaaauuagcugggcgugguggcacacaccuguagucccagcuauuugggaggcugaggcaggagaauugcuugaacgcaggagguggagguugcaauaagcugagauggugccauugcacuccacgcuggugacagagugagacucugucacaaaacaaaaaaaaagaaagaaaaucucaaacuucaaauccaauggccuuuccuugguccucauucucuuugcuuucuccuuaaaccugcgaaucccccaccucccugaagcucucucucuugacuuucauaccacaaugagcguccugguucucuuccacaucagcuuuauuugaugccuuuugcgucucugaccacacuccuccucuaucuccuucccuagccucgccucauaugccuuugcuguggauauuacaagagaugcaaucaauaaguguucccuccaaguugcuccucccauaacucauaagagaaaaaccucacuagcuuggauuuuccccugggcuucagucuagcguccucaguuucuggguguucacuggaugcccuucagcccuugucaucugggccaaaauacaaguauuguucuaguucuguuggucccaacccugacuuaacccuuuuagcuuuuauccacagccacucaguuccacuguugugauucuuauuuugaaauggcucauauaucucuuccauucauucaucucuuccuuucauucuauuccuacugcaaugcccuucuuuaaaagccggccugaugacucccaccuguaaucccagugcuuugggaggccaaggcaggagaaucccuugagcccagaaguucaagaccggccugagcaauguaguaagacucccauaucuauaaaacauuuaaaaaauuaaaaaaaacaagcaaacaaaacaaugcccuucucuaugcuuacuccaucuaucagccuauaucugguuacucgccuuuccauaaccaacuccuccaaucuugcucucgcaagcccacuuucucacauacauucaugccaugaagucuucccaaaucacugucauuuaucauaugcucgggaaaaauuacuacccccucaggccucaguuuccuggagacauguuucuucuccuugccauucauccuccucugaggcuuaguucagauauccucuccucucuguuagucaggguucucuagagggacagaacuaauaaaauagauauauauauggaaauuuauuaaauauuaacucacaugauuacaauaggccauccgcaagcugaagagcaaagagagccaguccaaucccaaaacugaagaaccagggguccaauguuugagggcaggaagcaucaagcaugggagaaagagguaggcugggaggcuaggccagucuagucuuuucaagguuuuucugccugcuuuauauucuagccgugcuggcagccgauuagauggugcccacccagauuaagggugggucggccuuuugcagcccacggacucaaauguuaaucuccuuuggcaacacucucacauacacacccaagaucaauacuuugcauccuucaauccaaucacguugacacucaguauuaacuaucacacccuccaugaagcuuucucaggucccccucacccaauaaaaaaaucacacuuuggaauagaauagcccuuacuuuuccaguacacaguggccuacuaugaauugcaucauuuugcuuaagauacuaacuucuucacauguuucuuugucauugagauuuuacauuucuuuagggaagucugugcgucuuauccuuguuuccauugcaguacuuagcagaugcaugauauaaaugcucaacacauaaagauauaccaucuguaugcacgguuuccaccuaugccuugagucuccuuuauucuuuccuccccgucucuaacaccuaagaauccauccacauacauauuuuugugaaagaauacaaugaaaauagcuguaugaugaggacaauucacacagcuuugagaaugcacuuccucaucugcaaacaagauccccacguauguugacauuugagauuuguuuccucacauuucccccccugcucuauaauuuugaucacugauaccaguaaaaguguuccuagauaaaauaugcauugcauagugaaggucuaaauuaaacaguuuuuggauuauuaccauucuuuggcaaggcauagguagguagugcaucaggcuuuaucaguuuucuuuucuuuucuuuuuuuuuuuuuuuuuuugagauggagucuugcucuguugcccaggcuggagugcaguggugcaaucucggcucgcugcaagcucugucucccagguuuaugccauucuccugccucagucuccugaguagcugggacuacaggcgccgccaccacgccaggcuaauuuuguuguauuuuuaguagagauggggcuucaccguguuagccaggacggucucgaucuccugaccucgugauccgccugccucagccucccaaagugcugggauuacaggcuugagccaccgugcccggccgcuuuaucaguuuucuuaggggcauuuacaccaaaagcugaucacuugaauggauaaguuuaucagucaggaugagcugggcuuugcugcaggacaaacaacccugacaucuuaguggcuuaacaaggcaaauguuuauuucuugcaucugcuauaugcucauuguaagacaggcuccccacuaugucaucuuuacucuggggugcaggaugaagcugacagaaccacaaucaaccuggaguguugcuguuugcagugauggcugacucucauagggagacaacuuggugaacugcacauuagcucuuagagacuuuggcacaacagugauacagguuacuucugccuccacaucauaagccaaaaauaacauuuuaagccccacagccaucugaauuggccucuccucucagccaagggcauuccaaaguuaaccugaaaaacuaguucaggucaugauggggaguggggguugcacaugccucauuauacccuccucccuuuggaauccaggcacagcugaccagcauuaacauuaauagagaucuuaagacuuucuguagcaauaagacacccaaauccagccugacucuaguauagcauuacaugacagauagcagguccugaaagaaauccaaguauuuugucuuaaaauauauuucuuuggcaauuuuugaaauggcccugcaaagcugucucuuguggggaaaaaucuaacuucuguagagaaucccuuuccauuuccaggucuuuucccuaauccaggagagaauucacugagucuggcaccuuuuuaagucugauaagaaacauuuacaaucuauucucuccaaagccggcuaccuguaggcuuuguauaauaagagccuuggucucuacaaccacuuaucuuaauccagacacucccuucuauggauuccagaucuuuagauaaacucaaccaauugaaauuacaauaggacaucugggcaacaucaugagaaucugccuaugaccuggaaggcccccuucuacccuuggcuuccaguuguccugcuuuuccagacaaaaccaaaguauaucuuacauguaucgagugaugucuuaugucccccuaaaauguauaaaaccaagcuguagcccgaccaccuugggcacauguuuucaggauuucccgggaccauuggucacucauauuuggcucagaagaaaucucuucaaauauuuuacagaauuugacucuuucuguugacaacaucauagacccaggcaagucacaugccauacagaucuacaauucaagcaacgauaugcagugagaauuauucaagauguagacaccaccauucaaucacuagaaaaaugugcccauuucuuccucauuuuucccuucuacaaauacuguucauagguugaaaaagcuauuuguugugacauuucuaacaaauuugagagaaaguaaacauguuuuaaaaucuagauuucaauguauuuauuauuuuuaaaaauauguaauuuuuucuucucggaaaaucaaguuaaaaaugucaaaaaucuauucucaggcugggcaugauggcuuaugccuauaaucccagcacuucaggaggccgaggcugguggaucaucugaggucagggguuagagaccagccuggacaacauggugaaacccugucucuacuaaaaauacaaagauuagcugggcaugguggugggcaccuguaaucccaacuacucaggaggcugaggcaggagaaucguuugaaccugggagguggaaguugcagugagccgagauggcaccauugcacuccagccugggcaacaaaaaugaaacucggccuaauauauauauauucucaaaucauagguguaaaaaaaauguuaaaaauaaguauuuaaaacucauuauuauuuuagauuggaugaaauagagaacaggaaaauuaugcaauuuaaaagaaguggccaggugggguggcucaaugccuugcucaacgccuguaaucgcagaacuuuggaaggucaaggcaggcagaucacuugaugccagaaguuugagacaagccuggccaacauggcaaaaugccaucucuacuaaaaauacaaaaaugagccuggcaugcuggcaugcaccuguaaucccagcuacuugagaggcugaggcaugagaaucgcuugaacccaggagguggagguugcagugagcugagaucacaccacugcacuccagccugggugacagagcaagauucugucuaaaaaaaaaacaaaacaaugauuauguuuuuggguacauuaaucuuuuuaauaucugaaaccauacucuauuaaaauuaauauuguaauauucuauuaaaguugaauccaauuauaguaacucugugguauaaucccagacuuuguaugagaaggaguuuauuuuggcaguaaaacugguaagaaaaacaagaacagaauaaaucaucagaagcuugcugaauuuuauuuuuaaacaaaauaguguauaucaacuucuaauugguaacuuguauguauguaacauaauaggaaauacuugaauaagguccuuguuuauuuucuaguuuaggccaauucuaaagaguuacaauuagccaggugauacuuuuacugaugagacaauucagucaaaauguguaauuguacugccuccauuuagucuugaguguauaguuuuauauccgaaaaaaagaaagauuuucaaacaaacaacguacuaauucuggucuguuaaagacucuaaggggcauuuugaauuuguuuauuugaaucuccccaggguuucuugaaaugggaagagcucacaaccuuuauggucugugccaugcagcucuuaagcaacaaagcagggaacaucuggggaaagacaaaaagaggcccagaaauuaucauucauaaaaauuaggauuugcuuuucagaaccacagauagaaacacauguagaagcagauguuuccuuaaauaugaauuagaacuuucauauuguuaguaugugugguaauuuuuuuuuuuuuugagaugaagucuugcuguguugcccaggcuggagugcaauggcgugaucucggcucaccacaaaauccaccucccagguucaagcgauucuccugccucagccuccugaguagcugggauuacaggcauguacccccacaccuggcuaauuuuguauuuuuaguagagaagggguuucuccauguuggucaggcuaguaucgaacucccgaccucaggugagccacccgccuuggccucccaaagugcugggauuacagacgugacccaccaugccccgccuguauauaugguaguauuaauauuucucaagcuugaaggaaauccaacauugugguucagauugcucugucugauccagucuaccccaugcauacagaguuugugcugguaaaacuuuauccauacagcuagaugaaugccaagaaaccuuguuucaaauagauugcuaacauucacugcauuuacuaacauuugguaggaggcagaggcuuuugugaugguggaaaguaagaggggagauaugaaacugaugaacacaguugacuuagaagucagagcuaucggccgggcacgguggcucacaccuguaaucccagcacuccagcacuuugggaggcagagauggguggaucacgaggucaggagaucgagaccauccuggcuaacacggugaaaccccgucuguacuaaaaauacaaaaaauuagccgggcaugguggcgggcuccuguagucccagcugcucgggaggcugaggcaggagaauggcaugaaccugggagaucgagccugcagugagccgagaucgggccacugcacuccagccugggugaaagagugagacucugucucaaaaaaaaaaaaaaaaaaaaaaaaaaaaaaagaagucagagcuaucauaggucuacaccagggugucuccauuuuggcauucuugacauuuugggcgagaucauucuuuguugcggggcauuguccuacacauuggagguguucagcagcauccguggccucuacucucuagauaucaacaacaugcccaaguaaaaauaucuccagucauugccaaaugucuccuggagaaaaaaagucacccuccugagaacuacuggucuccauggacaguauuugccacccuugaaucugaacuguagacuuccugaagacaucacuuuuuaaauauuucauuuaauucuagguuuucuguaauaacuuaagucuuucauuacaucagauuaugugauuuaucauuuauauucauucuuauugcccacauucuuccuuuacagguguuuacuugucuaaauaccuaugaagacuguacggggaggaaaaaugagaaacaucacagaauucagagacauacaggcuacuuucgacucaucaccaaacucuuccaaauauuugauuagaaauuuuuggcaccacuuugauaacaauauuugaauagcucuggaguguaacaacgguacuaugugguugcuuucccaagcuauagccaggucauaaaaucaacggauuuguggaauuacacagucuaaucccucuauuuggggggauuuaaaaacaaguucagaaaauauaagacuuucccugucaaugacagcaaccagaggcaaaaauccagauuccuuuucaaaccauguuguucuaucucuuuaaaaguuauaauuuuuguuguuguugcugaggcuccauuuuuuaucacuuguaucugaaagugagcuguucaaaugugcccugcaggacucucuuacuccuucagagacuugaguaaaguagcuuuacuucaguagagcaagugguccuucacucacuggaaaucauguauuucaggcagaagcagcauuauuaauuuuuuuuuuuuuugagauuaaguuuugcugugucacccaggcuggagugcaguggcacgaucucagcucacugcaaucucugucucccggguucaagcgauucucuugccucagccaucugaggagcugggauuaccagugccugccaccaggcuuggcuaauuuuuguaauuuuaguagagacgggguuucaccauguuggccaggcugaucuugaacuccuaacgucaggugauccaccugccuuggccucccaaagugcugggaugacaggcaugagccaccacaccugaccuaauuuuuuuuuauacugaaacaucaaguaaucaaauagcuauaggacuuuguaggaaguuaagguaaaaauauugacaguuuagcuaugaaaaaaugggaaggagaaauauucuuuagaauacauaacucagcauucuauagaacuuuccgugcaauuuagaaaaacuuucuuugaugaauuguaaaaaaugauaaaauuauaaucuaaagugagaagcagaaguuuguuuauaccaauaauuuaaagauggggaugagaaaguguugauaaaaauaagaauguuucucugccuuugagacaucauggcagaacaucaucuacugugugucauuggccuguaaacuaucuaaaagcuaagaguaggugucucacacuuugcauaucagaagaaaacuuggagaaaagauaaauuuauggaaaaaggauuucuauaaauuaauuuagauucucaauuuuuuuuuuuuuugagacagucuugcucuuuugccccggcuggagugcaguggcgcaaucucggcucacugcaaccuccaccuccgaguucaagcgauucgccugcaucagacucccaaguagcugggauuacaggcaccugccaccacgcccagcaauuuuuguauuuuuaguagagacggguuucaccauguuggccaggcuggucuugaacuccugaccucaagugaucaacccgccucggccucccaaagugcugggauuacaggugugagccaccgggucuggccuagauucuuaauuuaauaucaacuauguauucuguggcucccaccucaucauucaaguggucuggucaaauggacaaaguccuuucaucgaauauuaaucuuuguaguccacugucaggugcacacuguaugguuugaguguaaggagguggaaagaggaaaaaugggaaaggaauauagaaagagacaaagcuggggggaagggauacugacuccuaaguccaaagcauaagcacucuaacgccaccaucuaaguuccaauaacgggcucucuuaagccuaggauuucuucagugguuauuaacuuggagguaguacggaaauucucuuuuaugugcagguuauacauucccagagccccagugaaugucugaaacuucagauaauacuggacccuauguauaccgucaucucucgcuaucuaugggggauugguuccaggacccccuucuauaccaaaauccgagcacauucaaguauggaagugagccauccagaacccucccagaugaaaagucagucagcucucuauauacauggguuucaaaucuugugaauacuauauuugugucuugccuugguugcagguucagaacccauugauauggagggccugcuguauuuauugaaaaaaaaaacacauaaaagaagacuacacagaucaaaucuguguuguucaagggucagcuguaccauauuuuuuuccaauacauacacaucuauguaaaguuuaauuuauaaaugaggcacaauagaauauuaacagcaguaacuaauaagauagaacaauuacaauaauauaccauaauaaaaguaaaguaaggaauuuuugaauggaagcacugcaauaccucuacuguugagccaauaauccagaagucuacuaagugacucaggaacagguagcagcuaccgcguggauaugcuggacaaauggcugguucaagucucuggugggaugguguaagauuucaucauacuacuuggaagagcacacaauuuaaaacugaugaauuauuuuucaaauuuuccauuuaauauuuuuagacuuugguugaucucugguaacugaaaccacagaaaaugaaacuguagguaaggggaagaccacgguauuaugguuucuacauuagaagcaugagaauccaauggcuaucucucaggugacacaugacgcuaucuuauacuacgcagccuaccagcucauauuuuaugcgguguauucuaaguuuucaguguauuagaccagugauuuucaacugggggcaauuuuguccccaaaggucauuugucaaugucuguagauuuucuaguuguugcaauugggggauguaggguguuaauggcauuuaguaggcagaggccagagaugauaugacacaucuuaaaauacaaaagacaggccaggcacgguggcucacaccuguaaucccaguacuuuggggggccgaggcgggcagaucaccugaggucaggagucugagacaagccuggccaauauggcaaaaccccaucucuacuaaaaauacaaaaauuagccagguauggugguggguaccuguaaucccagcuacuggggaggcugaggcaggagaaucgcuugaaccugggagguggagguugcagcgagccaagaucgcacuacugcacuccagucugggcuacagagugagaugcugucucaaaacaaaaacaaaagacaguccacaacaaagaauuaucugucccaaaguauuacuagugcugagggucagaaaaccuguaguaagcauucuguuaaccguuuagauaauggguuggcaaacuauggcccauggccugcugccuguuuuugugcgacccacaggcuaagaauggcuuuugucuuuuuaaaagguuaaagaagagauuuuuaaaaaauuauuuccuuacacauaaaauuugcaugaaauucaaguuuuuagugucuauaaaaaagauuuuauuggagcacaaccauacccauuuuuuuuuaaacauaccuugucuacuucugcucucacaauaugauggcagaguugaaaaguugugaccgacaccacauggcucaaaaagccugaaauacuaucugguccuuuacagaaaaagcuugccaaacaaauccugcucuacagacacaucaaaugagcugacauuaauauagcaaggugguaggauagacuuuagcuuaacucuuagaagaguuccauugcuuggagauuuagaguguuuauuauuuucugaacucagggguaaagguaggagggaggauaugaagaaauccuaaaaaacaauuauaaaucaggcugugacaauaaauaaguauaugugugggguggaagggggaggagaugccaugaauuauugccaccugaaaagaaagauaauuguuuacaugauuaacuaauacgcuagucagauaaugaguaaguaaagcuauuugcuacgaagcgcagggucagugguccugucucuuggaaauuuuuauagcuauuugaagagcacaccacaaccuugaagagugaacuacccaugaauuuucaaaugacuucuccagcuucuuucucaaaaaauaaauaagccucaagcaggcaauggugaauugaagacuuguauacagcauuuauaaaacuuacugacaguagagauugcagaggaguuuucacaagguaaguauuuauggaaaaagaaucaaaauccucaauucauaccuucagaaauggcauuaacauuacucuuuuccuuuuaggaagguugccaaugauacugaauggcaauacugccugcgaagcugucugucuaggaauuccauuacucuaaaaaguauuuacagaugauucgcaccuuccucaagacauuacuuucuccuucugcuguuccucucacacuagauauuuuauccauauuuuguguguguaugugugugugugugugagauggagucucgcucugucacccaggcuggagugcaguggcacaaucuuggcucacugcaaccuccaccuccugguucaagcaauuccccugccucagccuccagaguagcugggauuacaugcaccugcugcuaugcccagcaauuuuuuuuuguauuuuuaguagagacggggucucaccauguuggccagacuggucucgaacuccugaccucaggcaauccgcccgucucggccucugaaagugcugggauuacaggcgugagccacugcaccuggcaagauucuccugaugaugugugacaggaagauauuuguacuuggucucauaaaacugggauauguuuggggaaagagugaaaagcuaucaaaaagauguucuacauuugagcccugagaaacuuauaaugauaaacauuguuagaaaauacuuuauuuuugaaguagaagaggcuaaauucuacuuuauuuauguggggaaaauuuuggaaaaaagaaaaauuaaaugauuaaaaggaauuuuaagauguauuaguuuuaguacauuggagguaugaggggguuaguaacaauaccuucuaauucaaauaauuccugauucauuuaccugauauugcucagaaauaagaaauguuuuccauauaacaaaguuuaccacuauugaauaguguauuccaggauaaaaauuauuuuggugucagaauuauucaaaugcaaaacuguuucuuauuuaauuuaauuaauuaauuuauuuauuuuagaaggagucucgcucugucacccaggcuggagugcaguggugugaucucggcucacugcaaccuuugccuccuggguucaagcaauucuucugccucagccucccaaguagcugggacuaccaggugugcaccaccaugccuggcuaauuuuuguauuuuuaguagaaacaggguuuugccauauuggccaggcuggucucaaacuccugaccucaggugauccaccugccucggccucccgagugcugggauuacaggcaugagccacggugcccagcccaaaacuguuuuuuaagaaauaaaaaacauuuaaaaauauaaucaaagguuuaauuaaaaguuauuaacagagguuugcuuuuuuaacagcaaguucauuaucugagucuucauuccuuaauaugcuagugauagacuucucagugcaaugucuauuucagaggauucuauguccuugcccuuuuaaacaaauugucaguuuuuauuuuuccuuguauuuguuguauuuacauuuaauaucuucaucucagcaucuacaauucacuuuuauuauguuguggacuuuaagccagagaacuaaacaugauaagacugauauucuuagcagauaauauauuaguuacagagccuggauugaaaucugagccaugccauuuuuuaacuaugggaucuuggggaauuugcuuagccugcuucuuuauccauaaacuggagaugauaauagcuuacuuaugcaguugucagagaauuaaauacauccacauauguaaaaugcuuagaauagugacuggcacauauucagauaauaucuagaaucuaauuuuuagagcaaguauuuuauuaggcacacauuuuucaccaaaaucucugucugagucuuaguuuuagagaguugagauggagaugcauauguccccuccccauucuuucuuucuuucuuuuuuuuuuuuuuuuugagacggagucuuugucugucacccaggcuggagugcaguggcgcaaucuuggcucacugcaagcucugccucccagguucacgccauucuccugucucagccucccgaguagcugggacuacaggcgcccgccaccaugcccggcuaauuuuguguuuuuaguagagacgggguuucaccguguuagccaagauggucucaaucuccugaccucgugauccgccugccucggccucccaaagugcuggaauuacaggugugagccaccgugcccggccucgcccuucuuuuugauugcuuaugucccucucuugucauuucuccagaaguugucuauugggauuucuuagaccacagaaacuucauucacccuucuuuucccugucuccacucagaguauuaauuaaagauuaauccugaagccugggggccuaaacugacauccaggaaagccuuaggagcauuugcauacacuuaugaaguccuuauaaaacuuuacauuuuaauuagcugacaacaguuaaaaaucauaagacuagaaacuucuacuuccagccgagaaggaguagcaggauuugacuuacucuugucugaaacaacuaaaagacuggacaaaauauauaaaacagucauagagaucaggcagggcagggcaguuaugucugagagacagacacaaacaaugugaaccccacaauugcuucagccuacugccugauaaaauuuucugggucucagugcagggaagggaaacuuaggaaccuggugagcuccuuacuugaggagacagaguugguagucuagggucuucagaacagaauaccagacaggagagagcuguacagagagaaaacuuaagugaucugcagaagugucccuuaagucuucagcaagguaccaauaaauucauguguguaauaaaacaaccugggucagagaaaacucaccugaaaggagcugagggaacaaccuacucacacagauuaagaauaauucauguucccaccagucugagugcaaaaccuuguaacucaggguauuagguacaguacucaaaaggaaauuauaacauuauugggaaaaaaucagcccuagaaaagggcugugcuggucucaccucaugaagucuaaaagcaagucuccaaaggaucaacuguuuucaauaaguuaauuucaucccagaacaaagcuuaagcauaauauaggauauaaaaauaucuacacucaacaaagugaaauucacacugugagugcccaaagcgugaggagggaaaguccacuucugaacacauacccucacuggggaacauguaaauucagaucacaggagaagaauuuaaccuuaccuagagcugaaaugaauuuagagagcccagugaaauauaaaacuagaagaagcagcagaaagagcccuguaggcauuccuggugcccagggaagccguuucugacuuuaccucauagagguucuuggggagggcugccaguggaacuggggaaagacaacagggaaaaggaaacuucuagcugaacuuuguaauaauuuugaccaaauaugaauuuuucugggcacaaucuggggcaggggugggguagggggugaacagaaaguguagauaugagcaaagaagcuacagcagguggggagagguggggccugaaaguccugcuugcuuucucagcugggaggcuuguagucugggacaagaccucagcucugcucaccggcaccuggauauaaacucagugcuaucgguggggugcagugggagugagacuggccuugcuggcugugugggaagugagugaggccagucacugacgacuuucccccacuucccuggaaaccuauaugacacugcagagcagccauaaucccccugggaacauaacuccauuggccugagaaccacaccgccauccucaaaguggcugcagcaagcccugcccaaggggaggcugagcucagacacgccuaauccuggcuccacccaguggucuuucccuaccugcccuggcagcugaagacagaaaauacaaucucuugggagcgcuaugguccaacccaucaccugagaagcccaaauaccuauucaggcaaacuuaggacaagcuuguuucagcugaugcucucuuaaaagugccaccucuuggcuggaggccaacuaacugcuagcacaaccaacauucaagaaaacccaugcacuaaacaaaacuacaacuaaagacccucacacagucuaccucacuucccuacuaccucgaccagagcaagugcugggauccauggcugagagaccugaagacagaucaugucacaggacucuuugcagauacuccccaguaccaggucagaguccaguagcuccacuggguggcuagaccuagaaaagcaauaacaaucacugcaguccagcucucagugagccccaucccuagggaaagggggagagcaccacaucaaggcaucaccccauggcaccaaagaaugaacagcaggacuuaaaccccagcucuuuccucugaaauggucuacccaaaugagaaggaaccagaaaaacaauucugguaauaugacaaagcaaguuucuuuaacaccccaaaagaucacacuagcucgccagcaauggguucaaaccaauaagaaaucuucaaauugccagaaaaauaauucgguagguugauuauuaagauacucaaggaggcaccagagaaaggugaaaaccaacuuaaagaaauuuaaaaaauaauacaggauauggacaaaaaaaucucuagagaaauacauaacauaaauaaaagacaaucaaaacuucuggaaaugaaagacacacuuagagaaaugaaaaauacgcuggaaaguuucaguacaauggaacaaguagaagaaagaacuucagagaucaaagacgaggcuuuugaauuaacccaauccaacaaagacaaagaaaaaagaauuuaaggcugggcgcgguggcucacgccuguaauccuagcacuuugggagguugaggcaggcggaucaugaggucaggagaucgagaccauccuggcuaacacggugaaaccccaucucuacuaaaaauacaaaaaaauuagcugggugugguggugggcgccuguagucccagcuacucgggaggcugaggcaggagaauggcgugaauccaggagguggagcuugcagugagccgagauagcaccacugcacuccggccugggcgaaagagugagacuccaucucaaacuaaaaaaaaagaaaaaaagaaaaaagaauuuaaaaaaugaacaaagccucaaagaaguuugagcuuauguuaaaugaccaaaccuaagaauaacugguguucccaaggaagaagagaaaucuaaauguuuggaaaacuuacuugagaaaauaauugaggaaaacuucccuggccuuguuagagaucuagacauccaaauacaagaagcucaaagaacaccugggaaauucaucacaaaaagaucaucaccuagcacauagucauuagguuaucuaaagucaagacaaaggaaagaaucuuacgagcugugaggcaaaaacaucagguaaccuguaaaggaaaaccuaucagauuaacagcagauuucucggcagaaacccuacaagccagauaggauuggggcccuaucuuuagccuccuuaaacaaaauaauuaaaagccaagaauuuuguauccagugaaacuaagcuucacaaaugaaagaaagauggucuuuuacagacaaacaaaugcugagauaauucaccacuacaaagccagcacuacaagaauugcuacaaggagcucuaaaucuugaaacaaaaccuugaaauacaccaaaauagaaccuccuuaaagcauaaaucucacagggcauacaauacaauaacacggugacaaaaaacaagguauucaggcaacaacuagcaugauaaauagaagaguaccucaugucucaauacuaauguugaauguaaaugacuuaaaugcuccacuuaaaagacacagaauugcagaauggauaagaauucaaccaaguaucugcagucuucaagagacucaccuaacauaaggacucacauaaauguaagguaaaggaguggaaaaagauauuccaugcaaauggacaccaaaagugagcaggaguagcuauucauauaucagacaaaacagauguuaaagcaacaucaguuaaaaaagacgaagagguacauuauguaaugauaaaaggacuaguccaacaggaaaauaucacaauauuaaauauauaugcaccuaacacuggggaucccaaauuuggacaauaauuacuacuagaccuaagaaaugagauagacaacaacacaacaauauuggggggcuucaauauuccacugacagcacuggauaucaagacagaaagucaacaaagaagcaauggacuuaaacuauauccuagaacaaauggacuuaacagauauuuacagaacauuccacccaacaaccacagaauagacauucuacucaucagcacauggaacguucuccaagauagaccauaugauaggccacaaaacaagucucaguaaguuuaagaaaauugaaauuauaucaaguacuuucucagacuacaguggaauaaaauuggaaaucaacuugaaaaggaauccucaaaaccaugcaaauacauggaaauuaaauaaccuguuccugaaugaccauuuggucaacaaugaaaucaagauggaaauuaaaaaauucuucgaaccgaaugauaauaaugacacaaccuaucaaaaccucugggauacagcaaaguuggugcuaagaggaaaguucauagcauuaaaugcuuacaucaaaaagucugaaagagcccaaacagacaauguaagguaaaaccucaaggaacuagagaaacaaguacaaagcaaacccaaacccagcagaagaaaagaaauaacaaagaucggaguaaaacucaaugaaacugaaacaaaaauacaaaagauaguaguguuuuguaguuuuccuuguagagaucuuucacuucuuugguuagguauauucuugaguuuuuuuuuuuuuuuuuuuuaacagcuauuauaaaagaggcugaguucuugaucugauucuuagcuugcuugcaguugguguauagcagaacuacugauuuguguauguuaauuuuguauccugaaacuuugcugaauucauuuaucagauuuaggagguuuuuuggaugagucuuuaggguuuucuagguauacaaucauauccuuagugaacggcaacaguuugacuuccucuuuacugauuuugaugcccuuuauuucuuucucuuaucugauugcucuggcuaggacugaaagaaaucauagauagcacaaacaaauggaaacacaucucauccuuguggauagguagaauaaauauugucaaaaugaccauacugccaaaagcaaucuauaaauucaaugcaauucccaucaaaauaccaccaucauuauucacagaacuagaaaaaaaauccuaaauucauacagaacuaaaaaagagcccacauggccaaagcaagacuaagcaaaaauaacaaaucuggaggcauuacauuacgugacuucaagcuauacuauaaggcuacagucaaccaaauggcaugguacugguauaaaaauagguauacagaccaauggaacagaauagagaacccagaaaaaaagucaaauacuuacagccaacugaucuucgacaaagcaaacaaaaacauaaagugggaaaaggacacccuuuucaacaaauggugcugggaugauuggcaagcaacaugcaaaggaaugaaacugaauccucaucucucaccuuauauaaaaauuaacucaagauggaucgaagacugaaaucuaagaccugaaauccuaaaaauucuagaggauaacaucagaaaaacccuucuagacauuggcuuaggcaaagacuucaugaccaagaacccaaaagcaaaugcaacaaaaacaaagauaaauagaugagaccuaauuaaacuaaaaagcuucuguaccucaaaagaaguaaucagcagaguaaacagacaacccaaagaguggguugucacccacuacagaaguuuuccauguaacuaaacacuaccuguuccccaaaaaccuacugaaauaaaaaaaaaaauuaaaaaaagaaaaaauaucuggaaagggcuaacagcagauuagacacuacagaagaaaagauuagauaacuugaagacagugauagaaacuauccaaaauaaaaaacagaggaaaaaaaagcuacuagaaaagaaaaaagaaaaaaggaaagagcaccaaugagcuguggggcaaagucaagugguacaauauguauaaugggaauuuccaaaaguggggguugggagagugaugaaaauauuugaagagauaauggcuuuaaauuaaaacaugaauggaagaaacuacacugagguauaucauaaggccauucuuaaaagcagccagagaaaaaggacacaauugcccauaaaggagcaaacauaucaaugacagauuucucacaggaaauaaugcaauccagaagacaguaggaccacaccuuuaaaauaagaaagaaaaaaauaaugaacugucaaccuagaacucgauacccagugacaauaucuuucaauaaaaauaauauucugauacauauauacuauagauggaauucauccauuuugccuaaauuuucaaaugcuuuggccagcuuuguucaugguauucucuuauugucauuuaaagugucugcuaccuauaauuaucuccauuuucauuucuuguauugauuauuugugguguucuccuuuuuucuuaaccaauuuugcuggaggauuuucuguuuucaagaaacuaacuugugacuauguugauccucccuacuauaacuucaaguuuuauuucauuaagcucugcucuuacaucaucacauacuuuuacuuuauuugaauuuagcuaugaguuucuagccuuaacucauuuuuuacuuaagcauuuaaaguguaaaauaacuacaacuaucuuugucuugcaucucaugaauauuuauuuauaggauuauuuauuguccuucaguucuaaguauuuuuaagauaccuuccccuagaaagucauaaauguuuuaaacauuucauuuauaucuuagaagaauguguguucuuuauuuuguuuagacuuuaugucaaucaaguuuuuaaauuauauugguggaaaccucuauuuuuacuuauugucgugugccuaaaugaucaguucugaaauuaauaugccacauuuucuucuaugauauuugaguuaucaauuucucccugcacuucugucaauuuuugcuuuauauauuuugagaguauuuugcgaauucaaguuuaaaauugcuaaguucuucuggcaaaaugaaucgcuugccauaauucaguauccuuucuaccuucuaaaaagguuuuugaagucuuuguuaccugcuauuauaguuacccgguuuuuccuuuaauuauuauuugcauauuaugucucuuuucauuauuuuccauucaggcuuucugaguccucuuauuucagaugugucuuaaaaaaaccacuuagcuucuuuuuaaacuaauuugacaagaucuuuuagcuaguauauuuaguccacugccauggacuaaacacacacacacacacacacacacacacacacacacacacacacacacucucucucucucucucuaucaucuaucuaucuaucuaucuaucuaucuaucuaucuaucuaucuaucuaucuauaucuguuuaucuaucuaucuaucuaucuaucuauaucuguuuaucuaucuaucuaucuaucuaucuaucuaucuauaucuguuuaucuaucuaucuauaucuauuuaucuaacuaucuagguaucuagacuacacacacacaugcacacauguaaaagcaagaaagacagacuuguuccuauugucuuauauuguuuagucuuucugaauagaugauuuauauuuguuuucuuaauccauuuccucccccauucugguuuugaaguuauauauuauuuaauauuaagugggcacuuugaaggcugggugugguggcucacaccuguaaucacaguauuuugggagggcgaggcagguggaucacuugagaucaggacuuugagauaggccuggccgacauggugaaaccucgucucuacuaaaaauacaaaaaauuagccaggcgugauggcgugcaccuguagucccagcuacuugggaaacugaggcaggagacucacuugaaccugggagguggagguugcacugagccaagaucaugccacugcacuacagcaugggugacagaaugacagucugucucaaaaaauaaauaauaaaaaauuuaaaaagugggcacuuuggaauucuaucuuacauacuuaagaaagucuaaaguuaaucacucuuuuaaauccucuuaaaauacaaggaucuuaaaaaacuguaauuuugauuauucucuuucuaacagacuucauuuuuaauuguuucauuuacuccuuuuuaaaacacauuaauuuugauguuaauauuuuauuacacaguuuuaaaaaccuuuaaccuauaucuucauuaaugucuuugaucaauacuucuuacaccucagacauuucuucuggguuucuuuuauuuaaaaaaauuaaguaaauccuuuagagauugcuuuaaugaaaaaccuuuuggucucaaacucucaauuucuguuucucuuucucucaacacuuugaucauaccauucuguggucuugucuuucaacuauugcuuuugagaauucuauuuuuauuucacuugcuguuacuuuuucucugacuuccccuuuggugcucaagccuggugaaagacagagcugaguuaaaccuuuggugucuggagagcagagccuauacuuaacuauuccauaauacaaccaacagcgcugaggaucuauaacaaaaaggcauaguuagcauacucuaauuuauaagccuuaauuuucaagcaauaaauauugaacacauggaagugagcugauuuuaccuugucuauuaacuauuaaaauaugcauacagaauuuaaccaaauaauugauuuuaaacuuaaaauauuuuuguaacaagaguuacuauguugauacauccaaaugaaccuaaaggagaaacaauaugaguuuguugucuggaaaauucuaauagauaaaggauucaagguauaacuauugaucaacaaauauuuauuagcuacuugcaaaauguuccauuuuaugagagcuaauuuagaauugcaauugucuguucuauuagaauugaucaaaagcuucaggucauuuaauauugccuaauauauacacauaguauguaaauauacauauauauguauaaagaaaucacuuaaaaacaauaagcaaauacuucagaaaaauuauuacuacugagaaaaaaauauaaaccauuuauuuaaaaucauuuaaagcaguuuuaagguucaaaacauuuuuauuuaauaacaagcuuauuuagaugacuuuaaaagucaauguggcuguauuuacaaaauaaguaaauuuucccaacagcaaagcuaguggaucaauuaauggcuuaguuauaauacuuuguugaaauagucaaaaugaguguuauggcauuucugugugguacagcuuagaaguucaaaaacucugcaaaugaugcugaaaagaauauaaugaaugcaugaaaaaugacuauuccuggaaauguaagguggaagcugacaauacucauguuauuuuauguagaaccuuaccuuacuguaacugucaaagcacuuaaaaaccuugaccaauuuuuaaauuuugauauaucuuaauaugcacucaaguauuaauuugcauuagauauauucuaacuuagugcagacuuuguaucaaguuauauguauuccccuccuuacuaaauauauauauauaauuuaaauauaaauauauguauaguauaaauaugcauauuuuaaaauauagaaauuucuuuugagagaagaauauuucugcuguuuuuuaauaaccuacaugaagaaaaauacucagauuauaaguauacagcaugaugaauuuucuuucuuucuuucuuuuuuuuuuuuuuuuugagacagaguuuugcucuugcugcccaggcuggagugcaauggggcaccgucucagcucacugcaaccucccucucccggguucaagcgauuuuccugccucagccagaguagcugggauuacaggcaugcaccaccacacccggauaauuuuguauuuuuaguagagaagggguuucaccauguuggucaggcuggucucgaacuccugaccucaggugauccuagucugcucagccuccaaaagugcugggauuauaggugugagccaccgugccagaccuuuuguuuuuguuuucuuuuugagauggggucucacucugucacccaugcuggaguucaguggcaugaucuccacuuacugcaaccuccacgucuuggguucaagugauucucccaccucagccucccaagcagcugggacuacagcaguguaccaccacgcccagcuaauuuuuauuuuuuauuuuuuugguagagauuggguuucaucacauuggccagguuggucucgaauuccugaccucaagugauccgccuaccuuggccucccaaaaugcugggauuacaggcaugagccaccgagcccuugauggcccuugaugaauuuucauaaagugacacacccauguaacucgaauccacaucaagaaacagaacauuauuaguggcccagacacccccugugugccccuuuuguucacaaccauuucccuaaagguaacaacuauuuugucuuucuaacaccugggcuauuuuuugaauaacauuuacccuauuaggcauacaacgcuaaaaacaaacaaacaaaaaacuauucuaugggaauuaaaauuugggugaggucauguacuccuucuuccuauuuucaauuuauuuggcucauaucugcaccaaaagccaaacaucugccagccccucugcagcccccuaguccccucagucaagcgacacgccuugcaaggaaaugaccacucucggauaugcagaccugguugugcaugcuccauuucugccuaaaguuuucugugugcagaggaugguagguguaaaacuacgggccauaaagagccagguauugccacaugaauuauacucugccucugaaaugccccagguuuggcugccccaagcugcauccucaucuccuacaagccacccaggacauucccaggcaaaacgagaagggcccuggagguaggcugcacacugacuuguuuaaccguguguggaggggaugguuucuccccacuggcauaaacagaugcugcugggauaggcauguauucgcaucugccuguuugcucugcucugggagagucugagcuuugagagcuugccaauucuuaauggaaaucugcuacuugugaugaggcaugaaagacuagcuucaccugaccugcacaauugaacaccaugcucucucuucauguacuaagucacguuaucaacacacucuagaggguauauauuugacuuguuugugaauagcuaguuuuuguuuuaaguacuucuuagcaggauuauaccaauaaacuugacucugugaaagggaaauaaaaacuugggaccucaguucacuuugucaaaagcaaauaauaacaauaauaauaauaauaauaauaauaauaauaauaauaagcuggaagcugagucaugcaggaagcugccuuucucuuuguuccuaagcagauagcuacagaaaaaacauuucugauagagaauuugaagcuuagagaagugaaauaacuucuccaccaucacacagucaaggaguggcagcauuaugauuugaacccaagguuaguuuaacucuaaaucccaugcuugucuucuaguaauacuucugagacacugcagaaauacaaugguuaucaagaauguuuaaccuucaguuccuucaguaaguuuuaacugaggguaggagguacagugaugcccacagucuuucuucucuauuauucacaauucuaaauaguuaucuuugacuuaaaaugcuauuaauauuuauaaucugcuaucauguuacauccacauagggcuuuauacuugaagaucaccucacacucauaaacgcauucuaacccagguuaaaagggguguguauuacuacucuuauuuuacccugaguucuucucaggcugaugaaaucucgaauuuagugagaccucauguuaggaccuuucgacaccagaaaugcugaaagucuguuuuaaggcguugucucuauuccuugcugauguguuauccacacgcagacuauccaagcuauugagcgauugauccucauggagaccugggacacucagcagcucccggcuacuuguauaccuggcuacuugugcacccuccuacccaccgcuuagugaauucugcuuccucaugacugguacuaucugaggguuuacgacgccugugacucucuuaacuucuaaacuauguuaacaacaacaguggcucuuauguauggaagugacugcaccgagggcugugaauaccacucaagccucacugcaauaagagggugggcacagaugagaaaaugaagacucagaaaaguugagcaacuuuccuaaaggcaagugauggaaauaggauucaaacccaggucuguuugucuauaaagucugagcuuuuaauuccaguggauccaaagcuuacaugaggauugggcucuaaaaguuguugcaaaacuggaaaauuaagaaaagccaagggcugcucuggaaagcucuuaaaucgcccuucaaguaccuuaucccauuacuucucaaggacgccaacacgaacgaucauacuucagcacaaaacagaucagcauauuuuugggugggcaacagacgaaguaguuguuuguguuuaggauauauauuguacaaaaauauuugaaccacacucagccuagcaaaaaaacuuaccccaucaauguugcgggagggaccacagauccugucuucaucucauauucauuuaggggcauaugcucagugagcauguugcaacaaagacagauggaaucaaguuagcagauaugcuaugcuacucuggguucacuccuacuugggauuucagagaauguccuccucuuggggagagcauucuaauugcuacugcauauguaaaagguuuauacuguuaaaaauguaaucuugauaccagcaaagcuaugaucuaagagacaugcacuuuuaggggucagaaagugauagaaacauuucugcaauaucagugagguuacagcuuuggcuuuuagacagaaaacugacugcaugguuuuugggucaauguugacugaaacacaucccagaaaccaaccauaucaagcaugaaaaauccacagaacauaaaauggcuggaaaauuccacagcaaauggaagggcagaagaaauugcccacaauguuuaaauucucuucucucacugucuccccaaagcucccucccuucucaaugaguaugcuaaaauuugcgagggaacagagcccacucuuuaggcugcuauacagucugcauaucuuuuauucaaagucacugagagaagguuggagugaauccguucaucgcuauucaacacagaacuuucuguuagguagaguucucaugagaagccauguuagaggguacaggccaaguugcacaucacggccuaaggaaugagccccgaaccuuggcuuaauuagcuguggccagguuaucaaggcuauaaauugcaaaaucauggggaccaaaauauaagaaacccacugccuccuucauuuaaaagaaggcgauaggaauggugaggacaaagauguucacggacuagucucuacugcaaugcuuuuccuucuuaacugcaaugcuuuuccuucuuaacugcaauguguuaacuuggcaugcagcugaaacagucuuuuuguggcucagagaacagcuuugagugggacaaaacaggacuaccauuuauccuuugucuuuauaaacauaauaauagauguagcuaauauauauuuagaucucacuagguucugcauuaggugccuaaucuggaagagaagggcuaucauugucccauuuuacagaugaagaagcugagggguagauuaauaaaacagcucucuggaggucacagauuugguaaaugacagaacuggacugcaaugaagauuuggcuugcuccauagcaccaugggccacucuuuuagaugacacgggugcauagccuccugccuuagaaaacagaagaauaauuuccuauaagcuauugcugagauuuuuacugaguccaacccaacgcacuucaaaaguuagugaucaguuaccaucaggaggacuauuuaaauaaauauuaaaauuucaaacuauuaucuuuugcagauagccuacaaagucugguuguuuuaaaaggccaucaaagaugccuauuuauaggcugggcaugguggcucacaccuauaaucccagcacuuugggaggccgaggcaggcagaucaccugaggucaggaguuugagaccaaccuggccaacaugguaaaacccgucucuacuaaaaauacaaaaaaauuagccaggcguggugguguccacuuguaaucccagcuacuugggaggcugaggcaggagaaucgcuugaaccagggaggaagagguugcagugagcagagauugugguacuacacuccagccuggcugacagagugagacuccaucucagaaaaaaaaaaaaaaaaagauuccuauuaauuuacauacuggagaaaguauguuuugcaccuaaccaagcuuggaaggcuuaccuggacucuacauggcucaaaaccacgcauuacuugagaguuuuacugauauuguuuguuucugugcaugguuuguaaugugucagacuucauuuuaaaaguuucccaggggaugaucagcaaagaacuauagaucuuauugaccaugugaacacauccuggaguuaguuuuuuaaaggaaaagaguuggccucugcacucuggcgaaguuguaguuagggagcauagaguucugaguguuugcuaaagcuuaugugcaugucuucuaucagaaacccagaaugccuagcacucuaguugccuuucaggaauaaaauucuaagcucuuuauuauccagcucuguaaaaaaaaaaaaaaaaaaaaaaaaaggccacugagagaagucauagugauagauucuuuaaggacuguauagucuagucccauuuugugauuaaaucagauuacuagaugcauacauauuagacucauucauauuuuacagacgaggaagcucugccuagagaaauuguccacaaucccagagcuaauaagaaguggaauuagccgggcgcaguggcucacgccuguaaucccagcacuaugggaggccgaggcggguggaucacgaggucaggagaucaagaacauccuggcuaacacggugaaacccugucucuacuaaaaauacaaaaaauuagccgggugugguggcggguaccuguagucccagcuacucuggaggcugaggcaggagaauggcgugaacccgggaggcagaguuugcagugagcugagaccacaccacugcacuccagccugggcgacagagcuagacucugucuugaaaaaaaaaaaaaaaaaagaaguggaauuagagacucaacacccagucuuuuuggcuuguagcucucagccuuuuccauuaucucagccugcugcaacgauacaucacagaguagcaagaagaaaacacucucaauaccuaaguauuuuagccuucauuauuuuaaaagacaauuuacaguaauuauuauuacugacaauccauaaaacuuauuaccuuucguucuauaauccuagcauaaucauaauauuauaaauaauuuaccagcauaaugguauaaaaaguaauaauaaaagcaaaaaaugucccagauuuucucuuguauuuauugguuauuuaaucagcuccuucuucugccaucuaucuuuugccaaagcagguaaaguacggugaaaauauuuaucguacuacaaacaaaaaucuagauaaugagcguaaguuuucacaaaauuggcaggaguuuuggcuuuaaauaggcacagccauagcugacaaucugccaauauuuaaaauuauacaauauuacugagaagaaaauuaagauuuauaaaacauuaauuucuagaauauuaaauauucaguuuuaccauuuugagauacauacauuuccuagauuuaaaaagguaagauagcagauuaaaggaaaacaguuaagauccacauuuuaaaaguauaugaauaauguguauuuuacaauauuuggaauaaucagaaaaccauaaagaaaauguaagguuccccugcacuuacugacaagaaaaaaauguguuaacauuuucauuauaauuuucccagguacauguaaauacauguggaauuguaaaacugggauaauauucuaucaguguucuaucauaauuucuuauuaaaauuauaccauuaucaugcuuccauguuaauagucuucaaagacuuuuuuuuaggugauguuucuuguuuuuuugagacggagucuagcucugucacccagccuagagugcaguggcgugauuuaggcucacugaaauuucugccuccugguuucaagcgauucuccuggcucagccucccgaguagcugggacuacaggcgugcgccacuaugcccagcuaauuuuuguauuuuuacuagauaugagguuucaccauauuggccagccuggucucaaacucccgaccucaaguaauccgcucaccuuggccucucaaagugcuggguuauaggcgugagccacugugccuggccuaggagacuuauuuuuaaggaauacuguuauacggcuaaacuuaaauguauuuaaccauuuccuuccuuucugggugacagauaucauugauuugcauuuuucacaauuauauauaacuuuaugacaaauaaucuguaaaaaaaaucuugcauguggucuacaauuauuucuuugaaauauaauuuuagaggugaaaauccuugcucaagaacuacauacguuuuaaagauuauugaucugucuugcaaaauugcuugucaaaaaugccucaccauuuucugcuuauuaaacaaaaccaaaaccaaaauaaaauauuauauucuuguuucaguuuguauuucuuugauuggaaacacuuuuuacaccuuuacugaacaauucuggaucuuuuuuuuuuuuuuccaucaccugguuguucaucuuuuacuuuuuguugcuaguuuuuaaaaguuuuuaaaaacauauuaugauuuuuauaucaauguauugcaaauauuuuuccaguuucucaguuuuuaauuuguugauuuuuguacuuacaugaacuuuuaauuguuauguugccauaucuaccaaguuuccuuuguauuuaugcuuacaagggcuuuuuuuuuuuuuuuuggagacggagucuggcucugucugucgcccaggcuggagugcaguggugcgaucucagcucacugcaagcuccgccuccuggguucaccccauucuccugccucagccucccgagcagcugggacuacaggcaccugccaccacgcccggcuaauuuuuuguauuuuuaguagagacaggguuucaccguguuagccaggauggucuccaucuccugaccucgugauccacccgccucggccucccaaacugcugggauuacaggcgugagccacugugcccagccacaagggcuuuuuaaaauuuagagaacagaaaaauacugaauugcuuuuaguaucacuuuucuaugcauucuuccucuuugcacauugaagucuguaauucuuuggaauucauuuuagcaucuaacguaaaauagaaacuauuuuuuaaaguauagucacauaauuuucuuagcaaaauuugucuucaucccuguuuauuuauuuguuuguuuauuucagaguuuuacacugcaggauccccguucauuuaaauugccaguuucaguaugcacuacuucuuauguaaacaguauucugacauucuaaucaguuccagugauccuucugccuauucuugcauuugugacauacucuuuuaauuacgauggcuuuguauuuaucuuuaacaucaguuggugcaguuucuguuuucauuucaauagcaaucuuaaaaaaaaaaacagaaaagaaaagagaaagaaaacauauugcauaacuuccggauggccacuuaacaaccaacucccgccaggacauaaaugcucucauuucuguuuguaauugcugccaaaugcuacugcuuuaauuuugguuaccuauugagaaaagaacauaggccaacuuaauacaaaaaugauauuuggcccaagugaaagcaaauuacauaaaaguaugcucuguggguggagauuugauaguaguuugauuagaaaaaaguaguagcaaaauugaauuaucacaaacuuauaguguauaggcaaaaugaacucaaaacaagcuacacugaaaaaauucucauugaaaguggaaauuuaguuuacuaauacagucaugcauugcugagccugaacgauggagauguauucugaggagugugucucuaggcaauuuuguugucaugcaaacaucacagaaugcacuucacaaacugccacuguauagccuacuacauaccuaggcuauaugcuauggcccguugcucccaggcuacaaaucuguacagcauguuauuguacuaaauacuguagacaguuguaacacaaugguauuuguguaucuaaauauaucuaaacauagaaaaaguacaguaaaaauacagaguaaaagauaaaaagaauggcacaccuguauagggcacuuaucaugaauggagcuugcaggacuggaaguugcugugggugagucagugagugaguggagagugaacgugaaggccuagaacauuacuguacacuaauguugacuuaaaaaauacuguauacuuaggcuucacuaaauuuguaaaaaaauacuuuucuuuaauacacauuaguuuacuguaacuuuuuuuacuuucuaaacuuuuaauuucuuuuaacuuuuuuacucuuuugugauaacacagcuuaaaacacaagcacauuguacagccauacaaaaauauuuuuucuuuauauccuauucuaucagccuuuucuucuacuuugaauuuuuucauuuuuguacuuuaaauauuuguuguaaaaacuaagacacaaacacacacauuagccuaggccuaacagggucaggaauaucaauaucacugucuuccaccuccacaccuuguccuacugcgaggucuucaggggcagugacacacacagagcugccagcuccuaugguaacaaugccuucuucuggaaucccuccugaaggaccugcugagguuguuucacacuuaauguuucgguuuguuugagauagagucuuguucugucacccaggcuggagugcaguggcgcgaucuuggcuuacugcaaacugccucccgggcucaagugauucuucugccucagccuuccgaguagcugggaucauagggugaaccacuaugccuggcuaauuuuuguauuuuucauggagaugaggcuucugcauguuaaccaggcuggucucaaccuccugaccucaggugauccaccugccucggccucccaaagugcugggauuacaggcaugagccacuguacccugccuguuucacagcaaauuuuuuaaaauaaguagaaggaauacacuugaaugauaaaauguauaauauaauauagcaaauacauaaaccaguaacauagucaaauauuaucauuaucaaguauuacuguacauaauuguauaagcuacacuucuauaugccuggcagugcaguagguuuguuuacaccagugucaucacaaacauaggaguaauguguugugauaggaccuuaacaacagcugugauguuacuaggcauaggaaauguucagcuccucuauaaucuuauggaacugcuguuaucugugcgguccacugucgacuaaacgacauuguguggugugaacuauacagccuaucucguuacauucacuuuacuaguuuuaauuuuguugguuuuauaauuuuucuuauauccaaauuuguauaucauaaaacauuaaaaaaucuuagaaauauauuagcaggaguguauaucuagaauucuuucuauacauauauaauugacauuauaauguuaauuaggucaacagugagaguuuauaauaacuguucccuucaaagauguccauaaaugacucaaguuugaaaguucaaaaggugaaaaauguaauaaguuagcuucguaguuucacuacugacuuagccacuuauuuuuucuauuuuuugagacggaguuuugcucuugucgcccaggcugcagugcaauggcaugaucuuagcucucugcaaccucugccucuuggguucaagugauucuucugccucaggaucccgaguagcugggauuacaggcaccuaccacuacaccuggcuaauuuuuuuuguauuuuuaguagagaugggguuucaccauguuggccagucuggucucaaacuccagaccucaggugauccaccagccucggccucccaaagugcugggauuacaggcacgagccaccacgcccggccuagccacauuuuuauagcuauuaccuuacugauauguuagacuuguucucucaagaguauauaagggagauuuuauuucucagguccuggccacuuaaccagcccuacucugagacucacaucaaggggagcccaugaaagccaggcuugagcaaaaacaccagcuccagccauuggccaagguuugcuucugguuuuuuagcucacacagggcucacuguucuugacucccaggcuaccuggaucuagcuuccuccuguuugcccauuuuaggugaucuucucgaauuccccucuaucucuuagcucaauuugcacauucuuugauccaagaggacccagaguucucaguaagagacacuccccugacaugccccagcuccauggauucccuacuggcuaggcugacacugacccucacccagccucccugccauuggacuggauucugugaagaaaugucaaagaagcacacauguccuucccuuagaugguucauuaaagggaagggagagggggaaaggagguggugauugggguggggaaguuuuucauuuuuaaauugaacauuuauaaaagauaauuguuaugaaacauaagcccccagaaguugagugauacagcuccaugcagcuacaugacagugaugugguucucgaguugaucacaucccaggucaauguguuacuaaaaguaaggcacccaguggcugggugugguggcucacgccuguaaucccagcacuuugggaggccgaggcgggcggaucacgaggucaggagauugagaccauccuggcucacagggugaaaccccgucucuacuaaaaaaaaaaaaaaauuagcugggcaugguggcaggcaccuguagucccagcuacuggggaggcugaggcaggagaauggcgugaaccugggagguggagcuugcagugagcugagauggugccacugcacuccagacugggcgacaaagcgagacucugucucaaaacaaaaaaaaaaguaaggcacccagcucauagcaggugcucacuaaaugccaguugccaucuauaaccaaucucaaguugaauuguggcuuuuauuuuuguucaaaaggaugguguagucaacaguaauuauuugcggauuccauguuugcaaacucaucuacuuguugaaauuuauuuguaauccccaaaucuauacuugcagugcuuucauggucauuugaggacacguguacacacaggcuggcaaaaaaauugaguggcauaacacucaugaucccuacugauguagaacaaggugaugcccugccuucuuuuagcucauacugcaaacaaaugucuuuuucacagccuauuuacugccacauuucccccugacauuuuugugcuuuuuuuuuauuggugauauuacuguuucaaauggcccccaagcgcaguguugagugucguccaguguuccuaagcacaagaaggcugugaugugccuuauggggaaaacaugccuauuagauaagcuuuuuucagacauuaguuauagagcuguuggccaugaguucaguguuaaugaaucaaaaacauauguuaaguaagaugucuuaaagcagaaacaugcauaaaauaacguuauguauugauagguugaugaauauacugugaccagaggcuugcaggaacuuaacccugaauucccucuaggggcaaugguucaguauuaacuuauucaguguuugcagugauuuuaugggucauacuccugugaauaaugagcgucgaccauaauuaaugaccaauggcaaguaguuaucauguagcacgaacugaagaaucaaaaggaaaggagauuuggagagaaauagccugguuucgagaaagguaggaguuggggaggugggggcccaaggagaagcaucauuuaagucuauucccaauucaccaagugccaugguuaacagcuauucuagguagagaauugguacuacucuuauaucugaugauuaguauaaucauuuuguaaaagcuuuuguauucccaaaaggaaaaauacuauauacucuuucagaagagacuauucaguuucacaaaugaaaaauugaagaacauucuucuguguuugaaacagaagcaguuggccuacauuaauagagauuauauaacucuucuagagaaauuauauuuuuagaauauuuccugcauuuugauucaaauuuauaaauacuaauuaaaugcauucauguugaagcauguuaugaaauauguaauuuccccuuuguucuugagcuggguagcuucuacagacugaauuaucagaggcuuaaaaacuucaauuccaggcaaugauauagccaccuacacuagcuuggggugucagguagccagagaggaaaaguggaagucuaacucggaaaacagauaguaacuacauuacuucaaccagaguugaagguaaaacagaaaggaaugauaaauuagaauaguauaaaaaauuacacccaugugaauguuauaacuaaagauauuauaaccuauaaauugucuacacucaauuaaauauaaacuauauguaguuuauauauggauauaaacuacauguuauacacacacucauacacacacacacauaaugcauaguacuauaauugcucagcagcaaaacagauuuugccuuucauauaguuaauuaagaaccagguacuggcugggcacaauggcucacgaguguaaucccagcacuuuggaaggcugaaaugggaggacuacuugagcccaggagguugaggcugcagugagccaugaucauauuacugcauuccagccugggcaacagagugagacccugccucaaacaaaaacaaaaacuggugcuauauuuugguaauaauauugaaggacagcauuagaggagaaaaaggucuugcccagcaaugcuguaucuaauuuugaucauaauguauuauguaauuacuuauguguuuucacacauaaacuauuuucauuauaucccugucauuaauaaaaaucauuuuuccuaugguuggugauuuuauaaggacaguaguaucaaacguauuuuaccauuuuuugaugugucuuacuucugacaccauauaacauaugaacuguuuaucuguuggguuguuugauauggcuggccuuguaucgcugcuaugugggugauuguguaauugguuuauuucccauucuucgcagucccuguagugucuauuaugguuucucaaauaagcuagacgcucaguaaauauucacuggaaggcagccaaguuucauugccuaaggcguagcgaaaucuuacaauuuuauguugccugggcauccauuuugauuguaaguuggacuuucucauagcagaugcagggcuuagugaaucuugacaugauuucuaguucucugcuuccuccuagcuccucaaggcggucaauccagguaucugcuagugcccaccuccccaggggacagcucaauacaaccuaccugacucacgcccaagaccccucccgcugcauggacugcauggagaugccacaguuacuaccgcucaggcacaguguggcuccaugaaacugguaauuguugcuguaacgccccccaccacccacccccauuagaacucucagcaggaaaccugcuuggguaacuccugagaccccaacaaagucuuaggcccugaggucucuugugaucucuuuugcuccccacacugguggagccugcguguccaggacagcuccccuuuccuguuggcccugagaggcaggcugcccucucugcucuggaucugugagucaaacgcugcuucuguuauuucauguguuuugcuguaugaucuccucuuugucucaccugagcaacacacgcgaaccuaacucuccuucugcucagagcuuucacagagagugauucucuugguaggaauaagcuagacacaggguggcugggcgugguggcucccgccugucaucucagcacuuugagaggcugaggcgaaggauugcuugagucuaggaguuuaagaccagucugggcaacauaguaagauguugucuacaaaaacaaagcgaaaccaaaaaccaaaaaccaaacaaacuuaaaaccgaaccaaaacaaaacauacacuagacacagagcagacaaaagccaugucucagucuguuugggcugccauaaaaaauaucuuagacuggguaauuuguaaacaacaacaacagcagauugcuuacaguucuggaggcugggaagcccgagacagagguagcaguagauuuggugucugaugagggccgacucucugcuucauagauggugccuuccagcaguguccucacauggcacaaagguggacaagcuuccuugggccucuuuugucugggcacuaauccuguucaugaaggcucugcccucauuaccuaaucaucucccaaaggccccacuuauuaacaccaucacguuaggaaugagguuucaauuuacggauuuuaggaggauagagacauucagacuauagcacgccacaaggccaucugccaguguaaacagguuuuccuguuugugggacaccuggccacaagucacaccugggcaucaggccgucugccaggauaaagaaguauccaguuaaaggcacacugaacauccacaaccacgucccgggaacccccuugggucggagcuagaacacggagaccccgagacuaaauuagaaaaaaaaaaaaaaaaaauacaaccuaagguaacauaauuaacaagcuauuaguuggccaaguuagauaugaacucggauccacacgggucuaaagcuuguacucuuuucauuuuuaccguguuaucuccuuaugcuuuuuguuugauuuucuaauacgacagguuuaccaugggucauuuuuaugucuguuacaagcucaagugaaacguaucuuuaaccauguaagacaugaaaaauaauuuacgaauuacaaagucaaauaugccauggaauagucaaauauaucccuuugugcaaugaggggcaggcacaauaaaacugaguaagggcuaaaagcgguuaugaaaagauuuagaaaaucauccuugagacuccaaaauaaguauuuggccuagugaaaaggauacuggugaagaaagguuguauaagauacuucaaguaaggaaagaauaauuaacacagggguuucaauggcaugcagaaacaaaacaaagcaaaacgaaaauacgagagacuuucccaagcacauuuggugcaggucagguaccuacuuaauuaucuaaccagcaauuaaaauaggaagaaagggaaauauagggagagaaauagaaaaguucagauuaaaacuagaacuagucuuuuaacuacagagccgaagaaaaaagauuucuuauccuuuguaagauauucuuuauuauuguaguuaaggcaauuggcaaugauuuuuccauaacucaguaauuaaagccuuagcuugacaggugaaagccagugcuguaugaggagcagcucugagcaaauuaaagacacaaaggaaaaugaagaggccuccuguguguuucguauaucaagaauauguauuugcuuccuggguagucuuauaaaaaucaaugucuuuguuacacaccuugaucacagcacaugauuuuauaaugguuaauaauaagagaaucagagguguacugauuauuugccuuccuggggguaauugucaaacagccuuuaugugcuuugcaagggcuguaaagugguuuagcaacauauuuaauucugaguuagugacacugugacucacugggagguggcaauguaucaggcugauggaauauguaucacgucaaaaugucagagauguagugucaaaccauaaagagaugcuuuuagcaggugaagucuugcaucaaagcugauauuugaaauugucuggagagcauuuaaauuugcacauaauucucaaugggacuuuacagaacauuuguguggcauaugaacagcaauaugcugaaguccgagacucacauacuggaaaccacaacauuuuugagacuguucuugguuuaaagucauucauggcuuccugcuuccuggaauguuuaggugggguuuuaagcauuuuucaacauacaguggccauagcuuuuaauuuggggagaaaaauggauaugcauuaugcaggcauauugaggaugcugaagagggacgagguaaacagcgaacagccuggaauaagagaacagucagcugggccaggcauggaucgugaauacccaggaggugguauggucuagugucugugaaaagcagcaaauaaguaaguuuggcagagaucuuacaaaugggaacaaaacagagaggaaaaacaacagaggguagaccaaguuagcagaaccugggugcagguagaggcugagccucuuuggagucaaguagaauucagcaccugcagaaccagggcugggucuguccuuuaggauaaugaaaaggggccgugaugcuaacacgcuuagaaccagaagccaaagggaagacugagcuuuaaaaagaaaucaggcaacaacuccucccuucccccuccaccaugcccuggcaaccuggcaaccaccuacucucuguuuugauacauaugaguacuuuggauacuucaugguauagaguuuggguuugcaagaugaaagaguuguggagaccagaugcacguaaacgugacucuacuuaaugcuacugaacuugacugaaguggagucacugaacgugacucugcuugugcuuaaaaaugguuaagaucgucaauuugguguuauguguuuuuuuaaucacaauuguaaaagaaauaacagaaauaaaucaggcgaaagaguaggcagcagcugugcuggcaucguggccuucuguaacuucagcugaccuuucaaucuucccagcaccaagcacagaaccuggaacuuggcuugacaaagguguaaugcaugaaugcauuucugaauaaugauggauugcagcucacuccagaaugccuguacagaagaguuucucaaguuauauccaguuuuuuaaaaaaauaauuuguuauuguauauauuccguggagguucuaucucauucuaccuuuuuuuagccuuugcaccuaccauaaugccaggucgaaaguggguugcucaauagaugcuuguugacuaaggugugacuguuuuaaacuggggauaguuugcaaggaauugccugaaacuauacuaaugauauucuucccauaaacaaguugcauucugagaccucucauaaucaaaauuuaguuaugcauuugcaugaacuuuguggagcuauaaugugauacaaagaagaaaacaggagcuaccagagaaaauaugacauuuuaggaaaaauguuucacucucuacagcuacucuuguuaaguaguggcagcaaaagcgacacucagauuaaucuaggguugaaaugccacgguucuccguucuacuugccugccucuacuccaaaugggcuccauguuuguggccugccacagcuuuucauguuuuucaaguuggugccuuacaaaacccaguaacuuauuuccucucuaaccacaucuccaugcacaugacagucaauccuuccauuaaggguuuggggacuugcugucacacugcaucagcuauuuccuguuaauugcaguugugggcuuucucuccaagacacuuuuuaugaaaggccuauauucauuugccuggaguuacugagggguugauuugccugaaagcauagcaauggcuaaauaaguaugaaugucccuucccacuaaagaauaaucacaguagugucaaucuuguuuucagaucaauaauaagacaggccagcaggccugcagagucacauuaugcuuucacagaagcuuuguuuauuuaggaauuaugucuuuauguuguacaucuauaaacuaugaacagaagucacgauggaaaguggaaguauacgauguacaauuuucuaaaacuguuagguacacuugauuuugccuccaaugauccuccugccucagcaucccaaagugcugggauuacaggugugagccacugugcccagcugccucuuaaaaaaaaaaauuugcucucuuuccauuuccuaccuagaguuguucccauuucugugcuucauauucuccacaccuagacugggaaucucuuggggucaggaauaguuucuuguuugugcugauagucaugguuccuugcacgaaggcaaaauucaacuuauugauugaaugaauauacaaaugaaugaaacuguguguguguuuguguaugugcaugugugcagagcacacacugcaugcauaccuauuuuaggaaaaaggcggggugugggauaggacugguagaaagcacagucaugcagucaacaucuacugaaaugauucagaauauuguucaugucauuucuugauugugaccgacauuagaaccaccuagaaaguugaaaaauauugaugcuggggcucuuuuccagagcaauuaagucaacgugucugaggauggauccugggaauggaaaugccauguaaugaaguuucaucugagguaauuuccugcuuuuucuuuaaggcuuuguagaagagagaucucuccgugguuguaagcuuaucuugagcauacauuauuuucaguuuaguucagaaaguuaaagcauuaucauuuuaaugcuuuugcuuauuuuggagaauuuuccauuuauuucaguuauuuuuucccuaagcuuauuuugggcacaugguuuuauuuuagaaauucaaacauuugccuuaagcuagaugugaauuuaaagggcaacaagugaauuuuaaguaggugaaaaccucaagagaaagagccggcaucugaagccaaaacuaacaaguucuaauuuauauaagguuggcucuguggucaauuuagagagagaagggauaguuuuguuuaugcccaaggaacaaagcugccuugguagaaagaacagagaauacuuccuaauaaagcuuccauuuaguaauucaggaaacaacuacuauaguaagauguuuucugaauuucugaauugguuugugaggaaaaacauuagaaaugaaggugauuguucagccucaauccuguuacuuuggcaucucugaaacucuuagaugagaaagcagaggguucuuguaugugaccauggagccaaugcaugcaugaaaaagcugcugaaaccucaagaagugacaugaauauuggguugcaagcauccuuagcucuuuaccauguccccacuucucaguaggugcugagcaacgauggugcaaaguaugcgauggaggauuggaaaaccuagggguugguacugguccugccauugacugaccacaugaccuggagguaaaucacuaaucuguuuuuggugcccaguugcugugaugguuaaauuaaggagucagcuugacuggauuaagaaauaccuggagaguugguaaaaauuauuucugggugugucugcaagggucuuuccagaggagauuggggugugaauugguggacugagugaggaagauccucccucaugugggcaggcaugauccaauuugcugaggucccagagauaacaaaaggcagaagacaaauucuuuuuuugucucucccagagcgcugacacucuccuucuccuguccuuggccaucagaacuccaggcugucuggccuuuggacuugaacuugcauaauggccaccuggguucucaggccuucagccucagacuaagaguuacaccaauaauuuucccgguucugaggccuucagauuagacugagccaugcuaccagcuucccugguucuccagcuugcagagagccuagcguaggauuucucaaccucccaauugcaugagccaauucuccuaauaaaucucuucucauauguacagauacagauguauaucuucuauugguucugucucucuggaggcccuuaacuaauacaaaaaggauuuaacaaaaagagggccuguugugggacuuagcuuucauaauuguaugagccaauuccccuaauaaauuccuuaucuaucuauccauccauccauccauccauccauccauccauccauccauccaucuauccauccauccuauugcuucucucucucucuuuggagaagccuaaaacaguuggauuacuugcuuuaauggagucaguuaccauccugcuuaauggaguuucuaugggcaucaaaugaaaucaugggaaauacucuuaagcucuuacauaaauccaauuaaagaaacauuuaauggguaccaaacauguggagggguagacuaaacucuugagacacaaggauacuauaagaugauccuugacuuccucuagugauucaccauuuggggagggaaacagaaacagaaauggcaaaaaaggugugacugagaaaugcuuucauaaaaauagaauuagaugcuaugggaacuuuaaugaagaagaaacaauggauucugcugagacgagaggggacaaagaggggguguugaagagauuuccuaggaucauagauacuugaacugagucucaaaggaucagagaauuuuaacugcggaagcagcuugggaaagguacagauucaugaaaugcauacagcguucaaggcagucuggaugauauggagugauuagcaucugggguugaagugaaacaauacaguugaugggguugauggacagguugaggcaucagacugaauugccuugaagaccaugcucuauaguuuagauuguauuuuguaacuaauaagaagauauggaaagguuuugacagaagaauaccaugauuguuuacagauguaaacuauaaugaucuauuuguuuaugaaaacaaauuaauuuuucuuuuccuaauuacauacugaaguccuacaauuguacaguaguuucccccuuauccaugggaaauauguuccaagacucccaguagaugccugaaaccacagguaguaccaaauccuaaaagauacuccuccacuuacaauggggucauaucccaauaaaucuacuguaagucaaagaacauggaucgcugucccaccauuguaaagcugagaaaauuuuuaagucaaaacauuguaaaucaagaaucaucuguguauacuauguuuuuuuccuauucauacaugucuaugauaagcuuuaauuuauaaaugaggcacaguaagagauuaugagaauaauaaaauagaaaaauaauaacaauauauuguaauaaaaguuauguuaugugguucuucucucucucuuucaaaauacuguauauuuucaagccaugguuggccacagguaacugaaauugcagaaagcaaaaccacggacaaggggggacuacuguauuuauaguucaacacagauuuuauacgaguuggaacacuaguagcuagacuuagaguucagugaauugaaugaucauugugcuuauuuuuuauuauugaccuagauguaacccauuaaaauuuauuacaaaccaagagaagcaacaagugggcacacagcugcggauuggacauggcccagagacagucugauacacauacuaucugccuuauaauuuccuuccauuauauuaagucagaagccaauggcugcuccuuuuaaauaauucuuuacaugaagauugccauuuuggaaggauuucgacauaguuugagaugaugggggaggggagcaagauauaagugacuucugcuuucugaaaacucacaagacaaggccuuaguaaugucuucaaauguuugagugcuaugccaucuaucuuugaaaauauugaucagugggcaauacuggauucugagcuuaaggaaaauuuaacaagagaaaaguaaagcccccauuuaaaacuuccuaggauaaaauuuuaaagaggccuagcaaaucuucucaacauagcucuucuaaaaucugaaagaaaguaauuagaauuauuaccacuugugcuaauuauguaacaauuagcuauuugauaagaauuuuuagcuauuagauaucagucacauuuacauuuaaaaaaacacauaaaguuggcuuuauguguucuauauguugacucuguggaacuuugagauuccuuauagaaucagacauuuccauccauuuuauggaguuagguaauagaaaucacaugggacuagaaauuaggaaucagaauucuagacuugauucugcagcuaauauauuauaugauuauggguaaauaacauaacugcucgucuuaguccacuuugugcuguuauaacagaauaccugagacucaguaacguauaaagaauggaauuguuuuucauuccauuggaaugaaaacgucccuuuggagccugggacauccaagaucaaggcauccgugucuugugagggccuucuugcugugucauaacaugguggaaaagcaucacauggaaagcaucacaagagagagcaagagaggccaaauucauccuuuuauaagcaauucgccccagaaaccaugagcccacuucuaagauaauggcacuaauauuuucaugagggcagugccaccaugauccaaacaccucccacugggccccaccucccaacacugcugaauuagggaucaaguuucuaacacaugaacuuuggggaacaguuucaaauuauagcauuucaucccugguccaccaaauucaugucuuucucacaugcaaaauauauucaaucuaucucaauagacucuaaacucuucacucaucccagccccaacucaaaguccaaaguccagaauguuaucuaaauuagaaaugguugagacuaacagcaugauucacuugaggcaaauuucccucuagcuaugagccugugaaguuaaacaaguuaugugcuuccaaaauauaauccuagaacuaaaacaggcauaguauagacaugcccauuuugaaaaggacgaauaagcagggaaaaagggguagcuggucucagguaaguccaaaaagccaacagggugaacacuaaaucuuaagacuccagaauaaaguuugacuucuugugcugaacacacuggaguugagguugggcccucaaagucucaggcagccucacccguauagcuuugcuggguucagcccacauaggagcucucauggguuggaguuucauaccugcaucucucccaggcuggggcuacaugcuaguagcucuauaggucuggggucaggguugugggguuugcccuacccccacggcuccaccaggcaucgccauagugggaaaucugcuaugacuucugucuguaccaugucucugccugggcccugaggcuguccaacacauccuuugaaaucuagguagaggcuaccauggccccacagcuaauguacuuugugugccuacaaaauaagcaccauauagguaccaccaaagauuacccuuauacuuucuggagcaccagcaccagcugcaccugggcccacuugagccacagcuggaguggucgaggacugcuacacuggaaugcagggaguagagucccuaggccgcccugggcagagaaaccaaggagggcacucugagacucuccucugaaaccauucugcccuccuagagcucugggcuugugauggagggagagccucagagaucuccaaaacaccuucggguaauucucccacugucuugauaaauagcaccuggcuucuuucuagcuguacuaaucccuuuauuaaaggguugcuuggcagcaccuuuacauggcuguucauuacauggccaggccacagauuucccaaaucuuucugcucuacuucuuuuuuaauuauaaguucugucuuuaaaucauuucucuucucucuaaucuuacuauaugcaguuaaaaguaaccaugcaacuccuucaauauuuugcuuagaaauuucuuccaccagauauccgaguccauuacucuuaaauucugccuuccauaaagcccuagggcaugaacaauucagccaaguucuuugccaauuuauaacaagaauggccuuuacuccaguuucuaauaagcuauuccucauuucugucugagacuucaucagaaugcccuuuauuguccauauuucuaccaacauucugaucacaacaacuuaguaaucucuacuuccccuauauuucuucucuucugagcccucaacagaauuacccuaaauguucuguucauagcaaugcaugcuuuucccagccuacuccuccaaauuuuccaggcuucuacccauuauacaguuccaaagcuacuucuacauuuucagguauuuacuauagcaacacugcucucucugguacccauuuucugucuucgucuguuuugugcugcuguaacagaauaccugagacuggguaauuuauaaagcacagaaguucaagaucaaggugcuggcaucucguaaggaccuucuugcugugucauaacauggcagaaggcaagagggggucaaacucaugcuuuuauaagaaauacacucccaagaccaugaauccacuuccaagauaacagcaucaaucccuucaugagaguggugcccuuaugacccaaacaccucccauuaggcuuaaccucccaauaucccugcauugggggucaaccuuccaacacaugcacuuuggggggaacaauuaaaccauagcccugauaaugaggacguaagacugggugauuccaaauuuacuuuaaauuuuauccucuuauaaccucuaaugugggugcuacacacaggaaauucuaucacuugaaauucaucuguucacuuuaucucuauguuaaccugauagauauagaugucucauuuauaucaaagcauuuuguaucuacuuuucugcuaauaaugguaccaggagcaggcaugucagcauugcucacuuaacaguuuuuuuaugauuccuacuaugucuuuguuuauucuagaguuuuucuuuuagaauuuucuuuuuccugccucugucacggugaaugcuuucucuaauguuugaugaucacuggcuaccuguuucuccuugaaagaguuuuuaaauucccuccuuggcaggaauauaggaggggguaagaagaaguaauaugcuugcugcuaguuuccugguagggagauuuaaacagaugugggcaauccaccauccuuagcucaaagccucucucuguguguauacguauaugcacauacacuugcacauacuauaaaaaaugcaaucuaacauaauuuauggagaaauuaauagugaaaacaaacugaacauguuaaugcucaauucuaauuucuuaaagcuaauaugugcagucaaaaaucuaacagauuaaaacauuccaagcaauagacaucucuaaaggagguugucuugcucagaaucucaggauuaagcauguucucacucauaaguaagaguugaauauugagaacacagggacacagugaggcgaauaacacacacaagggccuuuguggaguggcggguagaggaagggaacuuagaggaugggucaauaggugcagcaaaccaccauggcacauguaaccuauguaacaaaccugcacguucugaacauguaucccauuuuuuuuuuuuagaagaaauaaaggaaaaaaaaggaucuuaaggguaaaaaugugucucuggagauuggggguggaguaggaggaagucuucaggaaagagauacaucuucuaaauuacgaagaauuucuuauuuuacccaauuauaauguauauagacuuagaaguauuuuuaaauucagcaaugagauggaagaggaaggaaaucuggcaggcaagcagauacagacaugaaaaaucugcucaguggcaguaguucuuuaacuuuuuaagaucuaugagcccucgcuagguguguggcuggguauuauucuagaccacuagggagcuuggugaaugggagagucaccgaguguugggauccagucaucccagucacucugucugcguggaaccuggcugauauccagcccugggucacucugugccuuucaugaauucauggacuacaacaaaaugauaugauauaaaugauucaagggucaaauuuuugagccaggaauaugggaucucuucauuaaagaguguguuuuguguugagggggaauuucucagaacaauccaaagugcucaucaacauagaaaaccccuaaaacuggcaagcagccuucgcgucagcaggugaggugaauggcuccucauugguucucucuucugcuuagcgcccaagggcugcugcuucuguggguuggcugcuguugaucagaaauccucugaacaagugcagaggauuucuuuguuuugggggauguucugcaaauaaggugucauguugggaccuugaacguuucccuugggugucuccucccauaugucacuucuccuuuguucuucugguucuuugucauuuccucugauuuugagaucugagcagagaggccaugaguucuccuggcaccuuucacugggcuccagcacgguagcuccuucggucugacuccuacccucucugucucuugcccuuguacucaccaaccacaugcagaguugcacacacacugaugugaugucaagcuucagggagagcccagaaacuuugucugagacaccaucuguaccugcuggcgcuauuauuuucuugaaauguuaguuccccagugccccuguagauaucacaaagaucuuucagugagacauagauggacugucaaugucuccccaauagagccaugaccacagccagauuagcacaaccuacugacauccagaacaucucuuccaggcggauuucccccauugccuaagccccucccuagcauuaaguuagauguuuagggaggcacauuaauucuuucagaccacuggggaaacaucuagggcaccgcgcggcugcagucacagagucagggcagacagaugggaggcgauuugucgacuugcaacaauaaagccuugauguuacccuggagaccuggcagugacgaaugaucuucccuaaguagauaacuuaguucuagggagugacauagccuuagggaaugagaauuuauugugauauuaggaagaaacaauuaauguccucucugacugagucuccuccucaguaaaucgaggguaaaaauacugccauucacuucagagagaccgagugcagccaggaaaaaggaaagaggugcacuguguaaauucggcacauggaaauaccuuguccacucagcaaucucagcguauguuacccaggaaggcuauuccccugggcaacaccacugacccugggccgaacauuucuguaucuacuggaugcuauuaauacuucuauuuagugcuauuaaauacauuucugcuucuguugaauacuauugauuuacuuucuauuaaguagcacuuaaguaguauuucuguuucuaccaaauacuaaagaaaauguuuaaaguauguguaagguguaaggugucaugauacaaugaccagcggacuucccaccuaauuuuagaaaacaagacuucagcauuaucacugaagcuuacuguugaccaaggaggcuuuaaguuccuuucagcuugacuaaacuucagacagcuuucuuccugacucuaggccuuugacuucucuuuucuuagagcacuuacauuagaaaacuugcaauuguaaauucuuacucugcccuuugagagguaaaccuuuuacagcccaggaguguuuuucuuaaggacccgggagcuaucccuuugaaauguuguuaucaagaagggagggccccagucucucagucucuguggaaggguaaggagccuaaauucuggaagugccaauuaggaaaugcagauggccuaaucacaucgucccaccaucuuccaguaccuguucucuggcucacuucaugcuugaaaacuuuccagucuuuugugccaauggagucuaguucaaucucuccccuacugcaauagucuuaauccauauuacaaucguuucaaagaaagucucucugccauuuuuaaugagugucuggugcaauuuuucuuuuacgcuacgugcuuccgccugauuccauccacuuauuuccuccugacucagaugaaacugcucucccagauuucagguuuaugguucccuugauauucuuuauaguugaccacauuuuguagcccuaacucacuuaauaguuuauuuuuguuuuugaacuucaucuaaaugaaaauaugcuguacgcuucucaagaaauuacaagaauaaacuuuaccaccugccaaaaaaaaaaaaaaaaagagcuggauaaagaaaauuacuaccaaacaaucauguuuuuuguaacucuacaaacaaaggaaugggcccagaaccggaagaacuaagaauauauauauuuuuaaaaacuuagagaaucccuaauccucugauucuuuuuuaaugacacuuuccucaagcauacauuauuccuugacauugaauuuccccagcauauguauucaguaguccccauugguagauaacugcaacuauuaaagacaaucaaacuuuucuuuaacuccauauuuuaaaagaaaaaauauaauggcauauuaaguacauugacaauuccccuuucuuuuaauuaaauuccaaaacuuucuuuccccaugcaacaauacaauaugcacaacgauuaagaaacucuaauugcaauucuaguuugugauuucacagagaccuaacuguuacaucuuuguugaugacacagaauaauucaaauuagagaggucaaaagaggauuaagaaaagcuccaaaggaucagcagcacuugguaauuuaacugggcuauagcagccggaaagcaacacagacagauacaacaacuagacuagaacuuggaagaugcuauuuuccuggcauacucaaauggguuggaaauuaguuaaagguuauucacugagugucuguccucugaagauuuccaaccagagaguaugauauuaagaagacauugauucuaggauguaaaaauaauuuuaaacacuuagaacaucucccuguucuucuccaccacaauccugccaaacauaaaacaguacuggaaauauaccuuacaggaguauuugcagauaauuggucuuauguucauauuuggucacagaaacaacuccucaacuuuuaucaucagacaguuagauaguucucacagagcuaagcacuaagacccuauucuacaaauuuauaugugguggaauaaaauauagucauacauucucugagacuaccaucgagucaagguauuauauucgcagguuuaaaauuguaauuaaaagauaguauggaugcuaugcugauauuuauggaaaccaucaauucuaggguggcaacaauaucuccauuuacccaacguguuuucagaauguguuuauauagagaaauuguuguauaguuucauuucagcagcuauguaacuugugucuagcuguucacagcauuaaaaguuuuaugcaacuccuucauuucucuagagugucccagauggaagucaaaccuauauauuuucugcaaguauaacaaaagagauucacaccuauuguugggggcaauuagcaaacucggcauaagaaaaaaaauuccauauuuucugccacauaaugccucuaagacuaauuagaauauucuuuauuauagcugcuuuucuagcuacuuggugaaauuuaucacugacauuaagcauagaacuuuggaguugugcguguguuuguuuugcugagcucacuguuacaugacuagaauaaucaaaaagggaaauuuacgaaugcaguagauagaauggugaaaacucacucaaauuaacaucuccuaagagagguuaaaaguguguugcccaaaaggauauccagauucugguagggcacaaucuuuuucaauggcugccugaaaauaaugaaauuuuaauaaugaaaaauggaaauuuuguacaaaauaugauugggauuuuauuuggagacauaugaaaacaaaaacguaauuuucucccaauugucauacuaugaugauuucucuucccccaaaucugaaacugaagacuuguguuccaggaauaggggaaccgagagccaucaguuucacggcuucauacuguagaaugaucuggggagaugguguuguuuccaaaugcuuucuguuuggaaggcuuugagguugaugugguuaaaccugaccuugggaugcacaggaaggacccaugugaaccuggguugugaagugaaggcuaagccugauucuuuuuaguacaaauucaguguucauuauaauacucagguugugucucacuuuauucucccuacacagaaugcuuuaaauggcuuuucuacacugagaaguauacaacauauguauauauuuugagacggggucuuguucuguuacccaggcugaaaggcagcgacacaaucauggcucacugcagccuugaccucccggacucaagugauccuuccaccuuggucacauuuuugcuguccgggggucaucaguuugaucugagacauugguucagagagccuggguuaaacugauuuuucccauauuccugaaaucagccaagucauccaaauguguggaacaugagaucuaccagguggcaaccuugauuauuagaccucaguuuucuaaacagacccugaucuccuuuggagagcaugaauuugcucuugagagaaaucaguuacucuagucaccuucuaugacuuuccagugauugcaaaugggugaaaguuguuuuuagagggauauacuauuuuagugaaaguaaccuuaugacaccgauuucgucuguacaauuacauuuuuaaagguguaaaaaaacuuuaguucaggugggcacucauuuuugugagaauuuggagauuauuucauauguuaagguuaagagaauguuuaugaguaugaaggaaugcuacauuuuuaaaauaguguguggcucuacaugccucgauuugauaucaucuauagguguuauugagguugggagagaauggaaggugacuucuguaauuaacauaaaauaaucauugucauuuuacgaucaucaaagucaagaguuucagaaauugagaggcccaaguugaguguuucaaccucaggaauaauuuucaauuuauguuuuauaacugauaugaagcagucaacucuuucacgaaaggcuaugaaauccuuucuuuuuuucauauaugaccauguauaaucaaaauaaaccucuuuacaaaauaaaaucauaggauuauaucagcguuucucaaauuugcuugaugguaugauuguuaaaaguacagauucucuugugucuguugagauucugacccaacagguuggaguggagacuaaaaaucuauauuuucaacacauucccuggugauuguuuucauuugacaaguaggaaaaugagggaccagaugaauccuauaaacucuuccaguuguaacauuccaugaacccauaaucacuguccauccuggaugucugccuuaagacaaauaagaauuaaaucuuuuccugauugguaaacagacugucaaaaacuuuaggugggcugaauuugagagaaagaaaauuaagaaaaaauucagacagcaggagaagccuaaaagugcuacauagauucuauuggcuaaacuuuucacuaaguuaucaugacaacugucauauacacuuuaaugugaagaaaacuagauauuaaucugaauaggccuauggagaaagggaucuuucagagagaaguacuuauuuaggcuguuuuguagaccacacacccaauauuuucauuaguucguauagugggucuuguuuagaucugaaaucucuugcuuuucucacacacagucgugugaaaacccacagaaaaaauuagggcuagcaugauaucuguugguccaaagucccuuaggucggaaacugcucuauauuuugcaucaaagccucuguuaguaugugagaaagcucagaaaaaaacaacaacaacaacaaaaaacagugacugcugccucugcucagagggugugcuuugacauuaaugguacgagaaaggguuguggcggguuucaaauaguuagaugacaauuugguuuugacaacaugagguuuugguagaccucagguacugauuugcagugucauuauuuucauacgagaaaucuugcuagccuguagcaagaggauuaggguucuaacuuuuauuggaaugcagaaguuuuaaacuugagucuuguagaguuuucaagcuguaugaggugggcggguaucugguucaaacucugaauuuuaaaaacaagagauccaaagcccagagaauguaaauaauuuuuucaaagugcaaagccugcaggaggcaaaucaagaaucugacuuacucuuuuuacuacaaauucagugcucauuauaauacucagguugugucucacuuuauucccccuacacagaaugcuuuaaauggcuuuucuauagugagaaguauaaaacauauauauauuuuugagacggggucuuguucugucacccaggcugaaaggcaguggcacaaucauggcucaccgcagccuugacccccuggacucaagugacccuuccaccucagccuccugaguagcugugacuauaggccugcaccaucacacuaauuuaaaaaaaauuuuuuuuuuguagagacgaggccucacuauauuacucaggcuggucuugaacaccugagcucaagcaaucugccugccucggccucccaaagugcugggauuacaggugugagccgccacaccuggcuaguauuuuuuaaaguacacuuuuucuuuacuuuuggggguaagcugucauuuccuggaaggcagugauguaaaucugccugcuuuguccuaagggacaaggguccaaccucugcccuugccuuaccuuuuccuuucaggucaaaaaguccugcuauccuggacugaagcaaacaauacagugugacaauuuuaagaaggagauugucccauaccgauauauuagcaaggccuaaacacauuagaaucggucauauagccacauaugcaucuuaauauauuauuuccaaaaauacuuguuuucaaacaucucuuuaugaaaaggauccugcuguuuucucucauuauggauaauuuuuucauucauuaggcuuaagaugagauaaaugaauuuggggagaggucacucaugauccaauuauaaccugcaaguuauuacagaaagaguaaguauuauguuauugcaaguaaguaaguguaagaaugguaacagagauuaaauaaucaagaaagaaagguugagaagagggaccauagauuguuuugaguacuaagguaacaggaaguauuuguauagcagccugauggguuaaucuugccugcugcucagaaaagucaaugcauugaguauagcagguauugcagcaaagaaagaacuuaauuauugcagggccagccaagagaaggaugagagauaguaaaacuuggaggcuaguguuuuucaagguaauuugguggguagggggauggggaaugggugcugcagauugacuggggauuaaaucauaggaauguccaaaauggucuuugugcacugagucaguaucuggaugaaggucacaggacugguugagccaguucccugguaugagucuuggguucagguggcaucagcuggucaaaccaaaugcaaaagucuggaaaauaccucaaagcccaaucuuagguuuugaccauauggauauuaucuaaaggagcaguuggagaaguuacaaaucuuguaccucuggaacaauagcugguuauuguuuaacuaugcauauaucuuagcagaauucaggccccucccauaauccuaaucuuauguccuuucauuagacuuacaaacaugguuucagucccuaagcaaggagggguuaguuucaggaagggauguaucauuuuuguuuuaaagcuaacaaagucagcuagcuugugagguuagaagcaagauggagucaggugagauuccucucacuguuagaauuuuugcaaaggcaauuucauuugcuuccaccucugacugcuugugagacaugaaguucaguccuugaaacucaaagaaaggagaaggcagggggcuucucugguguggcccagagaaaaagauggcugccugugaaggacuuccuguacuuugauggauaugaagaauaauaacaucccguaugcaauuugaugauucucaccuuugcuaaaaacuuguaacaugcuauaacagaauuauauuaguuggguuauagugucuguuuugggggucaaauaauguagaagaaagcuaaacauuagcagcaugguaauaacauguugaauagugaguguaaaaguuggguccuuccugaacacuccuggaagucauugauaaugugaggaacaaagcuggguuuccuagaguaaaguaucauagcggacugaagcacuuuauucagauaguaauaaugagggaagcccccaaggcugaaacauuuggagacacuguguuuccaguaucaugcagcugcuuucauagcuagaaguguguguacaccacacuucguuuucuuucacuguggcuaggagauagggaggagaacaauggaugaacaaacaugccuagcggguauggaggccacaauuuccaaauuaacugauuuauccaggaagcugagcucuaacuacuuguggugucuggaauuuuucauucuguaucuagccagcucuccaaggauuaauucucaggauguuauaaaguuuuuuuuuuuuuuuuuuuuuuacacuuuaaagguugaucuauaugggugauucacaagugcaagaaguguguaguagacuauuuguaaauuguacucccaaggauauagcauaaaaaggcaacacugucuacuucuagauguuguuauauagucaggacagugucaagugcaggccuccuuuuaugugaauuugaaagaucuuucaguucuguaacaugaagucuuauuaaguuacucuuauggccuuucccuucuucaccacaaaugcaauuucagcaucuagagaguuuuguauuugggaggaaaauucauaaaaucccagaagguagaguuacaggacuuuccaacucaaaauguaaauuaugaaugcucauaaaaggaggacuuucagggaguugguauaaaaauugauguguggacuuuaaaggaagucccagggacagcaaacagcauccaacuucauccaauggcuucaugugccacaaaucaguaaguuuaaucucugaccuggcaccucacagaauccaccaagacaucucacucaagaagcuggugcagcugugugugcauuucacagugugaaaugaagcguuuauugccucaucuccccugaucuucagcagccugggugcauugucaccuacagggcuauuggcauuucuuucccaauucaggcaaacauccuccaaccagacaagaggaaacacucaggggaacagaaauaaaaagaaacauggagauucauuauaacaaaacaacagaugaauauuuaaacuaauuuaaguaugaccaaugagcugcauaaacuguaucauuaaucacuccggcacacaugagcuugcuuucugggcuaaaaauuaugccauuaaaauucagugaaacuuagucacagugcaucucucucuacugaacacaguuagcuuugauuauucccaggcuuauaauguauuuugugcaucgcucaagagacauuugucuccccuuuuugcuuuuggguagggaaacaauggagauauuggaaacggguaauuucagaggaccuaugggagcugcgguuuaauucagaaugacuugucucagcuuucuaacaucuuuauaauugucauuauggcagugcugugugauaaugaugauggcagggauggggauugcuaugagugacacccaaagaagugacugagcacaguagucuuaagcuauuacugccgaugagauauuuaacggugcuguacaggcagugucacagggaugcacuucaggggcgucuguuuuauauucagauuucaagcaugaagacacucuuucugauaaucgggcuucgaaaggucuguucucaucguuauuuuccuagcacugaugaucgggcagacgguguggcuacaagagaaacugcagacacaggaaggagguccugccagggagacgagagcauuagacauccauucgcagaguccaaaaaaaaaccaaccaaacaaacaaaaaagcaaacuaaaacacuccacgaacaguaauaagggaaaaacaaaaacaaaaacaaaaaaacaggccacgccaaugcagcccagaccaaaaccacacagggcacacugauggaacccggguacucccauagccauggucacuaagacuauuacuuauuccagaggcagaagccacacuggauauucuuacagauucuuuuucuuuucuuuucuuuuuuuuuuuuuuuugagacggagucucccucugcuacccaggcuggagggcaguggcacgaucucggcucacugcaacuuccgccucccggguucaagcaauucuccugccucagccuccugaguagcugggacuacaggugccugccgccacgcucggcuaauuuuucguguuuuuaguagagacggaguuucaccgcguuucccgggcuggucucgaacuccugagcucaggcaaucugccugccuagccucccauagugcuaggauuacaggcgugagccacauuuuuuuuuuuaaacccucuuuuugucaucaaaaagccuugauuuaaagaacccuaaugacagguuuacauauaauacuuggaucagguuggggcagaggcuuuggaaaugggaagggaggagagaggcugcaggccuagaaagagaguguccagggagagagagcaagauaagucccuaucaaaaccaucgucgaguggccacagccuucuguuccuuuggguccauccuuuccacccacagaggagacggaggcagcgaaguagugccucuugugacaacaaaacaaaagggaaagguggagcagguauaccgugucugaugcccuuccccacgcucacccggccuccgccacugacucgguacagcuuuggagcaauccuccagguuuugggggagaggguccugaucucccaggucuaaguuuggugcccuucucugcgagccaccggguuccugcacugugagcacauuccugcauuccugccacccugucugcauucucuguuccaaguccucugagagcacagaguagcuuuccagcucaccggggacuggauccccaggggcuagcgccgucucucgcagguggagaugcccaaugauaguugauccauugaaugaacacgaggccuuccguucucccacaagucagguguuuucuccacucuggcacccuagaaaugcuucucaucuuuuaggauucagcguuagggacaucuagaaagcugucccccgugucucccuauuuauguagacuggcuauggucuacuugggccacccugggcugacuuccagcauagugcagcucacauuuuauuuuacuuaccuguuuacaagacugugucuuccuucuaaaccauaagccucuuuugguagggaguaugucuuauuguucuuccgugucccuaauacguggccgacaguggcacauaacaaguguucagguguguuuaauaaauuuauuugauaugagggagaauaaguccaaaaacaaaacaaaaacaaaaaaccuccaccaacaaaaaggcauccuaccuugauucugaaacugcuuguccaaucauauugccauuauuuuuccuuuuggcuuuauuauuagaaauucacucaacagucuacagaaggugaaaaaacaaaacaggugcuaaugaaaauaugaugucuuccugcuuaacgugggcacaagguggagaagaagaaaugcaagaaaguauucaguaaccgauucaaugauugacggugucagcacaaaguggcagguggcgccuguucuggggaguugcuuaagauuuaccacauucuuguuuuugaccuuuuuagcuuuucuuuaauuacgguagcauucaagucaugcugggcuccuuuuuuaugcucaccucaggagacaaacacauuguguguuacaacaaaguagucggaaggaagauaauuaaagguguuuauuguuaaaaaauaaaggaagauacaguugcuuuggcuuaagccagauucuaugguuuuaaggcagaucauaaauauauugcaggaaaaaauaucguuuuacugaaacugugggguagacaaucauauaauucacuccuucuuuauucacuuaguccucccaauguuaaaaaaaagaauaaaauggauuuaacuuguguauuucuugaccaaaauuaauacgaauucucaaagaugauuuaucagcagagugagaauaugauaguaaaaguucagucauuuaucuucaccaaucacaacuugcacuuuauuuugccauauuauauauuugaggggaaauaugccugccuagaucacauagauauacuauacaguaaacuugaacauguaguuaaucggagacuagugauaaaaguaagaugaauuacccuuguuuuucuuuguuuccaguauagaagauaaaacuuucuuuuccuuguuuuagcaugcuagugcaggugaagauuuaaagaagaauaaaaguagccccugccuccaaaagguguguaauccaguauagaaaaccaaguguacugcugaugaugagguaugccucaauuacauggcaacuaaaggugaagcaauauccuuuggcuucugguuacucagagaauuaaauaauacucuggccaggugugguggcucaugucuguaaucccagcacuuuggaaggccaaggcugauggaccacuccugaggucaggaguucaaaaacagacugaccaacauggugaaacccugucucuacuaaaaauacagaaauuagcugggcgugguggcaggcaccuguaaucccagcuacuugggaggcugagggaggagaaucguucauccaggagguggagguugcagugagcugagaucacgccauuacacuccagccugagugacaagagugaaacuccauucuccucacccuccccucacaccccuccccccaaaaaaagaauacccugagaaugggcacgauggcucacaccuguaaccccagcacuuugggagggcaaggcaggcggaucacuugaggccaggaguucgagaccagcaugggcaacauagugaaacacugucucuacuaaaaauauaaaaaauagccagguaugguggcaugcaccuguaaguccagcuacucaggagcccgaggcacaagaaucucuuggaccuggggggugguugcauugagccaagauaucacaacugcacuacagccugggugacagagcuagacucugucucaaaaaacaaaacaaaacaaaacacaaacacaaaacaacucugaaugagggagauuacaacaaggaacugaagaaucaauaagauauugggaggcaagaagcgaaagcagcauuccacaccugcacauaggaagguuucaggccuguuggaaggacacugggugguccagguccuggaucccauaggagacagagaauucccagacugaugcuaggagguccccucugaggaaccuagaagaugaagaccaggagugauuugggaccacacuaugggggaaugugaaugccaugcuaaagaaaaugcagugggaauucuuuguaaaaugauuuucacaucagugagaucaacagaugcauugcuagguguaaauccagcagguauucagggcugaacucuauagcugacuguaccaggcugugggagaggcagggaggagagccaagauggggacagaacuugccaccaaaauaaugcugacaguuuuacauagugauuucacacaacucuauguuuggaagaaaccuuggcuucacuggucuucagauuucuggaagcucuggaucaauuuagagggaaauggauauuaugaccuacuucuucccacaauguuugaguucaggaaaaugaacuuaacaaacaaaaaaccuugugagaagcacagccugugacauuguuugaugcuguuuuguggugagagucaaacucuguuugugccaaaaaugagagcaugggacuccuucccacgacaaaggucugggcuggaagccauuguggaggugcuccgggauaccuguauccgggagugacccuugaucccggucacuuuugcuaccgaguaaaaggaugcuucaguuuucaucucccaacauacccugaauguucacuguaguuucauccauaacuuaaaucccuccaacauucaugccuucuccuuuuccauuuuauuccuuguuucauacacuucugguucauugugugaguuuuuccccuuagcuguuaguacuugguuuuugaaauauguuuuugaacauucaaccaacaacaugcuuauauuuaccgccauccuuuagaaaugaaauuucugcccccagcacagauaaucaccagauucgaucuuacaaccauaaauauuauaaauaaauaaacugaaauuaagaaauuaugggagcuugaccauuacuauuaucagcccauauuuacagaguccccauaaaccaccugggaugaacaccucaacaaaucaauaguuagcagcaguuucaguuaggcccugaguccguuaaauaccuacagagguuagaugugaaauuggugucagaaauugcagguaccagucguguuauuuuccccauucugaugaaaaacaguuucuagggagcaguaagaguuccugagauagugugagagaguucuuggaaucugugugcaucugugaaugcuuuucccuuucugccuuuguggcgaguuuuaacagaaagcguuuuguguuuuagaaaaaccugcacaagaagauuaaaaugucacucgcugccuuuaacaaagauaaaaaccaaaaggcuuaagccauuaccauuuuggguagccgaacuuauuuuggccaggcauauucuuucaccuguucugaagcaacguuuuucucaaauaccauguauauucgcaagaggguuaaaaaggcuauuauuuacgucauucacuggaauguaauauaccacuaucaguuuuuaaauuacuguuacauagaugggcauuucuuguuaaucuccauagcggaagaucuugaccauacgcuuuucugaguaguguugcaaugguuuaaucugaacugguuuagaucccagucagacacuacuuaccaauuggcuacuacuuagauucuaguucuaguuuauauucuaaaacuagaacauauauacagaauagauuuuagucaaauuucauaguuuauaaaccaagcuaagauuucauuuuaauucacauuauuaguauucuuuuggucuuauauauuuaguuacuaucaauuuuuaacauaagcagccuuuuuguaugcuagauauaaaaauuuuaacaauuccaagucucauguaaacacaaauaauuuuguucucucucauaucugcuucacuuugaaauguuuacuaaaauguaguuuaucagaugaacugugauaaguuucauaacugcuguuaccacaguucgucugauaaacaaagaagcuacauuuuaguaaacauuuugacagauuuuggaaaggauuuagguguucagggaaaaugcccauuucccuuuugcaugucucagugaccaagcugagcaaccauacgcagaugagaagcucaggugcugagauccgggcaggacugcugcugagcuaaugcaguugguguaauuuauucugaccaucuaucaagaaaucuuguguuuugugucuagcaucauuacagugcauaauauaugaaucagguuugaugaaauauccuuccugaauauuucucuucaaauccugaauaaauaagacuugcuuuuuuugagauuuuuagagagagagggaugcucuauccauagcaucuauuagucaagaaagcugaacaauuugacagaucugcagaagaaagggaaggaaugcuauuccagaaauaccuuccgucuuagaaaucucccauuaaaaugcuauaacuuaggaccuaagagcaugaaaaaaccucugugauuagggauauauaccuuccuccuugacaaccagaaauuucccuacuaccaauacaccgaaauguuagcuggguaguaugauuaugguaacuucuuccuucuuuaaacuucucuguauuuuccagcauuuugacaaugagcauguguaacuuuuguaaucagaagaagaaauuaucuuuaagcaagcaguuucucuugcgaagcucugugauuuugcugucuucuuucacgucuccaccucugccucucuucagugucuucccccagauaagcuagacaugcacaguuugauaugaacgcugcugaagagugguacugugcaggagcuggugucacuggagcauccaagugucaugggaguggagacagagugacagcggccacaguaggagaaggcacaugugggaaggccauaucaaagcuaucagaauaguuaacccaacacaagucaggcaccugggcuggcauagguggacagagguaucacaaucagcucuaccgccaugcagaagucaggaguuugcaguguaaacagacuuccccaggaggggaugggcauguccaccccgguccucuacaaaggacguggagauuggcaggcaggugcaagaugcugggugucuucauucaaaacuggugcccgaauugccagggcaugugcuuuaacauuuggagcccaaaggaaauagaacugugcagaucaaccacaggaccugucaguuuucucagcuucaaaauacuuucuuguaaauguaguuguaagggaaagcuuggaaucaaaugcuaaguaccccuuucauuagacucugauuccauggauuuggauaaagggaguuggugaauuggaaaggauuagaauuugaauuccuaaaauacugaaaauauguaucuuaauucaccagaucuacaaaauaguguugaaaucucucaccuggaaacuuucauuuuaaaagcugcugacuaaucucuuugucuucuggauugaaaaauccugaaacaaaaaaucaauuuucuuacuggcauuaaggcaaaaugcaugcagaaggaucugucucuggcguaacaugcccuguugaggaugaaagugguugguguguguugggaccuggggauuuuuaagagaaacuuggaaaugggguucuaauguuuccaggucaguuagcacacuggauacaaauuaagggaugcuaaauaguguggagguuccaaaucauacuguacaucugggcugugaucacuugcacagaacaguagcagcaaaaaugcucguucucugugacacugggucucgccgaugcccgccuuccugauuuggggacacaggcgcuccucuguguccuuggauuuaggagcagagcccacugugcggccuucacugcaggagaguugcuuccugucuguugaguugaaugugacacaaaaggaaccuuaggaagaacuggggagauccagcucagcuuggaggacaucagcccuuacacaucugauucacuaaaaauuccauuaaagcucuuuagcagcaaagaaguaggcugcuauuugcaucuuuuuuaaaaaaauacuauguaauguucugcaaauuaaaggggaagaucauggauuuccuucaugcuuauggacagguauuuuccaucagauacauugacagccauggacaaugcuguuacaaauaaaaguguuuacccucaggaaaaacaaaaacaaaaaaacaugcuaugugggcuuauaaaaacucaaaggcuugcuuguggggcucaacaaucauaaauaauaacagauaaugcuuucucuuaacauccuucucacaagaacuucacauaaaaauaaaaccuucccuaauuuucuuuacugaagccuucucucucagcugggcuuccuucaauugcucuagcaggcacuagacuguggucugcccuaauuccagcaaggcgcugcaguuggcugauguuuucuaguugguuccgcuggauugcuugcuuuccuuuaacccagagcuuuucuuucuuuaauuauuauuggcuucuguugagaucuccaagcuguacugaguggauucucagugauucacuaauggauuucaaaacuguucauucuucgagcucuuuauaucaacaaggggcagcuggugacucauacuccagguggauuugugggaagugaccacgccuuuguuuugguaauauuuggggaguaacagagcuaucauucuuggcuaaagcagcccauuauaucaguagaguuugaaguauggauuuaggaaaauuggccaaaguuaugguaaaugguguuuaggaucucugccagauucuaguaaauaauucuauaauaaacaaugauaguauugcauucaucaaaugccccuucuccaggugucugugugaaguuuuguuacggcugcuguuuauuggaaauaaaacuguauuccauuucaaagcgguaaaaagcccauugcaagaccaagucaaagagaggugguuuuuuuuuuuuuuuuuauguuuacuugcuuaaguuucuuuuaaaaaaucauguucaaguaucaaguuuaaagucaaauaauacuggguggucgccagcuggugaguggguucuguuccagauuuucguuugucaacucgauguuuguaauucagagcucgguuucccauaaaugcuauagugagugacuuccaaaugaggacuccaauaucuuuaacaccaacugaaagaaaaugaaaugauuuguguggagaacucaacauuggaaucauuugggaaugcugcauuauuacauauauuucugaguauuaucauaucuauggcucaaaaacccaaccaugguuaauuuccuuguaccaaauuauaucagcuaacucuaccuuguuuccgugaucacaguccuccauuucagagcaauuuaaauuuugcucaacugccaccaagaaauuccacagagggccauauuacucaugcuguuacuuaacuuuaugacaaacaauaccaucaaacuuauuugcuguccacaucaggcacacuuguguacguaaucaauagcaaguccuacauuuuccuuuguugcaggguguguaagucauggauacaaauugauuaggcuaaggugaucaggggaauucuauuccucacaccaauaauugauuuuccugggguuggcauaugauucaguaauucaauuuuggccaauaauacacaagaggaaguccacuuagaaauuuuuaagaaaguguuguauuuuuucuucuucaaacagagagaucauaaaauaauaaacucuuuucuucugcuggguauuaugucucugucuccaggugaugccugggacugugguagccauucuggaagaaugagguuuuaaggaauaugaugugagcacaagauuuuuuggcuuccuucaaauaaaaugacaguuaauaccucugucuacuuaaguucuugcgcuguggauauauugggcauucaccguugacagcacauaaucugcuuacuuagagguuuagugauauuuuaguucuacuauuuauucugcauggaagaaaguccuugaaaccaacacacuggaacaauaccuucuuaccuugaauaaggucaguuugagaaugaguuucuauugucagcauguugguguggggguggagaaaaaggaaaguacauuuaauaagcuucuccugaaccacaucuuuuccucauaauuucagcacugugaacacccccagaugaucaacuccuuguucauuuaacugggguuaauaauugucacucacguacaauuacagaaaagcaaauuuaaacuaacaguuuacaaaagggaggcugaaugguauaauuugaaagcuagaaaauuaaaauuucucucacccuuaaccagcagcuccaccuccaccaacauuuccuacagauauacucuacauagccacacaauacaugccaggguauuaguguaguauuauuuguuguagcaaaagagucaaaaguaacauuacuuuuagcuuuggaaguuagcuaucgggaacuuggaauuuauggaagaaaaauaaaagcuuaauuaauucuugauaauuaaaugagagugaggagugugaauguuuuacacuuuuauuaugcgugugacacauuuuacuaggcaacucugaauuuacuuaugagguuucauuuuguuuuuauucagaaaauagucuucaacucuuaaaaaacaauuuuuuuauugugguaaaaacacuuaacaugagaucuacccucuuaacaaauuuugaagagcaccauacaguauuguuaccuacaggcacaagguggaucagcagaucccuagaacuuaugccuguugcauaacugaaauuucacagugguuggacagcaauguuccauuucuccaucuccccaggcccuggccagcaccauucuacuuucuauccugguauuaugacagacuagggguucugaaaaucucuaaaauaauucccacaaaugcugcauaaaaauuaacaagugucuuuuuuaagguauagcuggggacucgaaagagcaagauaaaucccaaugguagaaaaagaaggggaaggguuggguaugauggcucaugccaguguaaucccgacacuuugggagacugaggggggaagaucacuugaggccaggaguuugaggccagccugggcaacaaagcaacauccccucuuaaacaaagaaauaaacaaaaaggcaaaaaccaaaaaaauggggaagaacaucagaguggugagcuggcccuuaacuggggacauuccuuuaucuuggaaagcgagaggauugaauugcacagcauuccagggacaggaaagugcccugggcuccccuguggugggaaucuagaggaugcacagggcugaggccccugaaggcuacaucuucaaugauaggauguucuaggaaacacagcugacuacuggccauaggaaaugucugucaucugucuuggccagaauacugaauaaggaagagcuauucuccugagaguucauaaccacaggccugcccucacagaggucuacaguuugaguauacacuacuugagaguccaagaaaagccaagccaauaaaugaacauaaacccaaccuagauuauguaucaaagcacguguauaagcaaauccaaauccuguugagacagagcaacaucaaccuaagacaaaaugagucucacacauugcaaggugcaagggauaagcagaaagauaacaaaaauaccaaaacagaugaggaaauaagccacugugaaaaagugccagaaaaacccucuaaacccucaagguaauguaauaauuauaaaaaagauacaaaacaaauauacuuaagacacuuguaagacagaccaaaagaaaugaaaaccgugagaaaauaauaaaauacucucuagagagugggcagguuuaaaauguaccaaaaggaaauucuagaauaaugauguauaaucagcaauagcccaaacugaaaacaggauacacaaauacugauauauuuauaugaugggauacucuacagugauaaaaauaaauggacauaacuacacacaaaaacuugaauaucagaaacauaacguugacugaaagaggucagacacaaagaauucacacuauaugauuauauauauacauauaauuucaaaaaacagaagcuauugacuuuuacauuguaaauggaugaauuauauguaaugugaauucugucucacauuaucaaaaaauuacauuucuaucuaucagcaaucauuagaaaaaguaauuuauuaaaagauacuauuugcaguagcaaaauuugcaugaauuuuaguuagaaauuuuaagaacuuuauuaaaaaucaacacuguagacuaaacucuaucagaaaccaaguucuauuaugaagauguaucacuagcacaguaugaaauuugugcagcauugacaaugugaacaaaggaaaaaaauauagagcccaaaagagacccuugcauguauaaaaacuugauggauguugacaguaggggagacugugcauaugugggggcagagggugaaugugaaaucucuguacuuucuauucaguuuugcugugaaccuaaauugacucuaaaaaauaaagucuaauaaaaaaaaaaaaaccuugauguaugacagagguggcuuuacaguucaguggagaaagaauuuuucccauguuugaugauggaaaauuugguuguauaugugucaaaaauaagaaacugaacccuuagauuauaccauuaaaaaaauugaguuccauguauuuuaaugacccaaacauagaaaacgguuaaaacuuuuaaaagaaaaaagacaucauaaaagaaaaaaggcaugaagcacaaaagauaauauuuuuaugacauaagacacaaaacauaaaccaaaaaggaaaauggaugaauucuacuauauucaaauuaaaacuucugcacaucaaaauauaucauaauucaaauaaaaagacaagacaaagauuaggagaugacagcugcaguauauacaaauuauaaacauuaauauuugguuuauguaaauaauauauauuaauauaauuaucaaaagauacagauaacucauauuugaggaaacuugaaaauaugcucagucucacccuuaaucaagaaaacccaaauuaaauuaguuuagccucauucauuuaugugaucagauugguaaaauggaauuugccaauacuaacuguuauggagcaaguugagucaaaauaaaauuaaaacuuacuugaaaguguaaauugggaaaacaauuuggaaauaucuaauaagguuuaaaacugaauaacuccacaccuagauauaguuaccuuagagaaauucuugcacaugacuacauggaagcaauaaauuaauucucagaggagucauauuugcaaaaauaaaaaacugaaagcaauauauauuuucaauaaagaauacauaaauaacuugaaguguaguauagucaugugaauggaauaucauaaaacagaaaaagaaauaaacggugacugcauacauuaauaagaauaaucagaaacauuguuugaauguaaauagcaaguucauaaaaggauaaauauuauaugauggcauuuauuuaaaguuugaaaauaugcaaaacauacagagcacacacauacacauacacacacaaagaggcaguccuugcuuugcacacacuuuaauaugcauaaauuucaguuacuauaguauagguaaauauaccagucucccaacaugguucaaauuuuaguuacugugcuauacuaaguuugaguaauugcauaauauacaaauuuaauuaugcauauguauaguguucaaguuuuguuacuagcucuccuguccaaaaacacuacagaugaacccugacuuaugacaguuugccuuaaaauuguuguacuuuaggaaggugcaaaagccauaugcauucaguagacgcuguacuuugaguaccuguacaaccauuuuguuuuucacuuucagugcaguauucuauaaaucacaugagauauucaauauuuuauuacaaaauaggcuuuguguuaggugauuugguccaacucuaggcuacuguaaguguucuuagcauguuuaagguaggcuagguuaagcuaucauguuugguagguuagguguauuaaacgaauuuucaacuuuugauauauuuucaacuauguguuuucuauggauuuauugggacauaaccucauugugcauucagaaguaucuauacagaaauaacagaugugcaucaugaucagugaccaaccaugucacuucuuucaaaaucuauuaaggguuuguuacuccacauaauguuauucuuuccacacacagcaaagcaugugguuauguugccuccuuguuucccagugauaagcccauauaacacuuuacaaaacuggacacgagaagggagaauuggcuaacuaagauaaaagugcaucaagaaacagagagugaugaugcugaaagugaaaugugaaaugaauguaaauggaguuauagaagcaauagcugaaugugucauuguuucagagacuccagauuuguagccagaggaacucagguuaaaugaauugaacuacacaaauaaggaaggugguugugaccccaaaaaggaugaagcugucucacaggaagugacacuggcauaacauuucgcauuaaaggaacucucaaugauuuuucaugacauugaaaguggaaaggauaagaucuuggaagccgaucuaaacauggaaagaaguaugucaauagaaacaauuucuugauccauauuguaagcuguacaaugagaagaggaaaggaagcagguucuaauuacucuugacagauuuuuaaucaaagaaaacacuuuaaucucaaugcuucaaauguuuuuugcuuguuuguuuguuuguuugagauggagucuugcucugucacccaggcuggaguguaguggcgugaucuccacucacugcaaccucugccucccagguucaagcaauucuccugccucagcuucccgaguagcugggauuacaggcaaccgccaccaugcccagcuaauuuuuuuuuuuuuuuguauuuuuaguagacauaggguuucaucauuuuggccaggcuggucuugaacuccugaccucgugaucuacccaccucggccucccaaagugcugagacuacaggcaugagccacugugcccggccuccuccuacuauuuuuaaggauccaugugauuagauucuaccuacccagcgaauugcaggaaaaucuccgcauuuauagauccuuaauuuagucauaagugcuaaauccccuuugccauguaaggucgcauauucacagguucugaagauuaggauguggacaucuuugguggcggacauuauucugccucucacagauaccuuuuuaggccaggagccauagaagaguugaaguuccuugcauaagaccuagacauuuuauugugucauauauuuaaugaguauggaaugcaaguaaauccaggguugaaaaauacucuuacacacuucauuuggaguuuugaguaaugauacaagggaagcuagaaucauacccuaaaacaaaauacuuagagcaguauaaucacuauugacacauuccuaccaccaguguaauaaaccauacagcacaagcucaaucaaguacccuagucaguucuuaugguacuuagucuacguuugggaaucaaugaauuuuuagugauuccaaagccagccucaaaccuauguucccagagauuuggugaaagauuucauuuucacauuucaauauuauuuucagccagaaguaugcauaaaucuguagugucagggcuuuagaugcaguguagcuuauaagacagauuauuucuauauugucaacauaaaagacugcuuacaguggagaauagcuuacuuccuacauaagcagcacaaauuauuuaucugaacuuuaaagaauguaauauuucuacucugguagacuauuaaggcaauugaaguaaucccccaaguacaacgaaguccuacauuuucugaauuugcucuguuuuguugauagcauguagaugucuucugaaauauguuuacuugauaaaagacaaggcacaauuuuccaucaauaaacucauaagacaaagagaugcaauaaugaaaugcguaaagcacauguacugcauguggcuggugccaucaauguggaagagcugcugaauuguuuggcucuuaggcuuuuccaagucaguuaagaacugcucucugaaaugacccuuguauuuauauaaggccaaucagaggcacagaugauucuucauaaacauguaagucaaagauguaauagucuaagaaagauuugcuagaauguucuauauauucccaugaagugcaaugaagcuuagccucaaccugaagauacaaauuacugugaauaucucacuugaaaauugagugaaauuauuugaauugcccacuuucaugaaagaacggaauaugauuuagagauuucuuccauaaauucuuuuucuuuuuccucugagcacaugcuaaaacaaacgaacuaaagaaaaaaaaaagaaaauuauuaucaugagccccucagagucaagucuguaagccuaacucaguuuuuuuuuuuuuuuugucugggauauaaaaguuacuauuauggccgggcacgguggcuuaugccuguaaucccagcacuuuggaaggccgaggcaggcagaucacuugaggucaggaguuugagaccagccuggccaacauggugaaauccugucuccacuaaaaauacaaaaauagccaggcgugguggcgcaugcuuguaaucccaacuacucaggaggcugaggcaggagaaucacuugaaccugggaggcagagguugcagugagcagagauuguaccacuguacuccauccagggcaacagagcaagacucuguuucaaaaaaaaaaaaaaaaaaaaagaacuuccuauaaagcuuauuggcauaaaguauaggcuacuaggcuauuucucacagaguauuguuuuuucuuucauauucucuauuucgcuacaccaauaucccugcuuucagaaguuggcacuguugccccuguaccugggucugauccuguuuuuuuauuagccuuugggcucauagaguaugacuuagauacaauggauauauggagauuuguuaguaauggguucaucuuuuuguguucuauauuguguccauuuuuuuucuaagaucacgacuauguguaggauuuuauaaagugauacagacuugaaaucagugcugucuggaagggucauagacccucgugagacucuauugaaagcagggacugugaaucccaggaaaagaaaccuuacaggauuacaccuaaguaccauggcucacauuaaaccaucuuagagaauauuggcaacugaaucaaaacaaaggucucuucaguaacaaagcaauaauacuuccaaaucgugcuggaccacugaagcagcaaaacaugcacucauuggaaaaugaggacccucaguagcugacuggcuguuuugggccaauuuaugauaaaguccucauggaucauauauuucuaaaauaagauugagcuuuuggagggaagacauuuguaugaugcuguuucaccuuuagccccaauuuuccaguuuaugacaucugcacauuccucuuggugccacucagcauucaagugcccuucuccaccuccccuuccuugacuggaugcagggccggugagcagaccccacagcagggcuuugggaagagauaacaguggcgauuguuuacccuguaugagaugcuacauuaugugacacauagagcccaugaugucugcacagcaccccuuaucuuccacugcuaugaacugaaugucugugucccccacaaauuccuaugcuaaaacccuaaucaccaauguaauggcaugagaaggggggccuuuggggauuauuaggucuuuaggauggagcccucaugagugggauuaaugcccuuauaaaaaggggcccuaacgagcucucugguucuucccacuugggaggauauaaggagaaguuggcagacugcuaccgagacgagugcccucaccagagccugaccuuguugccagccugggcucaggcuucuggucuccagaccugggagauacaaauuucaguuguuuauaagccacccagucuaugguauguuagagcaucccaauaugacaaagacagcaagugaccugcaaagucuguaacugugaauauggggauaguacauaagaaagaacaaaacucaauccauuuaggaucaggaugagaguagaauucagcaccuugauuuacuuugcaacucccccaugcuugccucauaagcuaacuggauuaacucaggaagaggagauagaugcuugauuauugaacauucuuuccuggaacagguugucagguacuccaccuuucuuccugucugaaacacugagaaaaacucgaguucuauuuaaaaaucuaaccaaacuauaauaaugagguuaagagguuagaacauaaaacauuucuguaaugaaagaugaagcauuuucauuacauauuaaagaacagggcugaagaaagaagcuuucuuuguuuauaauguuuuaaauagguacuccacugggucauuuguugucuuaugagaacuuacuggaaaagguuccacaugaaaaaaugagaaaaaauaauuaauguaggagacuaaggaacuuguauguaaaugaacaaagcuucucauauuucauaaagauauucauauucauugaaaacuuugcacaaugccugccagaaugaauguauuauuagcuguguucacauaauugagcuuuucuuauuaauauuuuuaagacuuaaaaggcuauuuuaauucugucauaaaucuaagaaaaauuuauguaguaauaauucaaauuuacaccuauaugauuuauguaaagcagucaauugagaaauacuuuuuuaaaaaauagaaggcuuaaucacauacuagaaacuguguucuaggguuggcauaauucugaaagaauuugagauauuggaauauuuucuuuaucaugguuuaaaacaugccuauauuaagcugauagcauacacauuacaugcagaaagauuuuguauacuuauuacaacuaagaaaaauugauuuauuagcuauauaacuucauuucauuggcuuuacuucuaauuuccucuugcaaugauuuaaauauuugauguaaccucuuauugaaugaacuuuuguaaguuaacauaaauccuuucucaaaucaauuaauaaaucacuuagaguuguaauagauauuuuuguuaucuucauucaagaaauauacauauuauaauccugauuaagcacaauauuuaugcuaggcacuggccuaggcauugggaauacagagauaaauaagaaguagcuucugcugccaagaggcuaauugucuauuuaucuuaauuagugaaaccccuaagaaugaaauuuauuucuaaggaaacuaaucaaacaagaggauaaaucuuuaucuaaacuuaacaaauugugaaguuuuuugaaggagagugguuagccauacaaaauaauuucuuuuauaccagguuucuacauaugcuuaucuaauaggauugauaauuggaacaauccuagggaaagauagaaugucuuuucaauuugucuuuuuccccagucuugaccucuggugcccucuccgauucucaaugguaaccccuucuccaaccuuggcuccucaauacuucucauucacggaaucagagaggaaguaugcuugcucuuguacuuuugugauuaaauuuagggugaauaaauuucagucaauauuuagcaaauuuuuuuuccucuaauguuaaaaugaaagguuagguuagggagauuuuagguuagagagauuuuaagcauuagcaaacaggaaguauuaggggcugggagaaguaccuuggaagcauaucuaucccacugcaaagucuuucccuaguaauucugaucucaucccuucaggugacugggauaagaaaugguuagcaggacuguguguuuuauccugaauuccuccaaucuagggcccacugcuuccuugggaaggacacauagagguugaugcuccuugagaacucuuccuaggagcuacuaagcaugugcaucuuccucacuaguucuuuccauaucauagaaccugcacugucagcacaaggcuuuucuaaucgccuucucuguaggcccacugacugcuccccgugcugaucaaaauacccauuucaucuuucuuccccaggucacauaucugaacacaaauggccuuuuuguguucaacuguaaacaaauuuaugaacuuaaauguuuauguacuuacacaguagccauuccuaauuuuuaaaauuaaauaacaaguguaccgguaacaguauuacuugagcucccuccaugucuaaaccaucaugcuaggcucuguggcagauacagagaugaaucagauccacuccugguccccaaaacacuugcccaccagugaaugagcuuaggucguacaaagaaaccauggugguugacugugagaauuuaaagauccuaaccuaaaauaauguauuuucuuacauuauuuuuuccuccaaaaaaaucaagguuuugggcaaaauuaaaugugucaucuaaaugaauuuuacaggcuaacuagaguauuuuuuaagagaaauaauuaauuagcauuauaaauggauaagaaauguugguucccaaaucuggcauucuuggcauggggacuacauauagccuucagaggguuucaaaucucuuuaaaauuauaugaaaaauguuguguuuauauaaaagugcgcauuuuuuuucuagcaaugagggucauagauaaggaaauucuuaagaaaagguaaagagccauugaaaugcugguucuaaauauauauucagucuaucaaagcuuuaugaaguuccugaugaacauuuugcugucauuuugaaaaagcguaugcuuaucaucuuccuaccaugaaaauacacguggcuggaggguggaugggagaaaugaaggagaaaacauaguuaaaccaucaaacucuaaguaucuuguagaaauugggagauguucugcuuuucucauaauaauuaacuauacaugcaacuaauuauggugcagaaagauagcagcaucaagccauggagagaaaauuugugaacuuaaugaucuuuuuuaguagcaaaauaauuuuuucaggaauaagcuuuaugggcauaaaaugacuuauguuuaauaaaaaauguacagacauagaagauaucauccauuuggaaaaccauaaaauauaaggugagcaugaauugaugaauaauuaagcuuauuucugaauacaaguuaauagaugaagcuuauuuaacagcuaaaccauuaaaaaguaccaaccugaaaaaaauagaccagaaaauuuuacagaaauauuuuuguaacucuuuuauaugcuccaauaaaaauacuuuauuugaaacauuuuucucaccaguaccuagcuagauggcuucauagacacauugguuaucaaaagaagaaaaucauccucauuaagaugcacauuaauguauagcuuuucuacuauccaaauauacauaacucucaauuuaugcucauguauaaagcaucuugagcaagaagaguccuaauucuuuuauguaaugucauucugugauugacaacuccaaugauugcuuuugugacauuaaccaccaagucguccuauacuuugaaacacauuguucacaagauacuagaaaaaaaauugaguaacagugaaagugcuaucugcaauaacaacaaugugaugggaccuuccaggugggcugcugagaacucugcuaggugagucacugccaccaaaucuguucgacgcaguguagagccauguuauccgcaaagagcugugcugagagccaggcugaaggcuaggacccaggagacacaguuguggggcuccaagagcugagaagcuuuccaguagauccuguucucuuuugaacuagguagauguuucuuggccauuguagcagguugaauaucauuccccauucccaaauucauguccacccagaaccucagagugugaccuaauuuggaaacuggguauuugcagauguaauuaagcuaaggaucacuugagaucacacuaaauuagcguggguccuaaauccaaugagacuuuccugacaugagacagaaaggacacuugaacacacaaugaaauccuuguggagacaggcagaguugggaguuuugcugccauaagccaagggcugccgugagcccccagaaucuggaaaagucaagaaggggauccucccccagauccuucagagggauguggcccugcugaugcuugacuuugaacuucuggcuccagaacuguugagagaagucgcucuaguuuaagccaccaaguuugugguaauuugcuaaggcagaccuagaaaaccaaacuagccauuaucuuuuccucauguuuguaaguccucagcccguaauggcacugaggaaucuagucugcuagaauucagccagggaaucuuucucuuguuauacaaaagaacuaguuuuuguuggggucuggugcagccuugcuaaacuguaaaggcugaaaguaugggcuuuggagccaauuugccuggguuagauuccagcucugucauucacugugucacuuggagcaaauuacugaaucucuaucaugguuuucacgucuguaaaauaaggguaauaauaugaccuucauggacuauauacuugcgaggauuaaaugaguugauuugugaagugcuuaacuagaucugacacaugguagauacgcaacagauguuaucugcaaucauuaucauacaauuauuauuaugugaucauagcugucaacaucaucccgggguccuaaacacaaaggcuucuuccccucuggagggcaggcauagguagccaugcccaucauacagaggagcaccaggaauggagcuugcuucuccuacagagaggagaacccuuucucucucaagacacugcucugcaggggagcgguggguguccucacugacuccgcaucagacugaaguaccuucccuuuauccuuucaacaacugcuaaugguccuuuaaccauaacaaacacagcccaauccucuuggaguugaaaagaccacuugaauugcgccuccacauucuuugauuaggaagucacuguauuaggcuccucaggcuacuuuaacaaaguaccaaaaacuggguggcucaaaucaacagaaauuuauucucccacaguacuggggguagaaauccacaguccaaguuggcagggcucauuucuucugcagauucugagggagaauguucacccgugccucucucccaggcucuggcaguagccggcaauccuucauguuccuuggcuuaaggcagggcaacugcaaaauugcaacuucuaccuccauuuuuucauaguguucuccccgugugugagagugugugugugugcgcuuucucuucuuauaaggcaccggucauauaggguuagggcccaccccaauucaguauggccucaucuugacuugauuauaucuauaaagacccuauuuccuacaagaucauauucacaggcaugaggggauacgacuucaacaucucuuuuggggaauguuauucaacccacaacaaucacuguucauucacuuauaaaugaagcaaaacagaaaagcuagcagucaucaauaauuuuacagauuuauuaaaaauaguaaaauacuacuuuuuuccaagcauucuuacacaauuaagaaaggcuugucuaaaaugaguagcuuuuaaaagucuucuuaaaaaagauuucuacuggccgggcaugguggcucaugccuguaauccuagcacuuugggaggccgaggugggcggaucaccugaggucaggagaccaucuggccaacauggugaaaccccgucucuacuaaaaauacaacaauuagcugugugugguggugcgugccuguaauuccagcuacucaggaggcugaggcaggagaaucacuggaacccgggaggcagaggcugcagugagcaaagacugcaccacugcacuccaaccugggugacagaguaacacucugucucaaaaaaaaagacuucuauaaugagaauauaacaauaaguuuuaauuguguauuuucaguauagcguuguuggauguggaaccuacuguaagcccuuuauugaauuacaucauuuuauuggcaauguuuguuuuauuuguuuaaaaaacuacauaggcauagaucucugcaacuaagcacaagugaagaguuuaauauuuuaauuaaagauuaaagguuuuauuuuaauuaaagauuucccacucaccccuccuauuucuggcuaacaaacuccccacugucuacagacuaucuucagcucugggauuauuggcauuugucgguuuuucugguuccaacucaggucucauuuucucauucaaguauuuacugaaugcuuacuguguauguuugcauauuuuucuacaggaaacuuuugcuucuuuacguuuggcuaaucauugucuaauauucuccagcucaagccuucuacccacuccaccaauccccacggaaaauggucuuuacucauucucuuugcuuugcccuuuaaccuuuauguguuuccuuuuaaagagaugcaucuucucaccucucuaacuuauccugaaauagaugaucaauuccuugauugcaaaaaucaucggucacgccucuguaucugcagccugcuaucaaugaggcaggauagguagucaaaaaagugaccaugggccgggcgccguggcucucgccuguaaucccagcacuuugggaggccaaggugggcggaucaccaggucaggagaucgagaccagccuggccaacacggugaaaccccgucucuacuaaaaauacaaaaaauuagccagacgugguggcgggcgccuguaaucccagcuacucgagaggcugaggcaggagaaucacuugaacccgggaggcagagguugcagggagcggaguuugugccacugcacuccagccugggcagcagggugagacuccgucucaaaaaaaaaaaaaaaaaaaaaaaaaagaaaaaagaaaugaccauguucuuaggacgcagcaaccguggugaccacacagucaauacaauaagccccagcauucgcuugguaauugagcucguucaagcaaagcuaucuucauuagggacucccccuguagagaguaugcgcacuuugauuucauccguccucagacugacccuuuguucauuauaaugguauaaaauacaccccuagguggagauuuaagauguuaaugagacaugagacguaugaacacgcaugugcggcuacugcgcaugugcacccagagaaccacccagaacaugcuuacugguaacaccucuuuucaccuccuuaggaauaaucagguaagacucccauaaggggagucucccucccgccaaucuuuucugucucauccuccccggcagcccacccugacuccucucucucucagagcauccugucuauucugcacuuaacuuucaaaguauucuuuuucuuuugcaauaaauuaugcugcacccgcuucacugugcgucucuuguuuaaauuuuuuuuuuuuuuuuugagacagaguuuugcucuuguugcccaggcuggagugcaauggcgugaucucggcucaccacaaccuccgccucccgguucaagcgauucuccugccucagccucccaagcagcugggauuacaggcaugugccaccacgcccagcuaauucaguauuuuuuuuaaauagagacgggguuucuccauguuggucaggcuggucuugaacucccaaccucaggucauccacccgccucggccucccaaagugcugggauuacaggccugagccaccacacccagcuguuuaaauucuuuuaaacuaagaagacaagaacggaggcaucgugacacugccaacacaaggugcuugucuuagugugucugggcuaccuauaacaaaauaucguaaacuggguagcuuaugaaaaacagaaauuuauuucuuacaguccuggaggcugggaaguccaagauuaaggcagauuugauaucugaugaaggucuacuuuuuggcuuauggaucgugccuuccagcugaagucucucauggcagaaagggccaauaagcucucuggggucucuuuuacaaggguacuaaucccauuaaugggaguggccucaugaccuaauugccucccagagccccaccuccugauauugucaugugggugauuagguuucaacauauaaauuuuggaaagacaaaaacagaccauagcagugcucaaaauguuuaccauugaugacugauugagccuuuuguucacuucagauuguaauuuauuauuucugaaugaguuuaauuugacagaaauaacuguugccuuuagcaauuugcauuuaagcuuaauucaucuaguauuacaaaacugaggguuuuaaaugaguucuacucuuuuucuguaauauuuauaacuacgauuacugacagcuuacuguagcagucacuguucuaaguucuuuacagacauuugucucauuuuauucccauagcaaccuuuuguacuagcacaauuauuucuauuuuacagaugaggaaauugaagcuuagugaaauuaaauaacuuucccaaugucacacugcugauaaauggagaauuucagcauaggccugucugcccccaaauauucugagccuaaguuucuacacuuucccugucagaaaaauauucuagaaaacuucuuaaaaacagguuacugggcuccacucuggagaauccaaaucaaaaucucuaggggagcugugugggaaucugcauguugauaagaaccccagguaauuucuguaaucaaguuuagggaaaacucaauaauaugauaugguuugccaguacauauaagaagccccuguguuaaauauuuuugccauauauaguuugguuuucaucacauaaauguuucuugugguucaaagcuauuagagaaaccaagcuugcagauccacaucugcaaggucugccaugccccagugauauucagaaucuaggguugaccuugugcuuucgcuagcacguagaaacauaggugugugacccucacagccucagaagggccuggcaccugguuuauugucucucuuuuaaaauucacaauacaaaugguccugcauuugcauuuucacuggacuuugcaaauuauguagcuggugcugcccggggaauggaugcagcagaaacugcaggccaugagauacaaaggaucagcucaagggaaaagagcacagucuuuuuucuuuuccuucucuaagaauucggacagggaggccgggcacaguggcucaugccuguaaucccagcacuuugggaggccgaggugggcagaucacgaggucaggagauugugaccauccuggcuaacauggugaaacccuaucucuacuaaaaauacaaaaaauuagcugggcaugguggcgggcgccuguagucccagcuaccugggaugcugaggcaggagaauggcaggagcuugcagugagcugagguugcaccacugcacugcagccugggugacagagcaagauuccaucucaaaaaaaaaaaaacaacaaaagaauuagaagaggcaggacaaagccagguggaaguggaguaugauggugucaggagugugaugcaggguggugugagguugaagaucuggauguucccacaucuucuuaauacuucuauggaagggagagggaaaagaguguggagaaggguuuggggagcaggggaaggagagaggcagcauccuugugcuggagaagugcuucccauggcuggcccaccaaguuagauuucaggaggguuaacugauuaauaagaaugccccacuaugcugaacuguugguacaaacaaugugguuugugcuaaacaacugccuuucuucugggagucuggguuuugggugcaugccugguaggggcugccuuugugaccaguacccaauaaaaccuugggugcugagucucuagugagccucuguuguagacagcauuucacacaugaugccacaacuaauagcugggggaauuaaguguguucuguggacuccagugggagucucuuggaagcuuguguuugguuuccucuggacuucaucucaugcacguuuccuuuugcugacuuugcuuuguauccuuuugcuguagucauacccaugaguacaacuauagcaguucccccuuaucugagaggaacgaguuccaaggcugccucucauuucucuucagcuuccucucuauaucuuccaacuacacugguguccagaaguuuuaagcccugaguugugguuaccuuguguguuaguccauuuucauauggcugauaaagacauacccaagacugggcaauuuacaaaagaaagagguuuauuggacuuagaguuccauauggcuggggaggcuucacaaucaugguggaaggcaaggggagaaagucacaucuuauauggauagcagcaggcaaaaagagagcuucuggagagaaacucccauuuuuaaaaccaucagaucuucugacagccauucacuaucaugagaacagugcuggaaagaccuguccccaugauucaaucaucucccacugggucccuccuauaacacaugggaauuauggaagcuaaaagaugaaauauggguggaaacacagagccaaaccauauuaccuuggguuaaaguagguucaggauugcaaaugccaaguuccuuuuuuuuuuuuuuugagacaggucuuacuuugucacucaagcuguagugcaguggcacaaucauagcucacugcagucuugaauuccugggcuccagugauccuccugccucagccucccaaguaguugggccacgggcaugugccaccaaaccugguuaauuauuuuauuuuuuuguaaauacagggucuugcuauguugcccaggcuggucucaaacuccuggggcucaagcaauccucccaccucggccucccaaagugcugggguuacaggugugagccaaugcacccagccuaaugcuaaauucuaagcauaccugcaugugugcauacguaaguauaucugcauguguguguguguguauguguaauugugccagaaaggagggcaaaucugugugaaagcagaaauaguagagacuauauuacuuuauuccgaaaguaagugucauccuuuuuuuuuucuugauuccuuaauaggugcuucuugugaagggggaaggaaacagguaggaaggaggccuggcuauuaaaguuagguaggcuagaggaguuagaggagcaguggagaaguguucucaaauauauaacauccugaaaauugauguuccaaacucagauacuuuuguuggguucucuuaucauaacaacauaauucgcuaauuuguaaagucauaagacaaagucggguuuaauacugcccaccacgaaaugacugguuucagaugugauauggccaucuaaaguucagaguggaaucaauagcucauucucuuucucaaccccuaagugaagguguaaaguuugcuuucuuaucgacacugcccggaacuacaguuuuauuuccuauggauguucaagacacaagcgacuuuuuuggggauuaucagcauaagccaagcaaacugucaguucugcaggcaaagaaaacacucagacuuaauuuuggagcaucuaucuaucuguuguacuuaaauaauaacaaaugaauuuuuccauaaaggaaggcuaugucuuuuugaaauauauaaguaaagaauaaauaaagauaccuaaguaacaaaguaaaauacaacagaguaucuucuuggcucuaauguucaggucauuuucucuuuugacaaguucaaugccaagguuuagguuauuuaauacaaaguguugguuuuugccuuuguuaaaauggagaaaaccgaggcagucagagcaaacucaguaucuuuggauaaaccaaaagagcaaaucaagcacccaguaacgggguucucucauagcaauccugacgucgugaacugguuacauuaucaucucagcuaugucaaugagaauaccacagcaaaauacuugacauauaaauuucuuuucugugaaaugaaaggccaucuuuuaagcucaaguccuacuuuguauccuauucaguauaauauaauuaaauucuaaagguuuaaauaccagaaaacaaaaucgauuaggguaaucuaccaaauugaauuaaggaauacuuaauacauuagacauagggauuacagaaaagauuauugagccacuucauugucuaaagcuugaguaagucaagaaaacccugaaggagguauggcuagaaucuuaauuggcacaugacuuuuucauaaaaagauuaagcaauccucuacaagucuaguuguucuauucacccuuagacagugugagagauucuugauuaaguguuggucuagcaacuaauauucccaccaccccuuauagguuagcuugaagauauucauuuacuuuagcacaauuggcucuuggacuuaaugagaaacuauggaugggacacaggaguccccuuuucuucuuaacuugggacuaggcaucuauuccaaagagcaauuuguuaugccaguagguaaaugccaguucaaaugcacuauuuccuauguacauacacauggcgacuuuugaauuaggauuuauuuuacagguaguaauagaggcugggcaugguggcucacaccuguaaucccagcacuuugagaggccgaggugggcagaucacuuaaggucaggaguuugagaucagccuggccaauguggugaaacuucaccuauacuaaaaauacaaaaauuaacugggcguggaaauuaacugggugugguggcaugcuccuguuaucccaucuacuugggaggcugaggcaggagaauugcuugagcccaggaggcggagguugcagugagccgagaucacgccacugcacuccagccuaggugacagagcgagacucugucucaaaaaaaaaaaaaaaaaaaaaaaaagagguaguaauacaaaucuuauguuuuuacaauaguuuaguacaauuuuuuuauccugaugauaguaagacugcuauaacagaacuaucagcaaacuucaagaagaagcuuauguuuaaaguuuucuucaguaaaguucccaaguuucccagaccugcacauaguuaggagugugaaaagaagcuuuauggaaagccaaguagguaucauaaaauaggugaacuggaacacgguuuuaauuaugccagagugagguaguuuauagcucacagcuuagcacccuaacaauggacaugaaguacugacuaauuguaauuuugucaguaauaaccuugagacauggauaaacaaaaguauggaagccucuacuuggaucucugaagggccaaggggguuaaucuaauuuagauuaaacaaugaguuauauaaauuuaauacuucaugugcaucuuaauuuagaauugccaaagaauguauaaaaacuuagcaaaagaguuuuuuuuuaauccuuaauuuaaagauaaucaucagauucaagggauuuucaagguacaaaggaauaaaaguuuucauuuaguuaagaugaauaaaugugcaaaacccuguugagguuaaaaauaguugugcauauaaaucaagugauagugcuucucuuggaccuuuauaacaauuauugucugugcaaguuuucugcaauuuaucaugaagugccucaugcacugccuccauuguuacuuggaaaugcuaauuuaaaucaucuuuugugguuauuuaaccauucauauuaauuuaaugaacacaugucugagugccucaauguggcaggcauuguccuuggcaccaugauacagacuucugccugagauucccgucuacuguuagggacaauggugacaauaaagcaaauaaauagagaaaagagauugacucauaacaggucauuaauuuggucuuugucccagguuccugggaccaaguuucuaaacccuaggacuuucucaagugauaggaguguuuguuauucauagugagcgccagggaccaugccuggguccaugccaauaaggugacucauggugggccccuaggugguuucaggaugggggcugggugugccaggaagaccagccaccugauagaggguugaggcuuugagcuuccugauaucagccugaucuccagggaggaggggaaaagggggcuaaacauuauauuuaaucauguggccaaugauuuaaucaaucaugauuacagaaugagaucccaauaaaucauugaacacccaaagccugggugagcgucacugguuggugaugcacacugguguaccagaagaguagggaauucuugacagagcaggagcaucaccaucuuggacaagcaccgccauuuuaaaguuccccuugauaaaaaaaucgccuaaguccaaagggcaucaggcuaaggucagcaugaccauaaaccacaaaugauaucuccaaucagaaacauuccaaccccaagauaaaccccuccccagccagagacaugccagccccaagauaaucuccccucuggccagagaggccggagagaugucagccccaagauaaccccccuccaaccagagacauuucaacccugcaauaaacuucucuuccacacagaaacaguccaagccugugauaagcucucucacccuaaaacccuuaaauacucuuagucuguaagagagagugcucuugacugaaaucagccagaagccccucuuagguuuguucuccaaaauaaaccugucuuugacuguugagcugccuuuuguguuucuuuccucuuucuuuaacuccuacaauucucacuucacagggagaggacaugcaagcucuugucucugaagcuucccccgaccucacccugugcaucucuucauuuggcuagacuugauuuguauccuuuauaacaaaacucugauuauaaguauagcacuuaccugaguucugugagucauucuagugaauuauugacccugaaagaauaguagcaaccccaaauuuguagucaguuggucagaaaugugaguggcuugagagccacccaaguuugcagcuggugugugaagagaaggcuguuuuguuggggacugugcuuuuaacuugugaaggcugugcuaacucagggcaguuggugucagaauugaguugugcauugcagagauaauuccagggaguggcacauucuaugaagaaaauuaagaagggcuguagggaggugugaguggcuaugucagcugaguggacaaagaaguccucuuagaagaauuaacaucgaagcugagauccacaugaugagaaggaaaugagagauugcuuauguggaaggacauugucccuggggacucagaaaaugcaguugagcucuaaucagguauuguggccagcaccuccaaauuaggagaagcuaaauggcuggaugcuacacugucaccugagacuaggccugucuucuccaagaaaaggcaugaagucaaggguacagggacaggaacauggagcaggaagaugggcagagcuuuucugauaucaagccugccacuuuuuccacagcaaauggauauaagaaugaugauguuggcuaacacuuagagagcucugacuaugugcaaggacuggggacaaucaggcuuuacuggagcaaacucagugauguuacaauuauucucauuugcagcugagguaaggaucugggugagaaguagaagcccagagagguuaaggaacuuguccaaaggcacaugguuagugagggagaaaguugggauuuggacccaggugggugugauuccaaagucugugcuguucaccaugcugcuauguaagguugcuggccuaagcguggccuguuggcuagcagcagccacaccuuguagcaucucagguccugcuccagacuuccugaaucagaaucugcauuuuaacaagaucucaggugguuucuaaguacauuaauguuuguaaagcacaacuacaugaggccucucagcuuuccacucaaagucccacuaggaauccaaacuuccauccuaaucuccuccacuuuguuaaaauuuucacccucacugaaacauaaacugauccaggaucagagccaugucucguuuuucucaauaaagucucuuagguugaauuuguuuucaggagcugauccuggaauagguuagacucuauuucacuccguguuucugucacuuccaaaguaugcuccacacuguggauguuuagauccaauaggccaagacuaauucucuucaaauggugagagauuggucagagaguucagcagagaaaccaaauuacggggauucaauuugcagagaaaucucccgccugcaucuggggaugcuguuucuucugcagagaguaacaaguucaggaagggagaggcacccagagagaggacauggaggaggcagaacccauccagccacacugaggacuaaacucugauuguuuuuuuuuaagucuugcccaaauuccuaucuaagagguguggggagucaugcccuacaaauaauaaauuuucaucagauggguuuuauuuaaccuauauauugugacuuauuuuccaaccugacucauauaacauuaugagacaaggaagaaaaucaaaauauuuuaccccaaagcauguuucuuagccauauuuugaaaugggccuccaaagcuguucuuugugggggaaauuuugcaucuguaaagaaucucuauuaacauagcuagaucucuuucuucuagacccucccaauccuaaagagauuaagaucugaauaggaaacuuugucaucuauugucucuaagggcauccacuauaagacuucaaaagaacuuugguauccacaaucuuuuaucuuaacaugaacauuccauuucuaucagucucaggucuuuagacaaacucaacaaauugucaaucacaaaauauuuaaauucaccuauagccuggaaccccuacccccaccacccuccgcuuugaguugucccgccuuucuggaccaaaccaacguauuucuuaaauguauuugauugaugucucauaccucucuaaaauguauaaaaccugccaggcgugguggcucaugcauguaaucccagcacuuugggaggccgagagggguggaucaucuaaggucaagaguucgaggccagccuggccaacauggugaaacccugucucuacuaaaaauaaaaaaauuagcggggugugguggcauguaccuguagucccagcuacuugggaggcugaggcaggagaaucacuugaaccugggaggcagagguugcagugagccaaggucaugccacugcacucuagccugggcaacagagcaagacucugucucaaaaaauaaaauauaaaauaaaauaacauaaaauagauaaaauguauaaaaccaagcugugucccaaccaccuugggcacacauucucaggacuucuugagggcugugucaugggccauggucacucauauuuggcucagaauaaaugucuucaaauauuuuacagaauuugacucuuuguugacaacacagaccugcagaaccaagucuggcaucagcucauucacguuaauuccucuguggcaugugacgauuccuccaaauacaaaugguauuugaaaggacagguaagaaaaucagucacacgcacacaaauaucaugucaauuguaaaacagaaagacuuuuuuccaaacuguaaccaauuuuacgucccauuucaacagugaguuugcagcugaaguugaguaacugaguaaucuuaaagagcugauuuccuucgcaggaauuguccauuucuucuaauuguuuaaagucacucuggaaucuggaagauaaaagggaaggcuuccaucuacuuguaaaagcuacagcauuuguaauuggaccugaccucagaaaugcccggugggcucaauccauuaaugggagucagccuagguugugauccugaaaauuucacuauuucugcuuguucuuagacccacuacugcuucucaguuguuaguagcccauggcaauagcagugaaggcugggacauuaagaaaaaauagagcuuaaugauuucuacacaucacuccagggcguuuuugcuuuuguuuuuuuuuucaugccuucuauuaucaacccuaaaaaguuaaaaaaaaccaaccacacacacacacacacacacacacacaaacaaaaaacauaacaaaaaaacagaagucaucaacuuucugccacugacccucacuucuguggcuguagguuuucuaucaagauuuccagaugauugaucucaugauggaguaagauuaagaguucugauacccacucagcuguugauaggcagagacccaaggucauuguuccaggucaaaguuuccucuuugggugucaacauucaucuuggcccuggggaauuacuaaggaugaaggcuguauuaaacuguuucucgaugugcucugcuguauaccagcucugagaccuugggccagucacuuaaccucucuagacccagaccccugaucuguaaaaugagagguucugcacugguugaucucuaagacgcuuccacuguuaggacacugugauucuuggucuuguuuugagcuauacgugaggcaaaaauauacagccacauuuugugggaaaaaauggggaaagaaaaacaauuuagagcaucuucucaggaaauaguuacugggaaugaucaaacguuacccauucugagauuugugauguuaaugcucuuuuuaaaaaucauguaugagcccaucaugauguugcaaaagcaugagggcugaagaccaaacccaaguaaaucgaauguauuauaauuaauggccagggcaggaauggagagacagagagaaagugguccucuaugcugguaauacaccuauuaucauccuacauagauugccugaggcaaccucucuuuucuggguggggcugaaucagagauaagcuuucagaacaauaguagggaagcaaagugagccagaaaucaguacacaguguaaugaaaacuuuaaaaaagaaaaggcagaggcaagagcuguacccaagcaggaaaugaggggucuaggaaaacagggucuaaaauccagauuucauguaggaagucaguuggcccagcaccuguggcuccauuagagaacuccaaagccccagcgcccugagauuucucugcuuggggugaugagugcccuaagggcagaagcugaguuucaggccaaaccuggcauuaucacucucccucugcucugauguauuauuuuucuuccucauucaacaaacauuuguugaauccuuucuagguguuaggcaugugauacuacugagaauauacaagugaauuagauuuuguuuuuacuuuuaagaaguacacuguuaggggagccaaaauagaugcaguaaguggaaaaagaucaguuguuugaugacuugucaaaaagaggggugcaaaaucaagggggaucuuuucuccacuaagcaugggacugggagcaguuuuugucaccuauccuuuuuuuaucucugcuuucagaaccagcccuucauguaagaguaaguuagaagacacagcuugccaguguaagagccaauggaaucuuccccuuugcccucugaagauucgcaaaaaaaaaaaaaaaaaaaguaaaaacauaaaucaacucccaagagucagauuaaauggagaaaaggcauacauauugauuuaacauguacauguggagaaccaaggagagccccagagggauuaccacuccccaccccccacccccaguggggguucagaagcuuauuuaccauccuggaaaaauagauuaugggaguggagagaagaggaauucuguugaggggauuaccagagagaauaaauggaucuaggaacagagaugaacuuguaaauaguuauuuauuuauuuauuuauuuauuuauuuauuuuuugacagagucuugcucugucacccaggcuggaguacaauggcgugauuucggcucacugcaaccucugccuccuggguucaagcgauucucaugccucagucuccugagcagcugggauuacaggugcgcaccaacaugcgcagcugauuuuuguguuuuuaguagagaugggguuucaccauguuggccaggcuggucucaaacuccugaccucaagugauccauccgccucagccucccaaaguguugggauuacaggcaugaaccacugcgcccagccaguaaauaguccuuuugacagugaaagugaaguuccucuccuccccugcucccaaaaccuguuuuuccaggaugauauauaagcuucugaacuccuuuggggggugagaaaucauucugugauucucccuguaguaaaauuugcaugccuuuucuucuauuaaccugccuugugaguugguuuuucagugacccuucacagggcaauagggauguuucccuagacccccucauuagcaaacagcuagacccagccacuccccgagagcauaagagauuuuuuuuucuucccauuuuuauccuaacaucagcucugauugaauagaguagaaaggaggacuuuggaacuagguagauuccagucugaacucugaaacuuauuggcaaagcaccuaauaacauuguuucuguuuccucaucaguacacuggagucaaagguacugugaaccaaaacuaaaaaucuaagcaccaacuccaucucgaaauaaggcuaagaccugcuggacuucauucccaggugguuagaaguucuaagucacaggauuagauaggaaguuggcacaagauacagguuacaaagaccuugcugauaaaacagguugcaguaaagaagccggcuaaaacccaccacaaccaagauggcgacaagagugaccucugguuguccucacugccauacuuccaccagggccaugacaguuuacagacuguagcaauaagauaccaaauuuuaaccugacucuagcauaacaucacaugacagaaaaaggaagaaauaaaaagauuucacacccaaacauguuucuuugccauauuuugaaaugacccugcuaagcaguuuuuuugugggggaaaauucacaucuaugaauaaucucuaucaacauaacuagaucuuuccccuuccaggcccucaaaauccagaagaaauuuacugagagucuaagcaccuuuuaaaggucuaaauggaaacauuugccaucuauugucucuaagggcagccaccuaggagacuucaucuacauaauaaguaccuugaccuccacaaccccuuaucuuaacccagaugcuccuuucuaucaauuccagaccuucagauaauaacuuaacucuuuuaaccaaucuccaaccagaacauuuuuaaauccaccuaugacuuguaagccacacucucacauugcuucuagacuaaaccaauguauaccucacauauauugauugaugucuuaugucuuucuaaaacauauaaaaaccaaauuguagcccuuggacacauguucugaggaccucuugagccuguaccuugggccauggccacucaucuuuggcuuaaauaaaccucuuuaaauauuuuacaggguacuuuuuuauuuauuuauuuuuauuuuuauuuuuuuuuugucaacaguaucaccuauuaagggauguugagagaaucaagagagaaaaugaaucgaaagugauugguuuagaaccugcaugcuagucccuuuuccuuucuugccuuuuccaagccugaagcagcaaagaaaaaggagauaaauaaauuuugaacucuucucuggagccuggagagcugcuuccucucaauaaggagaauugcuuccugaacccagaugagaagugguuucuccuucagucccuauucacugcacagaguauguggccuauguaugcucguggguauuaucuucugaaagagaguuacugccaugugcgccccuguuggaaauguuucauugguacagaaacaacguggagaccgaggcauugccuuauugccuugucuguuuuugcuuuuuuuuuuuuuuuuuuugagguggagucucacacugucacccaagcugaagugcaacagcacgauguuggcucacugcaacuuccaccucccggauucaaaugauucuccugccucagccuccugaguagcugggauuacaggcggccaccagcacacccugcuaauuuuuguguuuuuauuagagacagggcuucaccauguuggccaggcuguccucgaacuccugaccucaagugaucugccugccucggcuucccaaagugcugggauuacaggugugagccaccaugccuggccaucuuaucucuccugucaagggaauggcagguuaugauccugguuuguaaaauucuugcaaaaaaaagauaauggccuuccuauuagucuggcacauaaaauaacuuucccaaagaacaaauauucaccaucaucuugaugaaucuccaucaguaucuuuauuuguuuacacacagcuuugucuguccucugaguguuccagaacuagaugugucacuacugccuugccuuuccuuccuugucucucugggucaccuccguagcucugagaaacugaauuugcaucuuaauccugcagugugacuccagugcucugucugccagcuucacagccaguguuucuggcauggccuuggaagaagcccuugaauaagacauuuucuggaauuguuucuacccagguuuacugaaaacauuugauuuuuuuuuaaaccuuuccuaugguucugacaaacuugcuccaaaguauuuauuuacaguccccguaucccuagaggaguacaguaaaguuuuacaucauauggcugaaaauaaagcaauugucuagcaaauacuauauuccuacaauuaauuauauucgucauauauaguaugagauuucuaccuccaaaaaguggaagucuuuuauuuuuuuaacuaauuucaugaaaguaugaaaguuuggcagccaucugcaaagaugauuacauauuucaauuugaaacaaugucuaccugaucauugauuuuuaaucuuccaaaugguucuuuuguuucuuucuaggugcguacguguaguuuaagagggggauuuguauuuucacagcacuuuuuauuucagcgaaccauccgucaccacucauacuuucagugucauuugauuugaaguuuccauuuggauaggcuuugcaaaaaagaaagaaugaaagaaaaaaaaaaccacacacacacacacacacacacacacacaccuguaaggacauaagcauuucacagaacuauaugggaaaugcagcagaucugaguggcaugcacugauuuucuuuagcauuuugauuauaugggucugaguucagacgaaucaaagcaaaaaugaaacucagcaggcaugaugaaaucaaccaaaacugcugaaaugguugggcagagcccacaaaaaugguuucauucucugagacuagaggauggaacuggggccuaauucaagaggcagguucugagggcugucaucacucaacuccucaaacugaaagauauuuuucaacaauagguuuagucuuuauaagcuguagguuugaacagacuucaguaaaugacacaaaguaaguucaucucuauaaacagcaggaaaaaugcacuaugccacuuuuuaaauuacauaaauguaaucccuauaauguuuguacuauguugguaacugacauguguggcugaggcuaguggugggauaaaacccaaaugaaacauuuuaaggcauuuuaauuuaaucaacaauuggcucagggaugagaguacaguugggaaaacaacucugaccuuguacagacacagcuauuucuauucucuguuccaucuuuuguccugaagccucucagaggcugaaaguaugcucagaaauuugcuguguaaaugccauuuucaaagaaguauuuucuucauuuguaaggcagaaagacuaauauuugcccugcccaauucacaggaggcuguguguaaccagggagaucacauauguauaaaaacuggaaaaugcaguugauacggaacacucuaucacuacuguguccaugugagaacauucuuuuuuuuuuuuuuuuuuuuuuuguuaagauggagucuugcucugucacccaggccggagugcaguggcacaaucucugcucacugcaagcuccgccucccagguucacaccauucuccugccucagccucccgaguagcugggacuacaggugcccgccaccacgcccggcuaauuuuuuuuuuuuuguauuuuuaguagagacgggguuucaccgcguuagccaggauggucucgaucuccugaccucgugauccgcccgccucggccucccaaagugcugggauuacaggugugagccaccgcgcccggccgugagaacauucuuaaagggaacaugggcuucacaacugcugacugcuaccaggcaauucgaguaccagguaggauacuuauucucgguugccuggaaaacaaugagauuucucucucucacacagacacaaaaguauucuacauaauugccauuaacuguugacugcuuuugcuuucaugaaauaucagguaaaauauuauuuaaaagaguuucucugaaguuacaguaauuauaaguauacugagaucauguaaugugaauaaauaaguuuauuuugauaauagguucuaaaaauguuucuaagaacaacagcccuagaauagaaaugcaaaugaacaaugaccacuauacuuuucucauuuucucuuuuuuaaaaagaaagucugccugaaauacaccuucuauggcuccuuucuugauuaucaguugcaauaauuuuauauuacaaagccuaaaauuaaauuauaagccaauuuguguuuuccaauauuuuuucauguucauuucacauaacaugguuugaacuucuuuuucuuacuuuccagagcaccuaggaaaguucuagaugaaugacagccucacaauaaauucuuccugaggcugauuuauuaagaacaaauaagcuaauauuaauuauaaagugcucauauacugcagcaucuacuauuuaauguuccuagaaucuuuuuuuuaagaaugguaauaaaaguuugcagaaggcugggcacaguggcucacaccuguaaucccagcacuuugggaggccgaggcguguggaucacccggggucaggaguucgagaccagucuguccaacauggugaaaccccgucucuacuaaaagugcaaaaaucagucgggcaugguggcgugugcuuguaaucccagcuacuugggaggcugaggcuggagaaucacuugaaccugggaggcggagguugcagugagcugagaucguaccgcuguacuccagccugggcgacagagcaagacuccgucucaaaaaaagaaaauaaagcaaaacaaaacagacaagaaaaaaaguuugcagaaguggaauuuuuauaaauauauuaaguuaaucaauuauuuaaugggaacacuuucucaaauucaaagcuaacuucagaauuagaaucgguaagccagaaauauuuuaccuuuauaugcuaaugaguaauuauuccauaacaaaaaugauuuucauuagacaacacaugacagucuuccuaauuuuagagcaacacuguauuucauuucuuauaauauuuguuuaaaaugcauauauacuauugcuuuaggugaauauccuuuucuuaggcaguugaaauuaaauuucuucugcacaguuuuacuaagccugacuaaacaaaugaaguauuauuguucaauaagugcgugauaaagaucuugaccagucucaauuuuacagguagcauuuucaauguaaguagagaaaaaucaguacaaaguccaucucccuuuuguauuaggaacauggcauugcuuaauugcugacaaccucaauuuacuaaguaggaaacuguuaagcaugcaucauuacguuccuuaggacaucucuuugaguggacgcuauaauuuauuaucaaguaggucuaauucucccuugauuuacaaagugguaauaauauuccaucucacauaaugcuuugcuaggaggaauccaaauccaggcacuaaaauauucacagccuccccaggaggaauugggaugugugugguauucucauuaccacagcuaagacaauggagggguuugccugaggucuccuggcaagucagcuauuuggggagcagaaucuaggucuccggaugccuagcacacaaucacaaaagcauagaacucucaggagaguugccuaaaccacgugucccagaaagaagagagaaaacgaugcccaggaugcucgcugcagaauccccacagugcaaccaugucacuguuucccucugacugcacauaaagcacaccgaaggguaucaaacaacauaaaauccuaauggugcccuuaauuaggagggaccaucacuccaacucccuuaccucccacuguccaagcuagcagccccaaauuccucucuggggugacuaaucuugaaagcaagacauaguuaacagaaacaaucuuuggcuuacaagggaccaucaagcucugaugaugaugaaguuugauagcaauaaugucaaacuuuauauggccauaauccaaguuuacaaugauacauuaagccauaaugcuacuauuuauaucaccauaaacucgguuuauggugauauaaauagucauccuaauggcauuaacagcagcacuccguggaaucacagcuguugaguacugcauuuaugcuauuagcauugcuauuaauaucaucauaaacuuagguagucaaacuuguuacauaugaauauagaggaaagauggauauccccacuuuaugcccaaaucucggcuccuguacuggaggcuuuauggcuguuccccuccucuaaguuaucucugcuuggguugugugauguuucuguaggagcuacaggagagcaagucugauugcaggcaucuucugaggagccuggaaacaauauuuaaaugggauaagaaagugcaagccauagcugcuaugcaaacuuacugucuccuuggcagcgcagaggaccuacgcucaauuuggcuucugagccuugacggucaguaucuccaaccaccacuuggcucacuggcaggugaucuuuguaugauaagaaaccagcauccuuccuccuggaucacagggaaagacagaaaaagaaugaggaggcugcauuagacauaugaauuuucugcuaguugcuuacguugucuaaugaugacauuucaguaaucguuuggaaguuuacuaaguaaagccacaguuaaagaguuguucucucucuuccauagguggucucauagcacauugcucagaagcccuucuggcaucuucaucuucuggaaaacagaagcgacacccugauuuccagagauucacaaccauuaugcugcguacucuuuuagguagagaguacaccacagcaugucaaacccugagcacacaugcagaguuugcuguugucauggaaucagaaguucaacaaagucaaccuggucgcuugaauaauaugugaaacaaaacccuauuugaagcaguuccuucagaaguuuucuucccuauuguacaugaguuaaauaagggacaccuuuuguuccuuccucucuucuuguuuaguuuaacaacuggaacaguuuaugugaaguuuccagcacagaacagguauucaauaagugucuauuuccaucuacaaugaagaguggagccgagauuugagcccaguuggcuuuccuccugaguuuguucuucuguugacucuauauuuaucuuguuucaggucucccaagucuacccuguauccauccuaaaggaggaaagacaaggcuaguugcaaaguacugacucuagaauggagcauagaaacccaggagggguuccuggagaugggcuuaagaugaguuaugugcagugaguuuuggagcccgugcagcacagauuucaccuucauggaaaaucaguggccuuuuguccucuuuuucugcugcuguggcugagggaucccucauuugggagugaaugggugggaggcacaaagcagugugaugucauuccucaaauuuacccuuucagaugauuuuuuacuauucagucugaauagaaauaacaauuuugaaauugcacauagaacucaucagaaaaaucccacccugauuuuuggaugacaggagaaugagacagacaguucaaugauguaaagauuuaucauucaugucucuuagcaaauagugcagggaauggagaggaaccaacuuggaggccugucuugaaaaugcuaugcaguguggagcaguuacuuguaccucugaccuucuugaaugucagugaauauuuguuuccucaugugucaggacccauagaaacccaggaaggagucacagaacuuggccaguuggccucaaauaaaugcauuauauacugccuuaguuauuucauuguuuucaaaaugaaggguuuuuaaaaaauaauuauuuaucaaaucagaauuaagauaaugcagaaaaguacugugauucuuauugacacuguagcuacuaaugacuaggccucaaauaucuguggaauuuuuuacaaacccacccucuuuuauuagaagucuuaugaauuacaaucaugccaaagaggaaacaaagccuuugauauuaaacuuaauauuuagugcuucuuaaaggaacaauaaauaaaagcacucucuaacagcauaugguaauuugauaaccuacuagaaaugauggaacugaagguugagauucaaguuauuacuuaaaauuacaugacucuaaaucagagcucugcaaacuaaguccugagacccaaauucugcccaucacuucuuuuuguauggcucaaaagcuagcuaagaauaauuuucacaauuuaaaugguuuuaaaaaagaugaaaaaauauuuugugaugcuauaaaauucaguguucauaaaaaaguuuuauugaaauacagccauuuaaaaaaauguauugucuauguaugaugcaacuacagagguaagaagcuauggcagagacauaagacccccccaaagucuaaaauguauauuaugugguccuuuauagaguuugccaauucuaacucauaauggggcauaauuguccauuuuugcuuuagaaauuuauugagcaaauaucccacugacuaucaugguaggcaacuguuguguaacucaaucaaguuuccaaaguugagcaagggguuugggaagggaccaaagagggggcaaaaauauguacugagaauaaaugcaaagaaacaugcaagaggacagaaaccaucuacacuucaauuuauuuauuguaacagugagaaauaaauuuaauuaauaauaaauuuuuaaauuuacugugcauuacauagcaggcagucauaugucagcuuugguacaagugagaucuauccuguaggaagagaaggugcucugcuacuuguggcuacucucauuguuuaacccuuccagcaucuauaagauaguauggguaauuuuauaaaaacaaggucuuuaaaugguggaaucucuaugacauucuguaaugaaaugaauaaugaucaugaaaaucugaaagguacaguucaaugaauuuuacacacacacacacaccccuguacaaccaugacccacauaaugauuuagaacagcuccagcacccuagaagcaccccccaugcccuucccaaucaguacacuccaucagaaguaaccauaaauuugucuacugucaucauagaugagcuuugccuguucuugaccuuuaugugcauggaaucacuaugcauuccuuugugccuagcuccuucuacccaacuuuaaauauuuauuuagaugauacaaaaaauaguauauauaauacaaaaaauauuauacauaauacaaaaaaauuguauuauacguaauacaaaaaauuguauuauacauaauacaaaaaauuguauuauacguaauacaaaaaauuguauuauauguaauacaaaaaauuguauaauacauguugcauguauuuguauuauauaauacaaaagauuguauuauauaaauaaaauauaauacaacaauaagaaugaauauucuauugucauuuggauguuuccaguguuuggcuauuaugaauaaagcugcuaugaauguucuuauagauguguuacuuauuagccuucauuuaugucaagcauuuaccuaaaaguagaaaugcugggucauaaaguacacauguuuaauuuuaguggauaauuucaagcaguuuucccaaaagcauguaccaauuuacauuucuaccagggauguaugaaaauucagguugcucaagaucauugucagcacuugguaauguugguuuauuuuauuauuauuauuauuuucuuuuugagauggaguuuugcucuuguugcccaggcuggagugcaauggcacgaucucgacucacugcaaccuccaccuccuggguucaagcaauucuccugccucagcuucccuaguagcugggauuacaggugcccaccaccacaccugacuaauuuuuguauuuuuaguagagacaggguuuuaccauguuggccaggcuggugcuggccucagaugaucugcccuccugaccucaggggaucugcccaccucagccucccaaagugcugggauuacaggugugagccacuacacccagccaguaauguugguuuauauaugaugagugacaguguacuaccuucuuaugaaacuagugcuaggagaaagcauuuuuaaaacaaguguuuggaaauauuccaauuauuauguaauuguauugcccaaauugauauguguauaaccuuauaggaauucacauaucuacacacucucauaauuuggaaauauaauuuuuaaguguuuguaauaauuuuauaaauguagacuuuuaguagguuuugaacuuaaaaaaauuuuuaauacuaaaagcaggcauuacuuaauuauuuugcaagaaaaacugauuaacaucagggaugauagaaauuuauaagccacguuuuaugaaaauguuugcauuauuggucaaugauacugaaaauuuaauaucaugauucauuaagugagaauaauaaucauuaagugagauaauguacauuauucucauuuuacugaugagaagaaugagaaucagagaauuuagcuagacaaaguuuaccaguggcagucuggauucagauucacacuaucuggauccccuccuuggacuuuucgucuuaaaaaggggaaaaaccaaaacagaauauaagccaaaacaccacuauguaaauuaaaagaauuuuccuuuuaacucucauuuauagaugaggugaaaauuaccuuuuaaagaugucuuuagcuaggcugaaauauugagguuacuuguaagucauaaauucaaagauaucugcaauguuuuauucacauuuaccccuaaucuaucaauauaccauacuaagcaaaaaagaauucuagaacuaccucaugcccaaaucaaccaauguuuguaaugcuauauugaaguuuauaaaagguugccguauagcuaguaguaauaacacucagauauuccuuacccaaucaacaaaagagggaaagaauugucagcugagaaaauaauaaaaggagaaaauaguauaaagaugccuccuuggucacuuuugaccaaagaucuaaacagggauccagagaauggaaagccacaagcaauggcaugugaaacucucaaagaagcggacucuacauuaguuguggaaacuaauucaugaaaggcaguaaagugguuuaaccagcacaaaguuuuugugauccuacagcacaaccuacuuuuuuuuuuuuuuuuuuuuuaauuuuagagacagggucuugcucuguugcccaggccagagugcaguggugcaaucauagcucacuguaggcucaaccuggauucaagugauccuccugccucagccuccugaguaguugggaguacaggugcaugccaccacgcccacuguuuuaaauguuuuuuuuguagagacaggucuugcuuuugcuuuugugcccagaguggucccaaacuccuggcuucacggugugaaccacugugccuagccuccacaaccaauuugguuucuggagagggguccucugaaauaccuuuauguuguccaucugagcaucuugugugaaucuuuuugcaagcaaaacgagccuuuguugaaaguuacgauccuuacagauugaggucaaucuaauuuagggagauauucaguaacuauuuaucauguuagcauaauaagcuaauuauaucuguuagugggcuuguacauuggaaaaauucuaucauccauuuccaauaggcccugaacuaagacucuuacaugcuauuuccaucagcauuguuacucaaguaaagcuugauucuauggauuuuguuucucuaaccugguguuacuguuauuucccuucaguauuguuuuucugaagaauucugucuugcuuugcugucuuuccuugacuuuuuuauugugcugagaaagcaaagaagccuccaggcaguuuaaucuuauccuuagcuuaaugaaaaaguagaaaaaugaagcccuaaagaaaaauaaacauccccaguuuuuacaauaagccugcucuucuaccaaauauuaugaaaaugauuacacugaguuuuccuauacaguaauucuagcagaguagauggacuucucuuuugugaaguuucaggauuauuuaguaacccuuaaaaaauguuuacucugcauacuuucaugcauuuccaucacagcaucacccaaacuagaaauuucuggacagaauucaggaagucaaaguuauagcuacagaagauaucucauagauauaaguacaaauacaacauaaacacaugagaagaagccuaauacuaucauuccuuaggcaaauguaacuaaaacuacauugagaugcuacuucacacuaccaagauagcuauaaucaaaaggagaggcaauaacauguguugacaaggauuuggagaaacuggaaucaucacacauugcucggggggugggcuguaaagucaugauucuccugucucagcucccaaguagcuuggauuacacuaaagugacacugugcccagucauuuuugaaaacaguuuggcaguuucuuaaaaaguuaaacauagacacaccauaugacucaagaauucuacuucuggauaucuauacaagagacaugaaagcauauguucacacaaagccuuuuagguagauguuuauagcagauuuagucauaagaggcccaaaguggaaaucacgcaagugcccaucaacuagugaauggauaaaaguaugguaauacauacaaugaaauauuauuagacaauaaagaggaaugaaaucugaauacauguugcaacaugaacaaaccucaaaaaccuuaugcuaagugaaagaagccagacacacaaaaaaaucacauauucuaauuuuacugauaugaaaaaggaaaucuaccaggacagaaaggagauuagugguugucgggcugggaguagaaacagaaauucaugguaaccgggaaucguauagggauaauguugauguccuaaguugggauuguguugauuuguugcacaacucaaugaauuuucuaaaaauuuacuaaaaaaaccuguacacuuguacaguuaauguacaguuaaaaucgaugaauauuaugguauuuaaauuauacuucaaugagguuauuaaaaaaaagaacuguagauagucucaaaugccaauuggcaauaaggucugacaaguguuuugcacacaucucacuagaaguagcaggguaaugaacuacaaagugguguauuuccuggcuuuggugucuucuacuuugugacuaugaaccagggacuacaaaaucuuuacugacucuguuuuuaagggcuuuuccuaccuuuaaaguuuauaucacuauauuuauguauuccauugaccuuucuuccuggauagaaaacacaccuuucuuagauacccaugauuugucuguuuuccucaccuuugaccucuauauagacauucauuaacaagagucaagauauuuaaauggcacagaaugucccaccaauuuccuccauguuuccuucucuccuucauuccuuauuuagaauuugucuuuuguaucccaaccugaaacaucugucacuuuuccaaacuagauuuagggacugugucucaaucacagacaaucaaacauucuugguuuuuccaggacaagcuuaacaauaaaauucuguuugacugucaacauucaucauuguaauauucugaaaaugccaacauuuuuagcauuaaaucugcaucucaaggauggcuucuaaacuuuuuggagucuuuuguuugauuucuuguucagacaauuaaguucacuuuaccucuaaaucuuuguaucucuuuucuccaucuuuuuuuguuuuuaaaugggguuucaccauguuggccagguugaucuugaacuccugacuuaagugaucugcgcaccuugaccucccaaagugcugggauuauaggcaugagccacugagcccagccucucuuuucuccaccuuuucugccuccuaacaaucauccucaaauacacuguacuuuuuccauagcaaguguuuagaaaaaguaggucaaaagguaaaaaccuauaagaauuuuccuggaaaguuauuuuacuaauggcuuacacuaaagauuuuugauuaaugucuaguuauuucuauuaaauaaucuuuggguuguucuuauucuuucuaucucuuaaauaaaaauucacauccaggcauggugucucaugcuuguaaucccagcacuuugggaggcugaggugggaauucaagacuaucuugggcaaaauggugagacccugucucuauaaaaaauuuuaaaauuagccaggcauggugguguacaucaauacucccagcuacuugggaggcugaggugggaggauugcuugagcccaggagguugaggcugcagcaagccaagguuacaccaccgcacuccagccugggugacagaacccugucucaaaaauaaaauaaaauaaauaaaauaaaauaaaauaaaauaaauucauaacuaaaaaauguuuuaaaaguuuaaaacaacuuaaaaaaauagacagacuuuacccagaaauaagaugcuacuucaugguuaauaccaaaaacuaucuaauuguuaaaaguguguaucuaaugcacauaaaacaggagaggaaaccuauaacucaagccaaaguuaguuuuuguuaaauauuuuuaaaaguauggcgaauuuuuaguuuauuguauuuauuuuguucucagcuccaucuuucuguauccucucugcuacaugcccucuguccaagucucuacuaaaaccugcucucagagaaaaaggugacaaaccuuaaaccucccacuuaacaaaccaguuaaguagaagcaaugccuuaaugagacugucauacaggguuuaugggaggccauuguuuuggaguaggcccugcaguaggucccaacaacucagaccaaaccaacaugcaaucacuugugcuaggugccacauaacuaacgugaacuuugaaagccaccaguuuuccaaauaacaggagagucauagucaucaaucagaaggggcccaguuuggcugggcgugggggcucaucccuuaaucccagcacuuugggagaucaagaugggaggaucacuugagcucaggaguucaagaccagccugggcaauauggcgaaacccugucucuaccaaaaauacuaaaaauuagcugggcaugguggcacaugccugucgucccagcuacucaagaggcugaggugggaggauugcuugagccuaggaagucgaggcuucagugagcugagaucauaccaccauauagagcaagacauuuugucaaaaccaaaaagagagaaggagaccaguuugccugagcuggcaugauaagagaucccccuguuuuaacccuacaaggaaaguaacuuugaaaugaccaauccacuuuuuauuccuuguuucugcuuucuucagaccuuuucugccuauaaagccaaucuccucuacucagggcacugggacagcuauuccaguuuauagagugggguguugcccaauuugagaauugcuaauaaaagccaauuagaucuuuaauuuuuugugcaauuuugucuuuugacaaaauucuagaaaucaaaucucugugaaugguggagggugaaugggagagagagaggaacguuccuggcaucacugaaaugauuaugaggaggugauuucauguucuuaaaagggaaacccaugggcugaguuugccaguuccuuuacguucauuuucaaaaaucgcuucuaugucagaaguuaaagccuuuguucauaaaacaaacaggggcuggaucaucagaaaggcaaauaagcggcaggucccucuguucacaccccuccucacucuugccuugaugggccuugggugggugccauuaaauguuucucauaguguccuugcccaccauugacuguugagcuuuccugcauggaaggaaggaagcuaguguugcuaggaagcaaugagagugauuaagaaaacaaccaugacaaugagaucuuuagaauccaugccuauguccccagugaaaugaaaguaauuacagauucaauuacugcuuuucagugagaauagucuaggccuuuuacaaaaugugagacaauuaucuguucaauuuagacuucucuuagaaagcccuuguaaccauuucgggauucuuugcaaaacguuuuucuuugauuugccuuucuggaaagcaaguucccugagggcagauauauuguuucauggaacuuuguacaaucaacacaaaaguguuuauuuaaaguggauucaaauaaaaguggccggcuccacguguuucaugauugaauaaauacaugaauaaacauagacguuaacuaggcgcagcucuaaaauagcuacccguauguacuuaacuaucaauggagagagaugaaaaaaacccaacaacaagccuuucuuguauugaagcuccuugaaugcucuugaaauauuuuuaguaucuuuuuuuuucuguaauuggggcuuauuauuucuuuagaaauuaauauuuaauuagaagauccauaucucauuaacguggugaaagggguacaagacuuagauuugcaaaggcaaacccuaccuuggcucugucucuauguaaaaguaaguugguuaguuuaucugggccaauauuucuucacguagauaugcagugugagcccuuugaggacaagacuuuguaguccuacacagucuccccacaugcaauuagaacaguaaauuucugggagauaaucuaauuauuacccucauuuuucagagguaauagacuaggaauaaaacagugucuagacuaagguacucaaccaguuaauguagguuguaugacaagacuuuguaguucuacgcaauuuccccacaugcaauuagaacaguaauauuuugggagauaaucuaauuacuacccucauuuuucagagguaauagacuaggaauaaaacaaugccuagacuaagguauucaaccaguuaauagcugagcuagaaaaaaacagaucaaaucuccgauacucuagaguuuaagaaggaaagaugcauguuuacauuuuuuaaauucuaaaauaauuucaauguauuuccuuuaaaugauauaaaaauccauucuuuuuaucauauaggaaaauugccuuacuggcuagaagacuaauuuggacuacauacauuuuacuuugugcaucuacauucauauuuucccuaaacaggaguuccuuacauuuuguacaucaugacucauuugcaugauuaguagagggaaugcuugauguguagccucuuugccauuuccauguguuuucauaucuagcaauuaauggccaacuccuggcaucucaaaaguagucaaggggaaaaucuucccuuauaauggcccaguauucuuuuaaaauuagagugaauagucuaggacuucucgguguuucugaagcguuauuuauaaccaauaaauaagugcagaaacuggaaugccaugugcacccagccacugacaacuccccucuguuucugcacaguucacacuccuccucacucuugccuugauggccccugggugggugccuuuaaagguugcucauggcuggcuucauuccacacauccauguuucuuucccuugaaacuaaacagcgauaguccacucccaugauggugaugaugguugugggcagacggaauaugcugacaucucaacucugcaaauaaaucuuuccugcuggacucugagacacccccaggaauuguugggcuucucuuaugucacccaaggaggguaacugggugacacggacagagagggcacucagcuuuggaaugugaggguacaugccaccuuagucuaguucacagccuggggaaaccuaauucaugacuucuguuuggauauauaaaaauuucuaaaccuggacaauuuuuauaaaucaaaucuuuaucuaauuuacuuucuguacauuccuucauuguuuccauagacuucaacacucaugaaaaacaauaaucggacucuccacucccuaaauuuuugcuuaaauagcaugguuuucucaaaagagcauuaguucugaugcauuuggccucagaaggaaguacaauaugcuuugaauuuuuauuuuggggauuuggccaucuuaaaagguacuauuuuucaaugauaaaagcauuauuuuuuaaaccaagaagcauugcuuuuuuucuucuugaugccauuucuaaagcccccuccaaguaacacagauccauauaagugauuccuguaucgauuacugccacaaacuuuucucuacaaacaucacaucaucuuugagauacuuuguuauucccacuucaacucagcaggucauuuugcuccccuaguggauacaaaagacugauuugaagguggaagugguuucuuuuacccaucucugaagucuguaaggcccuuaggaugaucgauauuuguuuuuauguuaucaauaucucgaagaugcugugggacguagacguuugaaaaaggcacaccaccucagcuacaacaaugaaaaguacuuacucuucagggugagguggcccaaauaaaaacagaacuucaaaauaucucucagugacugggacuaaaugcaagucagaaugcagccauggaaagagccuugagagcacugucagugucagcaugaaagaagaagaaugaaccaaagaaguugaaaauacaggaucuaaaauucugaaggaaccaaaagaauuauauguacuauaagccaagggaacagagagcuucuggaggguggggugggagugaggugguauauuauguuaaauauugcaaaaauguccguuaucaaaaaauuaaagcauguacaucagcuauaucaauauggagaucaucgguggacgggacacaaagggaucuaguaaugucaugaagaaaaaguucaauagcugauaauuaaaugggagaugagagagaagagacaaaccuuaaacucuuaaaguuggaaugagaaauggaagaagcaauagggcagaaacuagaggaguuuuagcauuaagcaauuuuguauauagacuaggaacugaaucaauuaauuauguuuuaucccauaugucuguaaucaauuugccaacauugcuuuccaagguuggcaguaaaaagucaugaauauuacugccuuauguguauaggcagcauagaacuuuguccagaagaugaaaaguggcacaugaucagagacauucugacugaccauugcuggggaaugaaaguuacacuccaggguccucucauuucaguugcagugaacaaggagcaccugggcuucuuucuccaacucauaauugggcacauggcuuuucugaaauaggauggccaacauauuaaaggauucuugggcuuguaccuuuggaaaaaaugucugaaagaggaauuaacuagauaauuucacagugagguucagagcuuugugguuaacuccagccagcuggauauuugaucuauauugguuuggagaaaaucagaaauucagcaacccacucagggacauucuaaaacuucaguuaauuagauuuuaauaaacaaggucaucucuauuggcaaacuuacucuguaauuuagagggugaaccauuuaugauucaguccaacuuacacagauuaaaagacauauaaauccuccucucagaaguggggcaauaaaaauccaucacuguuaaucaagagagagaaaaugccucaaaaggaguaaggagccuacaccuauugggcuauguaaauuuugaccagugaaaaacucaauuuagcaauuuagcaauuucacuuuuuuauuuuuuucagaauaaauaaagcaucugaauauuuguuaaugugaauuuauuuuucuccugugaggauccagaaggggaaauugccacgugcuuuugcagggcagucuccagguugcaaauaaucugaaaauaggaaaggaaaaugauggaaacaaauccguggaggauugagucauuuuauuuccuugaggugaacaaaaucuugaugaccaauucuaaauuuaauucuucgagacuguuggauuagucugcucaggcugccguauugagacaccauggaucggguggcuuagacgacauuuauauucugguaguuuugaaagcuugaaguccaagaucaacauguugguagaguugguuucuggugaugccucucuccuuggcuuguggagggccaccuucccaccguguccucauauggccuuuccaugaacuaaaguggagaaaggaaccucuccuguguuucuuccucuacuuauaagggcaccacccccaucgcauuaaggccccauucuuguggccucauuuuaccuaaauaauuuccuuaaugacccugucuccaaauacaaucauguugggaguuagggcuuaauagaugaguuuuucagaggacacaguucaguccauaaugguuauauauaauguuuuauauuggguuuuagaaaauauuaauucugaaaaaugguaauaaauuucugaggggggaaaaaagacauuuggucuuccaagcaagggaucugggugauaauuucauggguauacuaauauguaacaaugccuaagcuguccauuuaagaugugugcacuucccucuaugaaaguuauagcucgagaaggaaacagcaucguuggcuuaucauugcuuucuaggacacaguagaaauuuccaguccugggaucuucacaaaagaguccaaguuacuguuucagcauuucgcgugucuggguguuuuaggaauacagaauauaaugugguaucaaacuugccuccuagccacauaaaccauuuacuguuccucaacgugacuguuuacugucacacauuccucuguuuguacauguugcgcccuuuucuaggaugucuuucuucuuuucucugccuaaugcaaucccacucaucccucaagccuuguaaaguuguuauaucuucuaugaaacucucccugaccccuccaagaucaauuaauugcuucuuccucuaggaagaacuguauuauccauagauaacagaacuguauuucccauagaaauugacucacauggauaauacaguuaugguugacauagauuguuaauuuucuggggccuugguuucagauauuuaucucuuugucucuauagcacauucuuacuauguauccuacuuuuuggauugagucauuugaccaacaaaaaaaaaucuaacucuagugauguaauacucuuuauaauuauguccucuuuacugcaaugugaccuucuugaguaaagauuaugucauuuuguagccauagaacuugaccucgauauugcagugguauaauaauaacuguauuauaagcaaauuucaccuuucuagaagcagacacuucgcacugugaauuaaccaugguauaucuuauugucacauuuuuguugacauaaauaagugauuggaaggcaagauuuugauaacauaauuuaugacauccauauuuucccuggcaggauaguauucuguuuaagaaaagggacucugauguuaaacuguuuaccuucuauguccucuuuguauguugggcaaguucccuaacuuauuguuaauuuccucaucuauuacaaagcuuuuuggaugaaauuuaaacaaauuaauggacuauacauuacuuagcacagugccuaccacguagcauuugaucaauauuaaauuaaaccaugugaaauugucaauauucacuuagguguuuacacacaaaaauaucaguuucauguguuucaagcuaauguuaacuauauuaaaauuaucauuaucacuucccuuuacuguccaacaaacagcucauaaucauuuccuuuaauacuuaauaugaugggaacacaaauucaacacauguauaaagaaggcuaauucugcuuugggcucauacuuuuucccagguaaugaaggaugauuuccaucuauaacaggaaauaguucaagacagggaggggcagcugaucaagucucucacccuuccucugagcuuggcugccucuugcauagcuuccugagcuucaaaauuaauucccaaagcacauagacuaacauucuaauucaguauacacauucuaacuauauccgaguaugaauuuccuuaaacuuguaucugcaaacugacuugaaaaaguacucauaaacuuguuaucauuuucauauagaauuugcuuccuuauuaauucaacaaaaauuuauugaguguccacuacauuccaggcacugccuggucugguggggaaugcaaagauuaaucaguccuaacucuaaucuucaaggagcacauaauuuacuaggcuuaggcuuuaguuuauuuauaacugaauaauuaaauuaauacucuauuccccaucauagcacaucagggaucuaucuguuuuguuucuguuucuuuuuacuacuuuucuguugccuuuccuauucucuuucuuuccuaguauugcaauccuacaguucuuuaagaauaaaguuguuacccccuuugaauaauuuuaaucuccuaauuuaauuccuuuaauaaaguucauauucauuuaguuauaggcauuccuaagggaaucaugcauuuuuauuauaauuagauaaugaauauucgaugaccaagauucugaaauaaaaauuguaaugccagugaugaaaaugcacaauaucuagaaucuuuuauuacagaauuaccaaugagaauaaucuacugggaauaacuaaucuguucaagcuggcgaaagcaguggauguggaaguaaagguuuuaauauugcccaauagaaauguucucucauuuauuuaaugucuucuauuggaaaacuguagaaaacuguaauaaugccauuccuaaauaccaugcccuuuugagaaggugaacagugguauuaguucacaagccccaugcuuaaaauguaacucaguggugugaaauagagaacuuccuucuccacguauaucuuuugaucaucuugugcauuguugcucugcauauuuguuaaauaaccacacuagcucauuucaaaugagcauacaagagauuccuacuucuccaggaaaugucaaauauuccugguguagcaaauaaauagaucaaaaggaagcacaacuauuuagaagaaggcagaagauaguaagauacauggauuuuuucauuugaguauauccuaguuauaaaaagagauauaauguugaggggagcaggagauagaaguuaggacagggauauaaauuaauuacuagaugaaaaaggagccagguaggagaucucugacaugaauaggucagaugugaggggagacagaauuguauggaaucaaaagauacucgauucagaaggcguuuuacaaaaagggaauacacuggacuucucuaaucuauaugcaauuaccucuuuguauauaauuuuugucuugaguuaacuucaccaacuauguuuuuuuguuauauucaauaauuuccugcaugcaggcuucuacuuaucaccaugauuucugggaaagaagaaaaagacuuauuucuagggcauaaagaaagaaagagagagacagagagagagaaggagggagagagggaggaaaggaggaggaaaggagaaagaaagagccuagguaauuagauacagcaucuuugacagagagagagucccugggcaccacagggagacagcauaacucacuaccguccacucuccucuggaccuuaggauguugagcucauccuguguuuaacuuacuugggauaggaaaugauacuccaguugaugcuggaaaacacugccuauuacugucacuauuguacaauuacaauguacaggacacugccuauuaguaucauuauuguguaauguucuuuguccuugucugccuggauuauucucauauuuggcaggcugauuucaggcaauccaagauuuaaaauguguuauaauugaauauaccugaacuuucaauaacaccacugcuggagucaguaccaccucauugguuaaucaucucaccauuuauugaguuccuuugcauuuugcugccucaaauuuugccagugacggcauaaagcuuccucauagaacucuaacuuguccugcucacucaucaguuacagaugcugacuccggcuuugcaccagguaauucaucuaccucuccuagcccuccauaaaaaccaguuauuauuuuucccucacccaugcaggaacacuauguuauaguguccuugggaauuccaacuuaagagccuaaacuauaaccacuccaugacucugaugguucugcugggcuugcugugggaauggcagccuacuagguggcuugccaaggauguauuggcaugaaguagucaucaguucucugagccuaaaggaaggagagagucgaggugcugaggcuuauuccaaggauaauguuuuaggcuuaagggaaaggaguaguuuugaauaggaugagaggccacucaaaugguuucaaguuauugguaagggggcaacaaaaaacugaauuaagugacuuucuucacuugaaguugagguaccaacugggacucgacuccagagguggggcucagauccugaaccaaguugaggacuagcuaaaacaggacuggggcaggaguagcuuuccauaagacacacccaccagcaugcccugucaguuuaccaucgccauggcaacaccuggggguuaccaccccuucccauggcaaugaccugaugaccccaaaguuacuaccccuuuucuagaaaugucugcauaagcugcuccuuaaucuacauguaauucaaggucgguauaaacaugacugcagaacugccccgaguugcuacucucagcacacugccugugggguagcccugcucugugggagcaaucacagaacuguaacacggccacuuccauaagagcuguuuucuucuacccuaccauuggcuugcccuuaaauucuuuccugggagaagccaagaacccucaugggcuaagccccacuuuggggcucgcuugccuugcaucaaacucaugguggguacuugagcuggauucaguguccugagcauuggacaacccacaucuguccuaagaaggugccagagacacccaagcaggagcuggaauaagggagaaggucauggaaagacgcuaugaggcaacuggaaaaccugaaugugcacucacacuugagccaaccacugggaacucugaaauaacggaauagaaucugagaguagcugaaguuccuaagauugcuaauucagagggaaccagguaaaugcaauuugucugauauggcauggagaaauacaagucucaacagccaaagaaaggaaugauaaguuuuuaaaaaccugauuucuacuuggguuuucagaaucacaguuuaauaaaaaguggagccuuuuuguauagaguuauguucagugugguccuuagauguguugcacugacacaccugggaccuuguuagaaauguggaauuacagauuccacccuacacuuacugcaaaaaaaucuguauuuagcaauagugccagguaauucauaugcacaaggcuuuagggaaugggaggcaaacugaugaguugggaguuaauuuggccagcagacaaaaauagcaauuucagugucugucuuauuagaauauacgucugacuccuauaaguaauugaguuuuaguugugguaguauaauucagcucacgauauguuagaauuuguaugauaauauuuuuacaaaauuaugcaaucuauacuuuaaaucuguaauaguucaguuauauuuuuggcucuagguuugugaaucaaccuguaaaaggaauuccacucccaugaagaagaaaauaucuaccauaaaaucaauauaaacauccaucucuuaggcaguuauucucaaagggcaauuaaugcaucaugagcaucugaagaccuugaugagcuugauguccuagagauuuuuggauagaagugagauuacccaaaucucagauuucagaucagagugauccugauaacccugguucccucgcaaacuuuaaauaaacauacaaauaaaaccaaaauagcuucuacaaauaagcaauuuguauuuucaaaauuaagcaauauuuuuucucuaguauucacguaaguauucauuuuuuggugaucauuauaaucaaugaguaauauuggauaaaggaaacaaaccauuucaggcaaagaauuaacuucuagauaauuuaauucaaauuacucgugauacagaugagaaaacuaagcucuagaaaguuaaagcgucuuugcuuaagaucacaguauuuauuaauauguccuauugguuuauuuauuugagacagucucacucuaucacuuaggcuaaaguacaguggugcaaacaucugucacugcagccucaaccuccaaggcucaagcaauccuuccaucucagccuuccaagcagcugggaccacaggugcaugacaccacaccuggcuaauuuuuaauuuucuuuuagagacagagucuccucauguuguccagacuggucuccaacuccugaguucaagcaauccucccaccucggcuucccaaagugcugagauuauaggcauaagacacuaugucuagcccuauauuucuucuuuauaucuuuuuuuacguauacaauuugauuuccauuuaauauauauguaucuaacauaauguucauggcauuuuagacuuuaauuuuaguauaucaacugaugauuuuagaauugcaaaaugcuuaauuucuugguuaaccggaacugaauacauaaucauugcaauucuggaccacagugaccuacgaaccucccauuucuuugagcaucucguuucccacuguuuuuucauccgauugcacuucagccaccuacuccccuggugauacccuugacuuagucauuaucuuuucaaacuuuuauucuaguuaugcugacuucugaccacugccuuuaauuuuccauuucauuuacucugguucucaaauacaguauuucuucuccugggaccuucaauucauugacuaucacuuuuucacucucuuguccucacuccuuuucuucauuaguuuagauuccaagguucacuguaauuaucacaucuuugagaaacaaacaaacaaacaaacaacuucagcucucuccaucguauuugucagcaaaaccccaacagaguuuacaucucauucucugcuaacccaugcuaacccauuuaguuccugucaauccuacuaacuuauuucuggucacuuucacuccuuuucucuuaacagacuuuuuccccugucucuucaaaccucaaacaccuuuucuccuuccugccucaguaagugacauuacuuggaaaaccaacucugggaaugccagauguuauuuuaccgcaucuaagcaguaaaacuuggagaaaaacaagcaaacaaaaggugcugaccaguuaugcguuacauggagaccaugaauaucaccuggguccucagaccugcaggacaacccuaucacuuucuuuagucaauuccaucuuccacacauucucuuacaccucuagccaagacuuuuucccuccacaccucaggaucagcaaaugaucucacucauuucuagaaaagaaaagaaaaaaugggaucaaucuaaguagaauuaaaucuucuuccuguccccaaaccuaucuaugucugggucuguauauucagcuuuuccugauaugauggaugaaaaguccaaucaagaugaaaaauuaagcaguaaacugaaaucucacaugagaauccugcgguccauggucauuucagggucuagguaugaggaaaggcaucugcaugugcuucgauaugggcaugugucuucaggcaagggugucagcggcagaaggcugaacacagugaagcucucugaaugggcuucucagacuaauugcaagauuucauuagagccucugcugccaauucuguccagacuuaggagaaaucagaggacauguacaucuuucuuuuggauauuuccagaauuucuauuuugcauccuagcucauuuaaacauggcucaaaugaaaacaguucgauugaugugcuuaucucacugauagcuuuuuuuuuuuuuugcccccugccaaagaaauaaucaucuugagauauucuccaaaggucauuuggaaaacauuauugaaaaauauacacauaaauauucacucauguauuuuguguuuuaacaggaacaguaaccaaauucuauguuguaaaauucaaauuucacaaugccuguuuauugaguauauucaaauaguuauuauuuuugugguaguugaaagaacugguauauaugagcaaagcaaguagcuaaguaggcuaaguaagcuauaaauucuggaauuuucuuuuaaagauuugcagugugcaacugugaucuuacuuuacuauggaauucuugcuugggggaaaauuuuucacuauaaauagcaccucuguuaaacugugguuugauuauagucaguaauucuugggucaagucuguacccccaucacaagccauucuuuggagacuuaguguccugagauaaaauacaugcauucuuguuuuguucuuuaaccugcaucucaagauaugugcacggcgcuuuugcucuuuuguccauaucucaguuugugguucucagggauaccuugaccuacaacaggagacauuuccgauccacuuggucagggacugugcaucauaugauagcugagguggggagcaggccagugaguugcccucugauucuguacuauagaaucaauuuccuccacuacauaucagaacauucuagggcugaaauucucuaaauguggccaggagacaacuggggguucugaauaccuuucaggggauccauuaacuauuggaccaaauaauuuucauaauaauauuaagacaucaauuuccuuuuucacucucauucacucauggguguguaauggaacaacacuacucuucucauuaaucuuuuuuuguuuuggaauaauguaguuuuuuuaaaaaauaaaagcauguuaugcuaauaaguagaggguuuuuaauguugucuuaaauuaauauuuaaaguauaucauuugucuuaaaauaaauauuuaaaguuugucaguuuuaauuucuaauacaugaaauucugauauguaaaacucauaaaaauaaaagcuuuuuggaucuucaauuuugaugacuaucaacgaguuguaagauuuaaaaagugugaucauuauugcuccagaggaauuaaucuuaauccauauacuuggaugugcaauaaauaucacauggcuuuuauuuucccuacagugaacuuggaaagccuuuucugcuguuucacuuguggugggaaauucagugucgguggcucaacuuugcugcacuaucuggauucaccugacaggaagaaaaaaguggguguagcuguuuuuuacagaaacguuggagacuggauaaggugaaagggaagaaaaauaucagagagaucucuucauagugaaaucacuauagaaaucuuucagccuuuuuauacuauuguacacuuuuauacuauaaauucccaugaauaaaagcuuuuguuaacucacucuaacuagacucucgauauaggggacggauauacugaauugugucuaacacacuuuggauacugaacacauauugcugagcaaauaaauaaaugauuguuucuaagagaguuaauuaaaauaaaauugucaucuaaaaauuauaaaaacauuaacuauagcauucaaauagcaauuauuggcugaaaauaacuaugcuuuucagugcuagaaauaaacauaauugcuuaauauauagaagaacaagaugcauaacacugaaucaauguucaguaacuuacaaaaaaugauaaauccuacugcuuuaugucaucaucuuucaguaaggucaauauaucauuauugucucuucugcuugcugucuucuuuuccuucuguauaauggugaaacuauaguuuaaaugcaaugcuauaucuucuacucacauaaaaacauuagcuuuuauuaucuuuaaugcuaggucacuugugagcugcuuccugcaauaacauaacaucugaaauaacucuaaaaaaucugacuugaacaaagucuuaaaagauaauuuaggauuuacagaggucucugugagaggcaccaaaagaaaaaaaguuauguugcaugaugcaaagcagaauguauuaaagucaucuucauuuaugcgucucuccauaguacacuggacaagcacuuuucuccccugaagauaacucauuuguuugcuuucaugucuuccugcucaucucccuucuaucccauuucucucuccaacucuucuagaucuacuuagguucuuuuucauguaaauugguguagcuucugugguggguagaacugugucuuccaaaaagauauuuucaaguucuaaccccugguacuucucgauaugaccuuugcagauguaaucaagucauacuugauuaagaugggcccuaauccaauggcuaguguccuaauaggaagggggaaauuuggacacagaaaacacagagagaaugccacgugacaagagaggcugagguuggagcgaugugucuacaagccaagaacaccaaggguuuccggcaaccaccagaagcuacgagagagaucauggcccugcugauaccuugauuucaggcuucuggccucuagaaccuugagagaguaaauuuuuguugcuuuaggcuacucuguuuaugguacuuuguugcugcagcccuaggauacuaacacagcuugucuuagaacuucucaauucccucuccacuuauuacucuaaucagcauaaccaauagaauugauauuuccuuuuuuaaaauuuaaaguuucaggauacaugugcaggacaugcagguuugugacauaggugaacgugugccaugguggucugcugcaccuuaucaacccaucaucuagguauggaaugagaaucguauuucuuagaaggaaagaagagcaucuguggcuaccuggaugcugauauuuuugucccacucauguaauuuagacuauuugacuacaugagcuugucuuucuaaggauucaaucauucacacuacucagcuugguuuaggggauauugauaagaauacacacuauucucaggaagcuuucaguuuagggggaagagacaauggaacacacaaauaaaacuuagcacaacugaugcuuccuaugaaacuaagaaaacgcaaagugagcaagacacguagcaacggaauaaugcuuacuucaucaaauuugagaggcaaagaguacacuauacaugaccauucaucuugaaaacaauguaacaauguaagauuggggaaaacucauuacgccagaacuuagaagacagcacaggcuugcuuugccacauacuacgugaccuugggaauauucccuaaaucucuacguuucucaggugcaaaauuagacuagcuauucccuaaggcaguguuuuccaaacuguaaauugagauacauugguagauaguaauuucaauuuggggaaccaggagcagcauuaaaaaaaauaaguauauuuuuaaaaugcaaagacuaggaaauaaagugcauucgauucuguacaaaguguaaauaaguauuauuucaggaagcuuucauuuuaguuauguaccugcaugugacgugucuguguguguaugugcauauuuauacuucaucaacaugagaugacuuucuuacugugagucuaaguuuuuaaaacucucaguccugaguucccuuuaaacacuaaacugcuaauaaucuaugauaguuaaguaccaggaggaauacauuaugauaggcguacauuuaauuacuuaaagaaauauguucaauuuaaugugccaaaauacuaugauuuucuauaaauaaugaaaaggagagauuuauuuuauuauuguuauuauuauuugagacagaguuucacucuucucgcccugccuggagugcaauggcguggccuuggcucacuacaaccucugccuccuggguucaagcgauucuccugccucagccuccugaguagcugggauuacaggcauccaccaccacacccagcuaauuuuguauuuuuaguagagaugggguuucuccguguuguucaggcuggucucaaacucccaaccucaggugauccacccgccucagccucccaaagugcugggauuacaggugugggccaccgugccuggccgaaaaggagagauuuaaguaugacugcuuuuaauuaagauauaaacaugcucuauauuuugaaccaaagaaugaucuuaauuuuggcauuaacauucaguuugagguauucaucuaacauuuaccuauuaacuguauuaagcucaguuucuaaaauuggggccaugccacuaugaguucucauaacaacauuuauuuucauuuucauuuuuuuuuauuuaauuaauuuuacuuuaaguuccgggauacaugugcagaaugugcagguuuguuauauagcuauacaugugccauggugguuugcugcaccuaucaacccaucaucuagguuuuaagccccgcaugcauuagguauuuguccuaaugcucuuccucucuuugcccucuacccccggacaggccccccuuguauguuguuccccucccuguguccauguguucucauuuuucaauaaaauuuauuuuuaagauacaugcugcucuaaauuuuugaauugcucuuccccccacccaaggucuagcucugacuuuaugaacugcucuuugauuuaacacuuucuauuagaauucuuauuuugaauucagcugcuuauauucccaaaccacaacguucauuucugacuauuuuuauccuguugaccccagaauuaauaacugcuucuguccagcaucacccuuucuuaauuuaguuuggaacauauauucuaagaaucaggauaugugcuugauuauacggagguuuggacaauucucucuccacuauaaagccuacugauggucagucaugaaucuucucuuuccucuuucccuauuacagaagaaauaccucaauuugcucuguagaauagauuguaaauuuuucuuucuguacuuuuucuuacuguuguucuuacguguccucacauucucuuuaggaaccuguuuaaaugucuuuccuucccucucuauuuacugggcuccauucuucgucuuccaggcucccaaauacagugauccuggaaggcacaacuuucucucugcccucugagaguccucggcugggccugagaauuaaaucgcuaucagauaauuaccaagauaggaguauacagauuuuaaauggacaugggaauucacauaggaaaaugaagacccaaagaagcaguuagagucagaugcuuauauccuaaguuggaugaagaggagcaccuugugaaaacauggcaagacaaagaggcuugggccagagcaguuaauuguagaaaagugaagagacagauaagguuaauuuaacaaaguuuuuugguacggauuucucuugaccuucacucccuaucucuggugauaagaauguuucuuccucccaauacagggacaacaacuuuccccuggagauuuaucuccugcuuuuaggaagaaaaaggaaggucaaagugcucuucuuguaucugcuauuuuucaagagccuuuacuucaacauaauccuuaugccaaaguggcaugcuuugagguuauauauucugccacccuucugugauucggacagagcagagcucaccagguauugcaggcuggggugccagucuguuuguguuugugcagcuuccacagggguacccagaagcugucuauuuuccuauuggaaacugacuuugcccaaggguauuauaacaguagagcacauuaaagaucagcugaaaugucaacaaacuuucaaagagggcuauuagcaaugaaaaugugaguuuccagcacuugugauaagcacaauaaacaaaacuguaaggucuuuuuuuuuuuuuuuuuuuuuuuuuuuuugccucucuauguguauagcuuaagcugugauggaaaagccaguucucacuggacuaaggauauaaggacaauucaucauauuuaucugaugugcuagccaacuguaugaauugcauuaauccuaauggcacagucacaguugaaaacagucuucagcuugcaaagucaauuccaggugaguuacugugccucccuuacuauacuugguaguuaacugcuuuccgcaacccauccuggucucuggcgugugaaacaccccccaggauucugcagggcuaucuacagaaccaacucauugcaauggauucccuuucuccccaagccuuugauggguaaaaguugggauuugacaagaaaaugucacuugcauuuagcuucugagagcaggcuggcuggccuugugcccgaaguaaaugcugcuuuucuucuuuguuauuaauaccaauucaaaucauagccucuucuuauuucuuaugggcugugaccagguacuacccauucuaccuggaccucaauucaauucucagucauggguggaagccauucuccucgaagcuucuuagcaauccauuccuggaauccuacuuggguuuccugaccugcagcccagggucaaccuucaaggagaccccaacagcuucucuggcuuccaucugacccagcagagugguacgaaaccucucugaccuuuccaugcauuagaaugcugcugaggucacugagucuauuucuugcuaaauaaccagguuccuuuugaauucgcucauuccgggagaacaaccaacuagccugggcuguaauuuauuccuagcuguguuucuaaguuucuuaagacaucuugagccagucaggauuauagcuuuggagagaggauuuuguuccugcaauaaaccuaaaaaaaaaaaauauauauauauauauauacacacaguugauccuugaacaacacagguuugaacugugugaguccacuuauacauggauuuucuucugccucuuucaccccugggacagcaagaccaaccucgucucuucuuccucagccuacucauugugaagacaggaaggaugaagacuuucaugaugauccauuucuacuuaaugacuaguaaauauauuuuucuuuucauuaugauuuucuuucuuuuuucuuuucuuuuuuuuuagacggaguuucgcucuuauugcccaggcuggagugcaaugguucuucucggcucacugcaaccuccgccucuuggguucaagcgauucuccugccucagccuccugaguagcugggauuacaggcauccaccaccacacccagcuaauuuuguauuuuuaguagagaugggguuucuccguguuguucaggcuggucucaaacucccaaccucaggugauccacccgccucagccucccaaagugcugggauuacaggugugggccaccgugcuuggccauuaugauuuucuuaauaacauuuucuuuuguguagcuuacuguaagauuacaauauauaauauacauaacauacaaaauaugugguagucgauuguuuauguuauggguaagguuuccagucaacgguaggcuauuagugguuaaaauuuuggggaguccaauguuauaugcagauuuuugacugugcaggacauagcccuaaccccugcauuguccaagggucaacuguauauauauacacacacacacauauauauauguguguguguguauauguguguguguguguaaauauauauguauauauacauacauauaugcuuguguguaugaaaacaaggugauaaucauaugauauauaugguuauaaucaucuuugcaaaauggggcuuuuuuuuuuuccuggaauggcuagaauaaaauuuuauuucauuuauuuuauuuuuauuuuauuaaaauaauuuucuggguauacaauagguauauauacuuauggggguacaugagauguuuugaugcaggcaugcaaugugaaauaagcacaucauggagaauggggaauccauccccucaaguauuuauccuuuguguuacaaacaauccaaucacacucuuucaguuaucuuaaaauguacaauucagucauuauugacuauagucacucuguugugcuaucaaauaguaggucuuauucauucuuucuauuuuuuucuacucauuaaccaugccccccucccccuagaaugaaauuuuaaguucaccauugaggauacuuagaauuuaaaauaauucuaauguguucugaauaagccaugaccaaaucugcauauacauggcuuugaaaauaauuaauuuuuaagguauuuuuuucuccucuuucuagauugugagguaaauuuuaaaaaaauucuguacagaaauggaauuuaacuugguuauugguaauuaggccaauagagaccauguuuccuuuggaagccuaaauuaucuacagggauuaugaagaucaaaugaauccaaguuuauuuuuaagguaaauaaaucauuuuaaaaaaaugaaagccaggcauccauuuugcauugugaggaguucuuggggcucagaaaauacuccuccaaaaauauggcucuuuggcaugcuuugaauuaaaggaaauuaaaggcaucagaaauaagccucagaaccaaggucucuccaguguucccucccaagccccacucugaucucuuuucuuuccugaagcauugggagcuacucuugcuggaauuuuauuuuuuguuuuuuuagagacagggucuuucucugucacccaggcuggagugcaguugagcgaucauagcucacugcagccucucuaccucccuggcuuaagcaauucuucccaccucagccuccugagaaccugggaccacaggcaugcacuacaaugcccaacuaauuuuuuuuuuuuuuuuuuuuuuuuguagagacagggucucccuauguuggccaggguggucuugaacuccugggcucaagcaauccucccgccucagccucccaaagugcugggauuacaggugugagccacuguaccagaaccggaauuuccuuaucugacuaggaaaacccuuuaaaaggaaaugcaauugucuuaagaccuccucccuaggaaucucaucaaacaaccaggaaagauuaaccacuggagaagaggagacacugggagucuccacugcacccagaaagacuuuucaucuauucuucucaagacagcuccaagagauuaccugggaggcuuuaucugcauaauaagauaaccuuugauuacagugaagcucaaccacucaccuucccuccaccuguccuagagcucagaggaacuuugucccagaccaccgugcuuugggcuuauucauuuccccuguaagucauuuaucccuacacuccucaucaacccugucccugugaagaaggguauacaaauaagugucaggaccucacuggauuauugggucauucuccuccugugauuccccugucccuaagcauguuaauuaccuucucuauguccuuuccuccuauuaaucccccucuugucauuuacucauuuucagcuaaccuuuagagggugaagggggagcuucccauuugccucuacagauucaacaugcuucuuuguaaaucuagagacccagacggacugagaauaucccacuguggccuuggcuuguccuggucucacagcuauuccuucucacguacucuucugcuugacuucagcgacuauuucucgccaagaaaaugcaaaucgcucaugugagggcagcugaucaacagcacaauuccacccucuuuggagaaccauccucgaccaacuauuccugaaacuagcugaaauuuggacccacuucugcuaaaguuuuguguaaaaccuucugucaugcuuauguuagugguacucugguuuauuuucuuccauauaaaccaagcuaucugguuuauuuugggggaauaucuugguauuuaacuuccugcuuauucuuggucugcagucuaccccaugucauugucccuuggguuuucacuuauacacuuggcuuucuguccaugauuuaaguaaacaaaaaaaaaguaaacauggcagcacaauguuaauaggcaugucuaccugcugcucucccaagcccagccuuuucacacugaagucaugcuaggagcuagauguguuugucuugcuguauuuugaagaaaguggccuuccuuagaagaagucaagaaugaaguuuccagaccucaguugcuacguguuuggguaguguauuucaggggugaauuaagaaaaguggggagaccagccugaccaacauggugaaaccccaucucuacuaaaaauacaaaaaucagccgagcaugguggcgcgcaucuguaaucccagcuacuuaggaggcugaggcaggagaauagcuugaaccugggaggcggagguugccaugagccgagauggcaccaccgcacuccagccuggggcgacagaguaagacucugucucaaaaaaaaaaaaaaaagaaaaagaaaaaaaaagaaaagaaaagagaaguaaguggggaaugcgaagaaugguuuccagggagugcaaccaaggcaccuaggugaaagaagucaauaaaauuauuuuauuuuauuuuauuuuaccaucuucuggagucugagcauguuugugauuaguuauauauauauauauauaaaggcuuuuguuugcuugcuuuuccugauaacagacuaugccugacugcccuucgagguguuguaggcaugaugacaggguuacauaaauaacucauuucucuuuuuuguuguucucaugauaaucagcacauuuccuucuacugucccaaauaaaaagcuuuuugagucuucaaccauauacuugauccuuuuaaaucacaaauuuacuuugcuuuaccgcuuuccugcuucguacugcaaaugauggauaauucagauacgaauauacaaagaugaaaaauuauugcauuuuagacuugaaaagauccgggaaacuuaauuaacucucuuuuuucuuuucuucuuaauuauuccaaauugauuuuaaaaaaaucacaucuuccucuauuauuuccuagaaguuuaaauuuuauguuaaaauuauaucaauauuuauacccaucacauuucauagauugaaaucauucaguugcaaauaauauaaaauuuuuguaaaauauuugcuaugaucuuaucaaaagaaagaguaguaaaaccauuacaaaacacuuuccuagaagacauaauuuuucuccaauugauuuguuuagcaauuuggauauaauucuauacaggcaauugaagcuaugcaaugcagaaaaaauauuaugcauccaccuuaauauauuuuuuucuguguauuucaagaaacugugccugggagcaucaaaccuuaaauuauucuguaauuggcaggcagcaaauagcaauuucuaguucuaagcagugccaagcccaaacagaagauuuuuauaauggcugugccuaaaaaaaguguagcuagaaggauuaucuacaaagugagguauaaacauaacucagccaacauuggggagagaaaggaggaaaaauaauuuguuauugucaaaguauuucacuuuguaaaauagcuguguauccaucccuacaacccuuuaaguguucuggccuauuacaaauaauuacuuggaauggaugcuuaaggaaaauuccaagcacauuuaaaacaauggcagacuagaaaaguaauuaccgauuuuaauuuuccccauuauguauaacaguugacuguaaaaauacuggcgaaacagacacacuugucaauuucccucagcuuguaaacaugggcauaugucucuuaacauuauuuucuuuucaguuaggauuuuuaaaaaaucuugcccacaauacaggcagauggucuugugagaagcaggaaaugcugccuccuuugugugcuaccauuuucacucccuuugaauuguuuuaaaauaauauuucuccuuacugcaucuugaacaucuugggacaucaggagucaauguggaguaaccaugcuauuuauguuuuaaaagacgguauuuauuuaacaugaauguacauggcuuggacagaacagauaugggcaguagaaaaacacguaauacuuuuauauuaauauuuguuaaaaauaaaguucuuaugcugaucugauuuucuaaauuguaggaagaauaaaaaaugagacaccaguaggcuagaucuuccauugaauagaagaucgauuagcaucuagaaaugaaagguaggacuucuacaaauuaugcugcauggagauugauagacugggaaacuuccccauugaggauggcaucauuucagaaaagcauucauuugaaccacucauaauguguuuguugauauacugggguacaguugaacgauggagaugcuagcuagaguaccuuccacuuauugaacugcuggggagagacuucuguugguguaugugucacaugucuauucuuggugauuuuuguucaauauuaugagcaaggacuuguaagaguaagcagacucaugaaauuuucagaugaaccaaacuuagaggcuuuuuuuuuuuuuuuuuuuuuuuuuuuuuuuugagacggggucucacuuuguugcucaggcuggagugcagugagugacauuaucucagcucacugcaaccucugucuccugggcgauucuccuggcucagccucccaaguaguugggauuacaagccugugccaccacgcccagauaauguuucuauuuuuaguagagacggggcuucaccauguuggccaggcuggucuugaacuccuggccucuagugaucugcccaccucagcuucccaaaguacugggauuuacaagcgugagcgacuucgcccggcccagauuuagagguuuuuauacagcuuucagagugagauuaauaugcuuuaaauagauuagaauaauaaaaacaacaccacauaauacaauaggauuaagugaaaaaaauuguugguuuaaauucaagguauagaauagagauuuauaacuggacaucauuucauguaaaaaucauuagaaaacuuuacacaaaaaugccgugugugccaacaguaaaauaaauaaaguuacaugaaaaguuaaucuaccaucagcaaguuuugaagcaucugguuguccaaaguaaagugagauagguauuguccuacuguauuuacagcccuuugugaacugaacugcucuauauacuucugguugccauaagaaaggcauugauaaauaugacaaaauucaggggaagguaggguuccaggagaacugcuguuggaagcggggauuuuuuuuuuuuugagauggagucucgcuuugucgcccaggcuggugugcaguggccugaucucagcucacugcaagcuccgccucccggguucaugccauucuccugccucagccucccgaguagcugggacuacaggcacccgccaccacacccagauaaguuuuuuuauuuuuaguagaaaugggguuucaccguguuagccaggauggucucgaucuccugaccucgugauccgcccaccucggccucccaaagugcugggauuacgggcgugagccacugcgccuggccaguaagacacaguggucuugauagcagucuucacauacuugaaggcugggaaauaagaaguauaugcuuucuguauuuuuuccuacacaggacaguaguaggauuauuagaucuaaauuuuagggugacaauugugacucuaaggaaauaugaagccucuaaaauauugagcagugcuauucacugcugcacgagauacugagauaccaaaauaggauucuagaguaguugacuggaauaucaugaacaggcuuccuacgaauauuaaaaaaucaggugggaugaucucaauuuauguuuaaguuuuuacaauuccuccucuuagguaaacuguuuuaaaaguuaucagaaaacauuuauccauuuuguuuguuuuugauuugcuguaggaugaaaggcuuacuucuacaacgaacuuaacuauuucaauguuuuuuaaguuaccaaugucacuaggaaauugaucagcauuggcagcuacugacaugcugcugauucaguuagccuaggaaacagguggguuaagagaucagauuuccguauggggcaagugcaucaauuacugcugccauuguuguauuggaucuugaaccucuagcaccacuuuucuagaccugaugugagcccugccaaacacuaaggacauaaagaaccucagaaauagcagugaggucuugcaucagguugaagagaaaaacugaugccacauaaaauaaacgugucuuaaaagccaguaagucauaaugagguacuaaccuggacagccaacauucaguaaagucaguuauuagguucuuagguagacauggccacaugaucaaagaacguacacacuuuaaauaugucgguauagcuggcucugacuguaaauaugugcaauaauccagcguaaucauuuaaauccuaaaacuguauucacccaggaaagagugacgguuuuaaaagcaguaacaacugagcaagaaaugguacugccuuuaaaugucccuuguuuauggggacauucaaucacagcuuaucauuuuagaguaauuacugaaucuuaaugugucacauuuggacucauuaaaaacacaacuaauuacauuuuaauucuguaaccaaaauagaagcaaaccuggcaauugagcgaguaagaacucuggaagagaaucgacauguuuguguacccacugccauucacagagugauuuguuuauaaagacacagagcuauuuucugucugcaaagcucuccagggagaagcagugaggucacuuggcggugacaacuuuuuuugugagugcucucuagaaguugguguguguguuaccaauauuauuuuagggcuggcaggagaggaaggagaccuauuuccagaaaagcuacugggaauccuaguaugaggcagauucuauaaugucgagccuuuacuaagggugugaacuauccccacccucggcugccauuuuguuuacuuuguaaauucuacacacgcaauuccuagcuuauaauuaagucauggccccaaaugccuuccagggucucucucuuacaccccugagaugccucauccuaaugucuuccucaaauucuccuuccagucuccggggcacagugcuucuuugggaaacccuuuugcuucagucccucauguuggagcuacucucagcgccagacuguggccacaucagagcacaucagaaaguacguguauaguuucuugccagaauauuguugggauaauuccggcuauuaauaccuccaaaccaacuccagcaaggauaaauuacucuuugacaacagaaauguaagcuagcuuaugaguuucucuuuuuauacuaguugcuucaaauauuacgauugaaacuauuguuuggacuuacaguuaaauaguauggugauuuguuugaugggguuuucuaaaagauuuucuuggaccgguuaugauggcuuaugccuuguaauuccagcacuuuuggugcccgaggugggaggaucgcuugagcccaggaauucuagaccaaccauccugggcaacagggagaucuugucucuacauaaaauuuaaaaaauuagccaggugugauggcgcuugucuguggucccagcuacucaggaggcugaggugggagaaucccuugagcccagaagguuaaggcugcagagaguuguguucacgccacugcacucaaagccagggcaucagaguuagacugugucucaaaaauaaauaaauaaauaaauaauuaaaaaagaaauaaugaaagaaucucuuuuauguguagaaacucaugcucagugaaguuggguuugaagauuguauugaucguauuguaucuaccauugcucuguaaguuuuacucugcuuuuuauuuuuuccuccuguggcgauaaagucggaccgcuaccuauauugguaaguuaggguguaaaauugcuucuaaagccauuuuuuuuuuuuuuuuuuuuuaaagagacagggucuugcuaugguauccagacuggagugcaguggcuauucacagguggaacccacugccgaucagaauggaaauuuugaccugcuccguuucucacuuggcuugguucaccccuccuuaggcaaacugaugauucccgcucccaggaauuaaccauauugacgccaaacuuagugcgacuacccuaucagcacagugcacuaccacgcagaacuccugggcucaaaacaaugcuccugccucaguguccaaaguagcugugaccccaggcacccgccaccaugcuuggcucuaaaguaauuuuaaagucacagauuuucuuuguuuugaaacaauugcauggaaaagcaaaauuuauagcuucgaaggacacuaauggcaacucagguuaaacugaacaacucucagacccaaguggggaaaaaaggaaacuuuuuguaugggggauuuauuuaccuuucuuuacaaaucugcuggggggugugugugugagagagagagagagagaaagagagauuggaaauggacacuugccuuuucuuuugaucagaauauaaugauacuuagcuccuuucgucauucuugacaaugcauuuaaaggccuccuuuuuauguguugaguuucccugcuagaacuacaggcuugugaccauaaaauucuacaugaggccaggcgugguggcucacgccuguaaucccagcacuuugggaggcagagaugggugggucacaaggucaggaauucgagaccagcuuggccaacauggugaaaccccaucucuacuaaaaauacaaaaauuagccaggugugguggcaggugccucuaaucccagcuacucaggaggcugaggcagaagaaucgcuugaacccgggaggcagagguugcagugagcugagaucgugccacugcacuccagccugggccacagccugucucaaaaaaaauaaaauuaaaaaaaaaaauccuacaugaauagucacuaauggguucaggcagauuuccugauuuuucuucuuaccucauagauuuaaaauguauggcuuuuuaguuaaaugugaguaaaauacuaucagcuucccucuucccuauuuuuuagguuucugguacauauuuaauuauaugauuauaguuuaugcgaacaucuuuuuaucaacugucaaaauuguauguuuuaugugauggagagugagucaucguacauacaucuagccaauaaacuuaucaaagauaagugaacccuugagcuagggaaaugggcacaggaaaugaugaaaucuaauauugaaaaauauuaaaaucuaauauuaaaaaaucuaauauugaaagcugugaauaaaaguugagauucauaggcauuuaucuuggcuccagaaggacucugugaugaguagccuuaagccuccaguugggcuaggugugggaucagucaagaucucacaccugagagucaacacucucaugucucuuuuuaacaggaaaacuagaaaaauacaauagccucaggucauuaguguuuggugaaagugaauacagcccuggaauuugagcagauucacaugagaccuacuuuuucaaaggaguauguguacuuuauaaauuguaccaguuuaguuacuuaaaaaaaauccugcuuuacuuaauuuacgugguuugccuuuuguuacccagauaucauaaagguauuaucuucauauuccuguaauauauuuaaaguuuuguuuuuuaauauauuuaaauguucuuuucauugagauccaauaucucccugaauuuuuuguuuguuucaggagggaaagcuauuuuacuuuuucaaauauugaaauucaauuaaugcaacaucauuuauuuuccuuuuuucauuaauucuucguguuuccucuauaauauuccaaguucuuuuauguaugggucagugucuagucucuuuaucauaauccauccaauugguccuaguauugugugcuuuaaauacuguagcuuaguguauaguaggucuuaguauuuaaugggaaaauauuuuccuccauuucuuucccuuuuuauaugcauauuuuuacgagugcugagaguugacccaaauuuuagaaaaggacuucuauugcaggaagaaaaaauuauuagaccagcucacaguucuuaucucuacgcagugaaugguguuguggaaauaaaaugaaauucgagucagacauggggucaaaaucuagcugccaauuuaaagcuauaagaugaauaaaaauaguuacuccugcugaaagucauuucccccaccugagaaauaggaacaauauccuaacuuuugaggacugccccugagaauuaaccaugguuaagauagaaggcaccuagcauaguaggcauuuguucaaugguagcuacuauuaucaucgucaucaucauuaagauuauauaguaugaucuaaagagcaauuugagucuccaauucaaaaugcuucuuauuauaugauuauuucugaaauaaucucuaaguccugaaaaaaaucuaggaagucauuaauaucucaaagggguuucgaaaaugagagaaagauugcuuuuuaguaucauccagggaauugugagugacacgcaggaguuguugcuuucauucaguggacucaggcaggaucugaaacauggggguggagucugcuccaggaacuaugacucaggcaggagagagagugcccaugccgcauggagagagaauaagaauguggguuacccgcaggaaagggcaccaagagacagaacuaagguaccagaauguauagucugaggguucagaugagcaguauccuuaguagacaugcacccugcagcugugccucauugauaugauuugugucccauagguauauuggucacuaacugggaucugagugccuauugcccaguauugggcaaaccaugggcaaccacuguauuuuggaauguguuaugaugguugaauguauuuaggugggaagcugggaaaggcaauuuaaagaucuuugugagaaaacaugaaggauauggaaauuuguuggucaaacuuaacaacaaauaaauucuaaaaguagcugaucacaagauucacaaacugaccaaucugguucuguccucucacuuuucccacaacccagccaagacugacuggccuaucaugucuuccuccucuuaagucaagcagugaaggauccaaaaauaaagucccggagcaccaucagguagaagggaaucguggugguggugguggugguggugagggggugagggucucuugaccaccagagaaaauacugguagagacugaggcugaccuugcuccauaauuggaugucuccuguccugcagcaauggggugcaacauuacugauggcugccagagcuuguucuaacucauucacuuuucuuuauuuuguaucaagggagcacagaaaccugcagaacuuuauuuaugaguccaagggcacaaagagacgguaacaggaugucaccauugugcuuucuauuuugagcacucugucccuaaaauugguguuugagugucaagcaugcuuaauuuaauagacucaugcugcuuaucaaggugagugggggugcagcauuguuuuuaguuguuuauucucuuucaaggagauagaguugaagaaagaggagaaaaaggagaaacacauuuauuauacccucaaaaugagggaggggagggauaaaugaauacauguagucauuucauaguugaaugaagcaaaaccaacuccagaagacccucucaauggcacccuuuaucauucuguguugaacuguuuauucucuuuuacauucauauuccagguugcuagauacaaaaauacucuccuuucuaauauauuuccucuuuuauaaccaguuuuucucugucuucagauuaagucauacugaagugaccacuucuagcaauauucacucacucuugauaauaggucaagauccacuggaucaaaauaagugagugcaaaaaaaaaaaaauaaaauaaaugucguguacaguauacacaacccuggcaaagagauuagaucuguguacucagaucagugaucuaaaaucaugugucuuuuaauuuuauuuugcuuucccaaaaaagacuugcuuuuaauguaaguugcuaauauagagguucucauguuuagcuuagugcaauuauuuuuaaaaaccaacauauauauuuuaaagaguacaagauagguguaguuauuuuauuuguuugcuuuuuuuucuuaucauccaaacaggcacacuuuuaaguugagcuuuuacaugaaagcauguucaaguuaaacaugagaguuuuaugaaaugaggacugaauauaagaguuuauagcaagcauuauguugcaucucuuaaaauagcuugacauucugcaugcuacaaugcauacauuauuuccagauaaacauauuugcacugaggaagaaaauaaugaaguggagagaguaaacauauaguuguuuuuaagcacuuuugaauaaaggcaguauaguuaauuuuuuugcuaucauauaaaugaaagauaauauuguuccaagauaaagcucaccuuucaguccuaaauuacaugaccagaauuaaaggggcagagcauuaaaaaauuuacuagauauuuguaauaguucaaaaagugacuaaaauauauaagaacauaauuuaaucuauaaccuugaaucauacuuuaaaauucauucucucagcccuacuuuaacauaaucuuguaaacaauuucaguuauaaaauuucaauucacaacugaccaaaaagguggcauaaaauucaauuuugaguugaugcaaauaaauacaguauauuaaacucagcuucaguaauuuuuaaagaaagauuuacucggcugggcgcaguggcucacgccuguaaucccagcacuucgggaggcugaggcgggcagaucaugaggucaagagaucaagaccauucuggccaacauggugaaaccccgucucuacuaaaaaugcaaaaauuagccagguguggugacgugugccuguaaucccagcuacucuggaggcugaggcaggagagucgcuugaccccgggaggcacagauugcagugagccgagaucgcaccacugcacugcagccuggcgacagaaugagacuccaccucaaaaaaaaagaaagaaagauuuacucaaaccuuuuaaauuaaaaaaaaaaacaaaaaacuuugcauuagauuacuuuucaauguaauuucuaaacuguaugaccaaaggacguaucuaaaacucuacaaaaguuaacuuuaaaauucauuaauuaaauuaguuauucaaaaagucucuguacucaucuuauaaauuuaaacguagcacaagagggaacuaagaguuggcaaauaaacuguaauagacuggauaaguuaaaaaucuguauguauuuuuaucagucaaguauuugggaaaaggguacuacacauauugugaauaggauguaaaacaaguuuuucauuuuuggaucucuguauaugaguuaucuacaagaaccuguuauauucauuuaaagucucugagacuuauaucccugucauuuugugguuauguaggguuacuuugauccaaguucaagauuucagugcuggugaucauguuuguaauuuccucagaucucuuagguaaaacaccuugaaguauaggcucucagauucuuucuaguuuuuuguuugucuauuuugauuucuauuucuauuugaucugguuuugcuguguccccacccacaucucaucuugaauucccauauguugugggagggacuuggugggcaguaauucaaucaugggggcaggucuuucccaugcuguucucaugauagugaauaagucuaaugagauuugaugguauuaaaaggaggaguuccccugcacaaguucucucucuuugccugcugccauccaaguaagacuugacuugcucuuccuugccuucugccaugacugugaggcuucccaagccacuuggaacuguaagcccaauuaaaccucuuucuuuuuuaaauuacccagucuuggguauaucuuuaucagcagugugaaaaaggacuaauacucuaacuguaguaugaacagguaacaugagaucuacucucucaaauuuuuaaguguacaguauuguuaaccguaagcacuacguuguauacccaucuugcaugacuaaaacuuuauacccauugaauagcaaguccccguauuccccucuugccagccccuggcaaccagcauucuacucuuugcuucuaugaguuugauuauuguugauaccucacauaaauggaaucaugcaguauuugccuucugugguugacuuauuucacuuagcauaauguucucaagauucaucuauauugucacuuauggcaggacuccuuuuucuuuuucuuucuuuuuguuuuuugagauagagucucacucuguugcccaggcuggagugcaauggugcgaucuuggcucacugcaaccucugccuccuggauucaaucgauucucccaccucagccucuccaguagcugggauuacaggcacccaccaccaugccugguuaauuuuguauuuuaguagagacaggguuuuaccauguuggucaggcuggucccgaacaccugaccucaagugaucugccugccuuggccucccaaagugcugggauuacaggugugagccaccacgcccagccaggacuuccuuuuucuuaaggcugaaugauauucuguuauaucuaucuaucuaucuaucuaucuaucuaucuaucuaucuaucuaucucacauuuucuguauccauucauauauacauauauaccauauuuucuguauccauucaucuuuugauagacauuuagguuauuuccacaucuuggcuacugugaauauugcugcagugaacaugggguccauauaucucuuuaagauucuaauuuuaauuuugggggaguaaauggccagaaguggacuuauuaaaucauauggcaacucuacuuuuaauuuuuuugagaacauucuauacaguuuuccauacauauauauacacagcugcaccauuuuuuauuuucaccaacaauguacaaggguuccaauuucuccacagccuuaauaacaccaaguaacuuuuuuuuuuaaaacaauagccauccagccugggagacagagcaagauucugucucaaaacaaacaaacaaacaaacaaacaaacaaacaaacaaacccccucaaauaaaaaccaauagccacccuaagaggugugagauaucucauuaugguuuucauucucauuucccuaugauuagugauguugaacaaucuuuuuauguaucuauugcccaguuguauaucuucuuuggauaaaugucuauucaaauuuuuuacucauuuaaaaaucaguuuguuugcuuuuuuacucuuaaguuggaggaguuccuuauauauuuuggaaauuaaugccuuaucagauaugugguuugcaaauauuuugucucauucuacagguugccuuuucacuguauugauuguuccuuugcuguacagaaguuuuuuaguuugacauaguauaccucuugcucuguuuuugcuuuuguuguuugugcuuuuggugucauauccaagaaaucauugcaaagaccaaugucaugaagauuuuccccuacguuuucuucuaaggauuuacaguuucaggucuuacguuuaagucuuuaauuaauuuugaguugauuuuuauguaugguguacaguaaggguuuaauuuuguucuuuuuguauguggauauacaaugccccaacacuauuuauugaagaaaucauccucuccccauugucuguucuuggcaucucuauugaagaucaguuggucauauaugcacagguuuauuucugggcccucuuuccacuggucuauaaagcugucuuuaugacaguaccuuaguguuuuaauuacugaagcuucagaauauauuuugaaaucaagaagugugaugccuccagcuuuguucuuuuucucaagauuguuuuagcuauuugggauccuuuguguuuccauaugaguuuuggaauuguuuuuucuauuucuguaaaaaaugcuggggcgggcacaguggcucaugccuguaaguuucgcaguuuggaaggccaagguggguggaucacuugagcccaggaguuugagaucagccugggcaauauagugagaccucaucucuacaaacaauaaaaaaauuagcugggccugguagcaugcaccuguaguuccaguuacuugugaggcugaggcaggaggaucgccugagcacgggaggcggagguugcagugagcugagaucgcaccacugcacuccagccugggugauauaaugagacccugucucaaaauaaauaaauaaauaaauaaaauaaaauaaagaaaaaagaauguuauuggaauuuugauagggauugcauugaaacucuaaauuccuuuggguaguauggacauuuuaaugauauuaaguuuuccugucauaaacgugggacgucuuuccacuuauuuucaucuuuaauuuuuuucaucaauguuucauaguuuucagcauacaagucuuucaccuucuuaaguuuauuccuaggcauucuggcaauguagugcagcacauuaauugauuuauuuauguugaaacauccuucuuccuaccugguugugguguaugaucuuuuugauaugcuguugaauuugguuugcuaguauuuuauuaaggaauuuugcaucuauguucagcagggauauuggccuguaguauucuuuucuuguaauauucuugucuggcuuuggugucagggaaaugcuggccuuauaaaaugaguuugaaaguauccccuuuucuuuaauuuuuuggaagaucuugacaaggauuagcauaaguucuuuaaauuuuugguggaauucagcauugaagccaucagguuguaaugucuccuuuuccauuuuuuauuuuauuuauuugaguuuuuuucucuuuuuuuuuuaguuugucaauuuuguuuaucuuuuuagaaaauauuucuucaaguuuuucuauuuuuuuuuuacucuguuuauuucugcucuaaucuacauuauuucuuccuucugcuaacuuugggcuaaguuuguuuuccuuuuucuaguuucuugagguauguuagguuguugauuugcguucuucuuuucuuaugcagcuguuuauuacuauacauuucucuuucaaaauugcuuuugcuguauugcauucauuuugguauguuguguuuucauuuuuauuugucgugagacauuuucuaauuucccuuuugauuuauuuauuugaccuauucauuguucaagaguauuucauuuaauuuucauacauuuguaaauguuucaguuuucuuucuguuauuuauuuuugauuucauuccauugugaucagaaaagauaccugguaugauuuuaaucuuagguuuauugaaacuuguuuugugacguaacaugagaucuauccuggagaauguucuguguguguuugagaaggaugugaauucugucacuguugggugggauguucuguguauguccguuagguccacuuggucuauaguuucuuauugauuugucugucugaaugucuaucugcuauuuagugggauaugcaagucuucuaauauuguauuucuuucuucaguuccaucaguguuugcuucauauauuuagagguacugaugcugggugcauauaaaauuguuacaucuuggugaauuagccuuccuucugcugauauuauuauuauauaguguccuuuuuugucucuuaugacaguuuuugacuuaaaaucuauucuaaguauagccacuccugcucucuuuugguugccauuugcauagauuaucauuuguucauccuaucacauucagccuaugugugucuuuaaacuuaaagugagucuccuguagacaguauuuaauuggaucuuuugucguuguuguuuucaaauccauucagucacucugucuuuugauuggggagucuagucuauuuucauuuaagguaauuauugacuuacuauugccauuuuguuaaccuuuuuuguuuguuuguuugucuuguauuuauuuugucccauuucuccuuuccuguuuuuuuuucuuucuguuuuucuuuuguaugugcucuauacagggguucccaacucccaggcuauggaccgguaccagucuguggccuguuaggaaccaggccaugcagcaggaggugaggcgggcgagugagcauucccgccugagcuccgccucuugucagaucagugacggcauuagauucucauggaagcuugagccccauugugaacugcgugugcaagggaucuagguugugugcuccuuaugagacucuaacuaaugccugaugaucugagguggaacaguuuuguccccaaaccaucccccaccaacccugguccauagaaaaauugucuuccauaaaacugucccuuggugcuaaaaaggcuggggaacacugcucuguauguauuuucuuugugguuacaaugggcuuaccuaaaaguagguacugagauuaaaaaauuugaaauaggguggcuuuacuuuuuggcaaaauacaggcauuuuggauauuuauaaaauuuaauacuuacaggaugaauucuaguauacuauuugcaaaaaccagaaguuaguagauaauggauuagucuaucucuaaauggcuggaccuguauaacacuuuguauuuugaaacuguaccuuucauaucuuuaaauauuguuuaaaucacauuauuucauaauaauguuauuauuuugugauacugauaguaaaaccugaguuuguaggauauucuuuucugaaaaagaggcagcguuagaugguaucuacacagcuguguucuuguugaagcauugggaggaguccuucuccucaccuccauguuacaugcugucccuauaguguccaauuagucuuuaaauauuuaugugaauaauaucucuucuaucccuuucuaaaauucuguguagcugaacuucaaaugcagcucauacuggucaucacaauuugacugcucuaucuugccucuauggacacacaugaucaauaagagcagaacucaauacauaaacagaucacauauaaagauuuaaagguuuuuuuuuuuuuuuuuuuuuuuuuuugggauggaguuucguucuuguugccccggcuggagugcaacggcgcagucucggcucacugcaaccucugccuccuggguucaagcgauucuccugccucagccuccugaguagcugggauuacaggugugugccaccacacccagcuaauuuuguauuuuuuuaguagagacgggguuucuccauguuggucaggcugaucucaaacucucgaccucaggugaucugcccccuucagccucucaaaguccugggauuacaggcgugagccaccgcacccggccgauuuaaagguuuuauaaaaaacucuguggaacauuuuauagaagacacauuauaagaugugguuuuuaggacucucccaaaacccacuacauagucagguagagcaguuccaagugugagaguaacugaccgccucuuagaauguugcugacaucaggaaacacgaccuacauuuauauuaggcuaccaaaaacauaacuuccuuugcacugacucuagccuauagauuguuuucugacauuuuuacccauagccaagagucuccuaauacuuuucaccaagacaauucaucgcuuuaaaguuuucuucuaaugagaaaaaauaaauaaauaagcuacucaugaguagcaguaaaaccuaacacuucugauuauguuacaugcauuuuacacauaauuucauauaaucuauauuauagcuuugugaaggagguacuauuacuuacacuagcaucuucuuucucauccucgcccugcuguucaccaucccucacuuugagaaauugagguuuaaagagguuauauaauuuucccaaguauauuaggagugucuguucucaugcugcuaauuacccgagacuggguaauuuauaaagaaaaagagguuuaauggguucacaguuucacauggcuagggaggccucacaaucacgguggaaggugaaaggcacaucuuacaugguggcaggcaagauagaaugagagccaagcaaaaggggaaaccacuuauaaaaccaucagaucuugugaaacuuauucacugccaugaggacaguaugggaaaaacugccccauaauucaaugaucucccaccaggucccucccaccacaugugggaauuauggaagcuacaauucaagaugagauuugaguggggacacagccaaaccauaucaccaagacugcauauuuaauugauaaucgguagguaguccugggacucuaacuuaggagaucccagagucaaggucucggccauugcacuaauuuccuuuuaaggaauuucccaaucuagucaaauuggugguuuucuaacuugucugagaaaaaagucacccagggaauaucaguaguuauuucugaauugagaaagaacuuuucuguauuuauuuuaaaauuucaaaguuuauugaucaaguauaguuaaucuuauggcaugaaauucugaagauauugcauaugucucaaggaacaacuugguuuuagaaauuuauuuuaagcaaaugaagauauuggucaauuuacuagccuaugccuaccaauucuuuuuaaaaaaauuuuugugaacacauaguagauguauauauuuacggaguacaucaguuaucuugacaauccauuugaaacuaaaaguguuugacuuauucuacaauauuuaaaauaauauuuauuucauuuuuacaacucuuagguuaaauuaaacuuuaaaaagaacccuauuuagcuacuaauacugaaaguauuucaaugaaucuaaucagaccaucagaguuuuucucaauauggcauaaguggcgacugucaucuacucagguugaauaugauaaggcagagguguggcuggcaggcuuaugauaguuugggggaacagaacauuuuucaucuuuuuucuugaaaaaguuauccuuagaccauucuaaaaaaauuaucuuuaucauucuacaacuaaauagaauaaaugcauauuuaucuuugaaggaguuucuucuacucuguaauauacgcaauuguuuuauugucauauuguagcaaauauuaaaaauuuguggugauuaugcaggagcugacuuuggaagugaaugucaauuuaaacauguuucucuggcauuuauuaguaauuaauuugauuuuauucuuuguaacuaacuaugcaauuauaaauaauuuaaauuagagaggaaauauauucuguagacaucuccacaucaucagaacuauguuuaaauaugucaaucugucuuaagaguaaaauaacuccauuguauuaucaccugaauucacaugaagaaguguuuaaaaacgcucuuuguuuuuuucauguagauuuauccugugccuucaguucuucuauuuuccuuuauaaaaucuuuuuuacuuucccguuugacauuuaucuuacguguuuauaagauaaacuuugguucaaagguuauauaacgagacuucaugaacuguaaucuguauaccagucaauccaacuuuaauuuuaauuuuaauuuggagaggauggaauuacauguagaucacagugacuuaauguguucaacaaguaaaaagauguugacuuuaauuuucuuugaauuuugacuauuaguauugaacaaacucaagaaaguguaugugaagguauuaaaagcauaaaucaaacaucagguaaacuuugacaguuuuauagaauguaccuucccauuuuauuauggaagaaaaggacauuuucaucauacuucuauuauaaauucacuaaauuuuuaaaguccuaaucucugaaaucugguuuuaaugcuguguuucaugaagcacuggaggcuucauguaagucuccaagguccaucauggaggaugaggcguggggagagguguggaguuguuggaacuccuaaucucuuuuucccuuugcccagacaugcuccauuuuaauaucucuucauacuagacuuucaaauaagacuccauuugaagaagguauaaucagcucaaauaucauuuacaucugauuuaaacaaacuccaaguagagcguaauuaaauauauuuguuuucacagugucagcaucccuaaauucuucuacauacuauuuaacauuuuuuaucacuaaaauaaaauuagcucaaccugaaagggcuauauccuuuaugauuucaacuauaggacauucuggacaaaguaaaacuaugaaaacaguaagaagaucaguuguugccaggaguugaggggaggggaggauugaauggagggaauacagagaauaguuuucagcagugaaacuauuuugugugaugcucuaaugauagcugcauuucauuauacauuuguuaaaauccacagaauggccgggcgugguggcucacgccuguaaucccagcacuuugggaggccgaggcggguggaucacgaggucaggagaucgagacuauccuggcuaacauggugaaaccccaacucuacuaaaaauacaaaaaauuagccgaguggcgggcgccuguagucccagcuacucgggaggcugaggcaagagaauggcaugaaccugggaggcagagcuugcagugagccaagaucacgccacugcacuucaaccugggcgacagagcgagacuccgucucaaaaaaaaaauuaaaaaauaaaaaauccacagaauguacaacagcaaguguaaacccaauguaaaugauggacuuuggaugauaaugugucaauguagguucaugaguauaacaaauauacuacccuguguugaaugaucaugggggaaagcugugugugugugugugugugugugugugugugugugugugcgcgcgcgcuuguguguguuugucugcauuauauguguaggggguaggggguacuuugcugugaaccuaaaacugcuccuucuuuccuuccuuccuuccuuccuuccuuccuuccuuccuuccuuccuuccuuccuucucucucucucucucucucuucucucuuucucucuuucugauggagucucgcucugucgcccaggcugcagugccguggcaugaucuuggcucacugcaaccucugccucccagauucaaacaauucuccugccucagccuccugaguagcugggacuacaggcucgugccucuaagccuggcuaaauuuuuuuguauuuuuuguagagacgggauuucaucguguuagccaggauggucuugaucuccugaccucaugauccgcccgccuaggccucccaaagugcugggauuacaggugugcgccaccacaccuugccacauucucuuucuuucugacuugagagguguggaugacucucccucugucuacucuauguacagcuuggcucucauacucugcacaaggacagucuaagacugggcuuacaucuuucaccuuucuccaugccuccuucucuguuccaucuucccggcuuacuuucaguucucuuaaccaucacacucauuccccuuuucucuacaggagguggaguaucauggcugcagcaucagauugccucccguucacuccuuaugaaugguguggucuugugcagguuaauuauccucucuaagccucgguuucuuuauuuacagaguuggaaaaguaauuguaccuauuuuauagguuuuugugaagauuacauaaggaaaugcagauaaagugcuuagugugggcuugcaugguggcugacaccugcaaucccagcauuuugggaagccaaggcaggcgaaucaccugaggucaggaguucgagaccagccugaccaacauggagaaacccugucucuacuaaaaauacaaaaauuagccgggcauugugguacaugccuguaaucccagcuacucgggaggcugagggaagagaaucacuugagcccaggaggcagagguugggugagcugcgaucgugccauugcacuccagccugggcaacaagagugaaacucugucucaaaaaaaaaaaaagaaaagaaaagaaaagaaaaaagugcuuagaguggugcccagcauuugggaagcccucagcaaaugccuggagcuguccaacaucaucagacuggcuuaggagacuggcaccacauuaggaaugugcuggcagaggggaauggccaucucuggcagcauugcugaaugcauuaaauuuccuaugacugccaugacaaaaugccacaaacuggguggcuuccaacaacagagauuuauuuucucacaguucuggaggcuagaagucugaaaucaagguguuugcagacuacguuuuuuucugaaggcucuaggaggcuacgcaugguggcucauaccuguaaucccaguauuuugggagaccaagguagaagaaucacuugagccuaggacuuugagaccagccugggcaacacagaaaauuccuacaaaggaaaaucucuagaaauuuuuuuuuuuuuuuuaauuagcugggcaugguggugcaugccuauaauccuagcuacuucggaggcugaggcaagaagauugcuggagcccuggcaauugaggcugcagugagcugugauuauaccacugcauuucagccugggugacagaccgagaugccaccucuaaaaaauuuuuaaaaauaaauuuaaacggagagaagggccuaggggaaaaucugcuccaggccuuucucuuagcuucugguguugcaggcaacccugggcaugcuuuggaagguagacacaucacuuaaaucucugccucccucccaacgugguguucuccuugagucugggucuucacauggcauucuccucuccaugugugucugucccugugucuuuccucuucucaugaggauaacaguaauaaugaauuagggcccaccuaauaaugacuucaucuuaaccugaguacaucuguaaagacucuaugucaaaaacaugucacguucacaauauaucuuuuguggggacacaauucaacuguuaacacugggaaagggauuauugcauggacaguggucucaucuccccuccccuucccuccccucccuuccuuccuuccuuuuugcucauuaucauuauauuggacacuuaucaaauuccugaccucauuuuccauguuuugguuuuuuaguacuauuuauaauucuucagguguggucuagcugaugcuugcuggaaacuccuauaaccuggacacuugacuaaggugucauuaagaguguuuuuaaaaaauguucuuuguauguugauagucccuaacauuggcaucuaauauugagcuugaaauaaaugacaacaaacaaacugauuuuugcauccucucuuuacuaacaauucaaaaccacuucucauaccucuauagccuauuuuuguugcuguuucugcauaaagacuugagauaauuaauagagaugaacauggucuaaacuacuccuagaacuggaauggaugggcagccacaagaaacguuaugaguaguuugaguggucuuuagacucuguggacugcaucaguuggccuagacaaagcacuucagggcaccaauggcaagauggaccuaguguagaaugugacccaucacuagaaaaaaaucuaagcuuucaguugcauguuaccacaugcccuauagauguaaguuccuaucacacagugagcaguccuggaaaagcccucaguauuuuuauggaagacuauaaggcaaccugagccuuucaaaaggagggggagugaagccugggcauugccccucuagaugccccuggcuugacuccucagagggcugccauguuagugucagugauggauuucucccaauauugacauacuauaagcaggguuggggcacagucaacacaaaaccaauucauacauuuagaaaugugagggcugcucuuaacaagaaagauuggcuguuuuauauugugauuuuucuuucucuaaaugaauuucuugauuuauuuuccuucugucuucauuuuccuuucgauauuuguaauuugcaucgacaugcguauuuaaaauguaacaaggauuaaaugugauuauuguaaugcuuuuuauacuagagauauacacuaugggaagucuauaauggggauaauuuguauauggcuaauaugggacuugccagaaucauucuuaacaauuuucacuagggcuguuacagggauucacaaguucucuuugauuugcaaaaugugugcucuaaaaucccaccacaugucucagcguuacucaccauugaauuccuaccccccauauugauauccugccuuugugcauaguaaguacucaacacauguuuguugaauagaucugccucuuuccuugucuaguugguccccugcuccuguucaugaggcuuauaaacuucugaaauacaaaggccugauaaaacaauacccauauugcauaaacauggggaucuucacaaggucaguaauauuacuauucucauuuuaaagaugaagaaacugaagugagaaaagucaaguaacuucucaaagcccuaaagaugauaauagcagggguggcauucaccuaucauugucauuagucuuagcagacuaccuugugcauaacaggaacucaaaaauuagguguuuaaaggaauggaugaaaugaaugacuuuggaaaagucuauuuuacaauugacuauugcaucaaagucccuaggaaaugagauagcuucugugcaauguaguaagcugcccaaaacaucuccuaaauaauaauaauagaaaauaauaaugcuuauaacuuuccaggcacuguccuagcuauaaaaccccauuguuaauggagaagagguuaucuggaucaugaggagauuaauacaccaaagauacagauugaggccaaauuaaguacgguguggacagcaggcaaauggcgucugccauaaaugaggcuguuacaaugggaaagcucagaauguccauaagauccucuuuaauucauuauuaugaaaauaaaaaauaaauaacgucuucauuaucuaaucauuucucugccuguuaaacaaaaaaaaaaaaggaggcagggcgugguggcucacaccuguaaucucagcacuuugggaggccgaggugggcagaucacaaggucaggagauggagaccauccuggcuaacauggugaaaccccaucucuacuaaaaauacaaaaaauuagcugggcgugguggcgggugccuguagucccagcuacuugggaggcugaggcaggagaauugcuugaacccgggaggcagagcuugcagugagcugagaucacgccaccgcacuccagccuaggugacagagugagacuccaucucaaaaaaaaaaaaaaaaaaaaaagacaggagcagaagcacauacgugaaauugcagugguguagggauugugaagacacauucuuaaaucugucuuucagcaggaggcauaugacuuaaaacuacccacccacccuguguuuccaaggacugccagauagucugacugugccugauauauagcagggacucagacaugagcugaaugauuggauguauaaaugaauguuucugaguuuuaaaaaauuccugccaacugcuauauaaucaucuacuugaaggagaccugaucacagguaggcacagacaaccaguccuucacugguagagcugguuaucagugaacgaaggcccugcacauccucuucguaggcuggaagcucucagcaucagcaagugauggacaggcagggaaacaggguguuagccacaaaaucacuuucagagacaugcuuuuuuuuuuuuuuuuuuuuugagacggagucucccucugucacccagguuggaguacaguggugccaucucggcucacugcaaccuccacuucccagguucaagugauucuccugccucagucuccugaguggcugggauuacaggcaugugccaccacgcccagcuaauuuuuguauuuuuaguagagacggguuuuaccauguuguucaggcuggucucuaaccccugaccuggugaucugcccgccucggccucccaaagugcugggauuacaggcaugagccaccgcgcccggccaaggcauacuuuuuaagguuucugcaaagcuauuuuaccagugaacuuucacucuauaccaaugugagaggaaaaaauaaagcuuuacggggucuuuuugaugacaucaccaccguaggaaggaaacuuaauuuuuuauugcugccuagcaaauuaacaccaaugaaguagcuuaaaacaacagaaauguggccgggcacgguggcucaugccuauaaucccagcacuuuaggaggcuaaggugggugaaucacuugagcccaggaguuccagacuggccugagcaacgcggagaaaaacacaaaaaauagaaaauguaggcugggcgugguggcucacgccuguaaucccagcacuuugggaggccgaggcgggcggaucacgaguucaggagaucgagaccauccuagugaacacugugaaaccccaucucuacuaaaaauacaaaaaauuagccaggcgugguggcggcugccuguagucccagcuacuugggaggcugaggcaagagaauggcaugaacccaggggacggagcuugcagugagcagagauugcgccacugcacuccagccugggagacagagcaagacucugucucaaaaaaaaaaaaaaaaagaaagaaaaaguagccagacaugguggcacaugcguauaguccuggcaacucaggaggcugacgugggaggaucaucugagcccagggagguugaggcugcagugaguugugaucgcgccacugcacucuagcuugggugacacagugagaccugucucaaaacaaaaacaaaaccugacaaacauauuaucuuaugguucuguagauuagaauucagaccaugggucuggcuguauuaagaucaaggugugucagggcuguguuccuuucuggagccucugugagagucaauuuccuugucucuuucagccucuauaggaugccuuuaugucuuaguucauggauuucuuccuccaccuucaaagccagcaauauagcaucucucugagccuacuacugucaucacauuucuuucugaucacagccaggaaagggucuuuucucacuuuuaagaagucaugugcuuugacugggcacccacugauaguccaggauaaucucuccaucucaaagucuguaccuugaacuacaucugcaaagucccuucugccacaugaaguaggaccuucacagguucugggaauuagaaugugaacaucuugggggccauuauucugccuaauauaguaaccuaagguaaagacacaccauucccagggcugacagggacaagcagguaaauaucgucacagauggucauuuccaaacauccuguauuucugucuuuagaauuauuccuccugcauaaggguaguuuuucuguuuguuuuuuuccuccucuaguccugaugaaaaaagguaguaauugauuucaccuuaauaccgggcauuaaauuagccuaagacaacuagcaugcuuccaaaaaaauuaauaaagucauuauacaucacauuuaguaauguaggaugugcauguaauauacuuguauacacgugucagugucuaugugaguauggacauacauauuaguacacacccauuaucuuuuuaaaaacugacuuggaugauuuaccucacuauugaauauaaaguaacuuuccaauuuuugcuaugugaacuaaaaccaucuacaaagccuaaagcagagaugaguguaugucuauguggguuuaugacucaaugcaaaaagaaaguuuauaaauacauacaaaaaaccggauucucuaaagugcuacacauuuggcuuacauugcaaauagauguugacuagcugcuaagugacaggcaugaaugacuuauaauacacaugagguauggugcuugaccuccugaagcuuguaauuugagagagaacucagauacccaggcaucuaauugcagauaagagagaaaauaacuuuaaaauaaguguaauuugcuuugagacccucaggaagcaggccuuuuaugcauggacuuuugcuagacaugaggggugugggcaaaggcagggagguuuccuugggaagcagcacuggcgcugguucugcagaaguagaugauguugaaaacgcagauaugugaagaguuauuuuagguguagguaaaggaccagcgaugagaaaauacaaauauccuuacaauggccccagugugagugagguaaagcagagaaugcaaggugaggagggacuccagaacugcaggagucuggacuuuauucuggagaucacagggaccuacuguaggugugaacaggagacuagcagggccccuuugaagaauuaacacuuccgacagaggcucuuaguugccccuuaaugcucauuuuccucuucuuccuugguaacagaaugcucauuuuuaggaaggcauauucaugcccaguuaaaggcuacagaacccagccaucuuugcugcuagucgugguuaacuaaaguuccagccaaugauacguaaauggaagugguauguaaagucauucuuggaaggaaaaggcaugcucucuuuccucucuuuucuaccuucugccuggaauggaagcauaauggcuggagcucuagaagccauguuggauccugaggaggaugucaaaucugaauaacaccagaacagagagcuggaaggagccuggacuuccuuuacaugcaugggaacuaacuuucaucuuguuuaagcacucuuguuuaguuauuuuucuguuauaugcagcuuaaccuagcccuauaucaaugguuuuuaaccuuggcuacacauuagaaaccucaggaaauugcaaaaucaaagauggccaaaaauaaucuccagagacuuugauuuaauuagucugaggcagggccuaaugauaaguaauaguuuaaguuuuccaggugauucuaaugugaagccagugauggccacaguuauagacagaguuguaggauaagagaguuuuaaggcuggaaguuauuuuggaagauuguugcaauaccauugcuuagauuuagaacuaggagaaaggccauggucacagauggucaggugucugugaaaggcccaggggagacagaauccauguauggaaaauggugaacaacugauaauacauaaggcaaugggguuuuacacgugggaaacuacaagugagcgagcaucauuaauaucaagaggggguaaugggaggagauggcuggccugguagggagggugugagggugaacuuucagugggacacagaauaaauaaacagauagguccacaauuauaacguguuuuacaauugcugcgucugcacuuuucuuuagaucccaugacaucucuuuuaauuugaucuuuuuuuuuccaugauugauuuuuugggcagaaugcauuuuuuuuuuuuucagaaaacauaacagcucucccucuuuuucaagcaaguggagagaaauacuaaugggaaauacacuguauuuuuuuuuuuuuuuuucagaaaaaaagcucuuuugaaucuuaguucugcuuuucucaaaaugacuaaauaaucuauuuuguuuaaguccauuuaacauuuuguugguaggcuauaucuauuucuaguacccacagcacacucugaacauuugacaggaucacaccugauuaaucgcucucuuugcugucaucaauauuauuugggggcaguggccaaaccguauugacacucugcugacaucuucuccggugcccaauuacccuucugucaugauacaauccaugaggugacaggaggauucuaugcugugccaaguggguuggcaccaaaaugucccugagacaguauauaauacaucauuuuuaugcuucuuuggggaacugggagagacaggacauuuccccuuccccauugccaauaacagguguuucacucacagggcugcagaaacacaguggcuuuccagguagcuuugcaauuugagcuaucuggaaccugccuggaugagccuccugaaguuuuuuaguucauccccaagguaaauuccuaacgaaagagggcagaagcccuugccugaggcucuuaacccugacccacauauuaaaaaguaguuaagcuccuaaaagaguugagcuguuagacgcucuaggaaucuccuguuaagaggcaacuucagcauagcucaaaucugccaaguaaaccacaguggagucaguauaaggaguaacguacacgggaugguguaacccuuuugaaaacugcucuggccaugcucuaauacugaaacacaugcuuuggggcuaaauaggacuaaaauuaagaguuuccuuuuuuuucuucuucuucacccccgcccgccacccagaucacugguaaagcaauaucuuuuuuuuuuuuuuuuaaacaaagcuuaacugaaugaaaaugaacaaagcuuaacuuaaugaaaauggccuucaugagaucaggagggcaucuccguuuauguaucuagaaagaaaauauauugauagcuguccauuuuaacauuuuauuuuauacacacacacacagacaagcacaugcacacacauuuauuugaauaucaacaaucuuucuggucaguuuagcaacuggugucauaacugauaccaguacuccucauaauaucauauuccuauaauaugcacgaauaagaccacugaguauugggaugucaagugauuguuccccagaaggauuccaaaagauuuaagagcacaaacaugaguuccacagaacucagaucaaugaaaaaacuauuuuguuuugcaugugguuacagggcuaaugguaugaauauucucaguuucacggcgcccgcugagcggaggaauccuccagcuugcugagaaauuccuuccaauauuggggccaggagagccaguaagaugcuuuguuugguuuuguuguugaugaugugaaaauuagucuuugaucugauuuuucuuaaaauaagaauuuaguauuguuuuauuauguacugggaugcuggcuaggauucuuauuuuuuauuuuaauuucuaaacuauuuuuaaauacuuaaauugaucagguuaaauguguucauggcaaaaaauucaaagagcuuauaagauguacaaugggacaagccagguccuccauaaaguccuacauccuuaaucuauugcguuguaauuguuucuuuuguagauuuucuagaaauuauguaugcauguauaaagguuauggauuauacacauuagagaaaugccaggcugggcacaguggcucacaacuguaaucccaguauuuugggaggccaaggcaggcagauugcuugagcccaggaauucgagaccagccugggcaaaauggcaagacccccaucucuacaaaaaauacaaaaaauuagcuagauguggugguuugugccuauagucccagcugaagugggaggaucaccugagccuggggaggucgagguugcagugagccaagaucaugucacuguauuucagcuggggcaacacagugagacccuucucaaaaauaauuuuuuuucuuucuuuuuuuuuuuuuuugguuagauggaguuucgcucuugucacccaagcuggaaugcagugaugcgaucuuggcucacugcaaccucugccuccuggguucaagugauucuccugucucagccucccgaguggcugggauuacagguaugugccacuaugccugacuaauuuuguauuuuuaguagacauaggguuucaccauguuggccaggcuagucucaaaccccugaccucaggugaucugcccaccuuggccucccaaaaugcugggaucacaggcgugagccaccacgaccagccuaaauaauuuuuuuuuuaaaaaagaaacaccagacucguauuauaccugcuauuugucaacuugcuuuuuucacuuucaucuuggccaucuuucugugcaaguguuuauguaucuacuucauuccuuggccagccuuauaacaucauuuucugaaacucuauucauggacauuucugcugucuacagguuauuuuuuuuuuuugacugcuacaaaaaaugguauaugccaccuuagaacauauauuuuuuuuaagaugguacaugccauauggugaaggauucagucaaagaauguaguguucaaguuuugauggcaauucccaaauagcccucaaaaaaguaaccucagucauacauuccuacccaguuguacuaaagguuauguuuccagucccauugccacugacaggacaaagaaugaugcucagcuugcuuggguccccugauucucacaucaucucuggagacacgcucuuuucaucuccacuguagauaagagaaaacugaggcacaggcaggucuuacuaacuggcugaguguuggaggaggaacauaaacguagauggucugacucuauagccaggcuccuagcugccaucgugcaguaccuucugucucguauuaagguuucuguuuuccagacugauguuagaaaccuuuuuuaaaaccuaugaaacagaaauucuuuuuaaauauccauuguccauguuucuuuaucuuuccuucauugaacugccuguuguugggcccuaaaaaucugaagcuguaaaaaccauuuguguuuguuugucuaaggugggagcagguggaauggaagcagugguuauaaagugauuuccaguguugucacugaggguaaaaucucuauuuccugagagaucacuuuuguggcuuuucaucuguggacaugccuggcaaguacuuccauauugcuccugaauuugggggcaggaauuaaaauggaauauuccuugcgaagugauuuuucuguugaauacuguaaauuuagcaggaccuugugccagcaguaugagagaugcuccuuccucccccaauaaaucuggauuuaaacuggcuuaucccuggaagcuccuuuuuauccuuuggacauguguuacauuuuugucuuggcuuuuucucccaugaaaucauagaaggaggagcuugcugacuuuaccuucucuucucuuuaugaggagacaucaugaaauaaaacuugacugauauugucacugcacacauugcauuagacuguuguccuacaggaggcgucccugaagacuggaaucuuagcuuggagaaaugcacucaacaaacccaggucccagaacagaccacagcgaugcucccguucaggccaggugauugacgcacaccuuuguggcuuaagcugggaauuuccuccuuaagggauuuaauuauugcacuaucaaucagccugagaagcaaauguuccuccuguaggaacugagguagggcuugggaugaagaagaacuucuucuuccucuggggcuuggaggagguuuggcuuggauccaaaugccugaggagccucauuaaugaaagcaggguugagacccauaggaggcuucgcugggagcuuggcagggucucaggggcugggcuccugccuggauuugaagaguggcuauuucaggaagcaguugcaaguuucucucaguguaaaauuucuguuagcuccaauccuugucaagucuugcugaaagccauagcuucguuuccacugcacugagguugaguagggggcccucuccaucucuccauaagggcaucagugacugucacaggcugagacagcugcagcuggcagaguaaggaucucaggagggcagugucagcagcaggguggcagcaaggcaugcaggcaaggaggucagaacagaggggcccaaugaguuguuuuugaauacugaagaggcugcuccuggggaacccaugagcuaacccuuaucugugugugcuuggguguaauuggaaucaauauuucuugagcauuuacuagugaaauauggaugugccuucucccuuaugaguauccucucauuuaaacucccuuucuaccaugugagguagcugugagugccauuuaaaugcugugguuaaggaaacagucauugacagcuuuuauaacuugcugaaggucacugaacuagcaagcaauaggacuaggauuugaaaucaggucacauucagaaaauaauuugaauguauuugucauaaugaauacuuuuaauauaaaauuaaaauaagagauuuuuagaaaccaaaucaggagcacuacagaggugaguaaaaguagacguuaaaaagaaauuguaccaccgugcucguagcagcguuauucacagucacuaaaauguggaaauaaaagugucccuuggcaaaugaaugaagaagcaaaauguauucuacccacacaauggaauauuauuccaucuuaaaaagggggaaaauccugauacaugcuacaaaauaggcaaaacuuaaggacauuauacuaagugaaauaugccaacugcaaaaagacaaauacuauaugauucacucacaugagguucuuagagcagucaaaaucacagagacagaaaauagaacgaugguggugugaaaucaaauaauucaaacuuaaaaugguuggaacuuuacauuauuuugagccuugagagaaaugugguuauguggccugaguuaugccacgugcagcugcaacuucugcuucucugauuauagauuaaaucucuuccucauuucuguccuguaaaugauuagaaaagaccaaaugguuccagaaauaagaccccucgagaccauuaccccuccuuauggaauguuaaagcaaucuuccuuggaacauagcaaacuguaaccaaucaaaugaccguaacaucugugcuggccuuauauggcaaauguugcaacccuguuaaccuucucuauuucugccuauguaagugaaaccuuaacuuucccacuuuggaaagcugaccccauucacuuggaguugguguuucccugguggcuauccucaggcuuugagcuggaauaaacucuauauuuaaucacauuuucugaacucauuauuuaagguuaacuggccaggggcuaggaggagagggaaauggggaauuacuguucaauggguauagcguuucaguuuugcuagauaaaaacggcucuggagauggaugauggugaugauugcacaacaaaaugaaugcauuuaauaccauugaauuguaaaaguaaaaaugguuaagauaguucauuuuauguguauuuaccauaauaaaaauuggaaaaaaaaugaaauugugcuguauauaguacacaggugaaaaauuuauacagaacuuacaucuuugauaugguuuggcuguguucccacccaaaucucacccagagguguaauaauccccacauguuaagggcgggaccagguggagauaauugaaucaugggggugguaucccccauacuguucuccugguagggacuaagucucaugagaucugaugguuuuauaaaugggaguucuccugcacaaguucucuugccugcagccauguaagacguggcuuuacuuuucccucugccuucugccaugauugugaggccuccccauccauguggaacugugaguccaauaagcuucuuuccuuuauaaauuacccagucucgggugucucuucacuagcagcaugagaacaggcuaauacagucuugguguguaauuccuaaggaugagucuaaaguugcuugccccgaguuugaaucucugcucuacugcuuuuuaacuauaugaccuugugggagaaauuaaucucucuggagcauuucuaaaauaaagacaaaauauguaguaccuuuggcauagagucaaugagauguuuaaaugacacaguauaugaaacauacaugaacaguggcugacauguaacuacuauuauuuaaacaacaugacgaaugagaaugcauauauaaauauuucacuuugaguaagaggcagucuaaaacuucaugaaaaaagucacuaagauucaaucaaauuucuuauaaacaaggacaaaaaauuauaacgauuauuuuuaaaaauauucagaauuagguguuggauaguaagcugacccaaccaaauaaauauguuucuggcuuugaaauaucgaagauauuuuuuaguuaacuccccucagcugcuauaaaaguuggucauggauuauuuuuggcccaggaagaaaaaggcuguuagacaagccaauuccauuuagggucagcgaaagagagcacaacggcuaguauuuggccuuucuaauguugaggugggaacugcugacuaauuguaacacaaagacugugcuaacggcuuuucacuucacuuauuuuccaccauguaugugcccaucuuggccaggacauaacuauccagaaauucuacaauaagagaaggguacucacgcaaugaauggcaauucuuucccugauaauuucauuuucgaauugcuaauuucagauauggugauuuagcucauugagucaggcugcaagagaccaggaauuacccagcaguggccacuuagcugagaccaagacucguguaauuagaauucuggcacuguaggugggaauauuuacuauugcugugaauaguaaaucauaaauguuaaauuacauucaaucucagaaauaacugcgcaaaacuucucccagcauagauaaucaggcaauuauugaaauggugaucguacucacaggccauugcagcuucguugugagacccaaucaugcucugagcugcaaucucauuuauccuggcuccauuuuuaugcauuuuacaccaguaaauaagaauaaguauucaaucuaaguuuuagaguucuuagaaaaagaacauauaauguggucugugguuuaagcuuuaaauuuaaagcuuacauauaagcuaguuaaaaauuacauucugaaaucauuaaaaagauagauaaaaacaauauuaaaaaaacuuccuugauccugauauuguggaagaacacuggccuggguguuuggagaugugugucuuuggucuucuuucuacuccucauuucuacuguaauuuuuugaaaguaauuuacauuuuucagggccccaauuuaugcaucuguaauuuaagacauuuuaaaauaauuuuuagcuaagguuccauucaacauucaaauaauaauaaaaauaauauaucacacuguaauuuuaaacuuucauuuaugacagcaauuuaccaagauccuuacaugacuugggaaguacuauacuaucuauuucuauuuugcugauaagaaaacaaagaugugaaauauccugacuuagaucacacagaaaggaaguggcacggguacuuuguccucauuuuggucuuaguucaucuuaauccaaugaugcuuugugauucagauuauugaaaauagcuuucuuaacuggacaaagcaucuaaaagcaugagauuuaauagaaccuuuauuuuuacccugacauuacaacaaacgugguuuaacauaugugaguuucauuuggauguaugugcuacauuuuuauuucccauaaucucccagcccuucucuguguuuggagaaacaaaaaaacugaacagcaaugaucgugacagugcacuccagguugccuggacaguguuccucacuucuccuaguuagagagacuacacccaaagucagcuucaagaaggggcucuggcuuccucccuguuccuggaggggcucugacucccagacaacacuuguaaacagcaggcaccuaugcccagacugccuggugccccaugcaucugauuuuccccuacugacaaaguugcugucauuuuugcuuugugagaagugagagaagcaggggcuuccugguaacgaaugcccuuggugcauucagcggaauagccuggcuuucgcacgucucccugagggaugaugggauuggagaccuguacuugcucuucugaugaugaucccugauuuauaacuuucucuaguaaagccuguuucauaacaucugcauguggcguuguggaauuagacuugaggccuacgacacagcaggucaagagcaugaaggggccuacuugccacgcucuguuuucauuuauuuucauuuaagagucaauuggaaucauuaagaauugugauaagggccaguugugguggcucaugccuguaauccuaacacuuugggaggcugagguggauggaucacuugaggucaggaguucaaggccagccuggugaaaccccaucucuacuaaaaauacaaaaaaaaaaaaauuagcuaggcauggugaugcgugccuguaaucccagcuacuugggaggcugagccaugagacugggggcagagguugcggugagccuagaucacacuacuguaccucagccugguugacagagugacucugugucaaaauaaauaaauaaagaaaauaaauuuuaaaauaaugcaauagaauugcaaauaacuaucccauauaguauaauuuauagaaggcuuuuauauucuauauucuuaaugaucacaaaaauuugccaagauuuauuuuuauuauacagauaauaaauuaaauuucagagagguuaaaagccucccccaaaaguggcaaaucugggccuggauguaaggucuacccgcaucaagcucaacuuucucuucacugccccugagagcuuuagaaagugucucuagaagcaaccccauccacucccaaauaucuaaagcauccacauaggaaggagggccuuugcuaggugcuggugaauucaaagaccaagaagauuucuccaagagcauucuuucuugugcuaaaaagggaagaccauuuuaagagcuauuuauuauaaaaaacauucauggcugggcgcgauggcucaagccuguaaucccagcacuuugggaggccgaggugggcagaucacgaggucaggagaucgagacuauccuggcuaacauggugaaaccccgucucuacuaaaaauacaaaaaauaagccaggcgugguggugggcgccuguagucccagcuacucgggaggcugaggcaggaaaauggugugaacccgggaggcagagcuugcagugagcugagaucaugccacugcacuccagccugggugacagagcaagacuccgucucuuaaaaaaaaaaauauucauuauacuuuucaguuugcucaagcuauagugccuuuauuaugaaauauuagacaaacuuuacggaagcaaaggagugggaugucuuagcugcugcuaagccagaagagaacaagacaccagcagugaccaagucccugaguaacugugaaauguuagaacucaauugaagcuugccagaggaggaggucugggaauaaggguggaauggaaugucuucuaaucugugaucugaauucagacauguucuuugaaauggcuucagaggcuaauauauaucuuuaaaaaucaaucuugugacugggcgccguggcucacgccuauaaucccagcacuuugggaggccgaggcagguagaucacuugaugucaggaguucaagaccagccuggccaacauggugaaaucacaacucuacuaaaaauacaaaaauuagcugggcaugguggugggcaccuguagucccagcuacuugggaggcugaagcaggagaaucacugagauugcgccacugcacuccagcccaggcaacagagcaagaccuugucucaaaaaaaaaaauaaaaaauaaaaaaaauaaagaucuaucuuggccaggcaugguggcucaugguuguaauccuagcacugugggaggcugaggguggaucacuugaggucaggaguucaagaccagucuggucaacauggugaaaccccgucuguacuaaaaauacaaaaauuagcugggcaugguggcaggugccagcagaggcaggagaauugcuugaaccggggaggcagagguuucagugggccgagguuuugccacuguacuccauccugggugacagagugagaccccaucucaaaaaaaaaaucuauguuuucaaccuguaauucuacuaaugguagcccucaggguuuagacacagaugucaugcuagggccuuaauguuuucaaaacugucaacugcacagacaguuccccagccuggcccagcuccgucaugcuucuucuccaagaccaccaugcaagggcgagugucccagggcccuugcuuuuccuugucuuucaaguuuaugccucuuccuccaagacguuauggauuccuuccuucacuccuccaguuagauugaaaauuucuuccaucaguuuuuuuuuguuuguuuguuuguuuguuuuuugagauggaguuucacucuuguuacccaggcuggagugcaguggcacgaucugggaucuuggcucacugcaagcuccgccuccuggguucaagcgauucuccugccucagccucccgaguaucugcaauuacaggcacccaccaccaugcccggcuaauuuuuucuauguuuaguagagacgggguuuugccuuguugggcaggcuggucucgaacuccugaccucaggugaucugcuggccucggccucccaaagugcugggauuauaggcgugagccacuacgccccgccacuuucauuaguuuuuguuguaucuugcacacaccuuccucacaacacugacuguauuauguuaucuauuugugugugcacauguguguuuccuucaacuaguuuuggagcuccugaggacaaauaccauguuccauucaucacuguaucccuagaacuuagcaugaugucugauaaaaaugaaguucacuuaggugcagguacuagaucuuacucuuucugaaucccucuucucuccucuguggugggacaaggugaugguggcagggcacucugggcugccuggacaaugaaccagcuggggcucuguucccacuucuccuaguuggggaggcugaacccaaugucagcuuccugaagagguagggaauuaauguuggauagacaaauggaugggagaaggucugccuggcuuaagaacacacaacuaguaauaaaaggcaucaagaacaagaaugugagucaggacagggauucuuguucuuugcauuugguauuuuauccccagugccuagaagaguugcugacucauaaguauuugaucaauauuuguugaaugaaugacugauuggaugauucacugaaugaaugauugaacgaaugaauaaaagguuaauuucaaagaccaugcccuuuuaacuccauucccaacuuccaaucuuuguauacaguguguguguguguguguguguguguguguagauacaucuuucaaagaaauaaaauuaaaaauuaucaugaucucuucuuuacaauaauccauaauuaaagauuaaugauagcuauuuacaaguauuuuacacacauauacacacacauucuaagccauugaaauagauaggcuuuguaauuuguuauauuuacuagaagaaauauaacuuucagaaaguaagcagacauccuaccugaaauucauauaaaguuacguucucagaauuuguuuuugguuaacugguggaaugaauuugucuuguaaacugucccuguaaauagcauacuacauaggugaacugaagaaaaccauggcugggcauauggggaaauucaugaccaugacuggcuaugugcacagcugcccagaagcagaaauggagccucucaacacuucuaaaaauguagaaagccggcacuggauaugugcuucugcaaagaaucacacuuagguuuauagucuuccaccuaaacuucuggggccuuuuucacaaagaauggcagcugaucuuaucuuuaucuguuacugacacagacccagcuauucacugcggggcagaacaaaagccagcaaagggaucgaagaaacccaaaauagaucuuucuugaacugauuuguaucagaguuauaaacaauuccagguaugaaagaaaaguagacaggcaagcacuuacagaagacaagagcaaagaaugauuuuuucuguuucuuuguuuuuucccuucucucucucucucuccuauuuuuccaauccagauccccaacgcaaacauugcaggaggugguugugcuccccgcaggaggcuguugacugccugcacucaugcacacuggcuucccgcccccagccaucccucuauuguuacacagcacauuuuauaaugcaaaucacugucuacaacauggcucauuauuuuccucucugaauaaaauaugaacacaucaauuaugucucaguuucuaaaugcauacccuugucgcacugaccucuuucugcuuuuauauuuuucaguauguuccugacauuugucaguuggguuaguuccagaccuuucuacccuauuaucguauuauuauagcacuuuucaaacuuucuucuaucacaugaguuugacacaaaggcacacugggagggugagccuggcugugcugcccgcaggcacucaccauugcuuguaguccgcgucgcaguuacaguaguacuugggaucugugcaguugcguucgaugccgcaggcacauuucuggauuccaggcccagagccuccccaguaguagugcuucucguuggcuuugccaacccaccaaguguaagggcuuccaucuacaagaaaaggcaaagguauauuuagaaacagaccuggguucagucauuagacugccacacuuacacccacuuccccaggaauacucugauagucugaacaucacucaacccucuuaaaagucaauuuauuucaaacagacaacccacagagugggagaaaaucuucacagucuaucuaucugacaaaggacuaauauccagaaucuacaacaaacucaaaugaauuaacaagaaaaaacaaucccaucaaaaagugggcuaaggcuaugaauagaaaauccucaaaauaagauauacaaaaggccaacaaacauaugaaaaaaugcucagcaucccuaaugaucagggaaaugcaaaucaaaaccaaaaugcaauacuaccuuauucccacaagaaugcccauaaucaaaaaaucaaaaaauaauauauguuggugugaauguggugaaaggggaacacuucuacacugcuggugggaaugcgaacuaguacaaccacuauggaaaacagcguggagauuccuuaaagaacuaaaaguagaacuaccacuugauccagcagucccacaaauggauaucuacccagaggaaaagaagucauuauacgaaaaagauacuugcacacauguguuuauagcagcacaauucaccauugcaaaaauguggaagcaaccuaaaugcccaucagucaaugaauggauaaauaaacuguuucucauacacacacacacacacacacacacacacauacacacacacacacacacacacacacacacacacaaacauauaugauggaauacuacucagccauaaaaagaaaugaauuaauggcauuugcagcaaccuggaugggacugaagacuauuauucuaagugaaguaacucaggaauggaaaaccaaauauuguauauucucacucauaagugggagcuaagcuaugaggaugcaaaggcagaagaaugauacaaggacuuuggggacucagggugaaagggugggaagggggugagggauaaaagaugacaaauuggauucaguguauacuucuugggugaugggugcaccaaaaucucauaaaucaccacuaaagaacuuacucaugcaaccaaauacuaccuguuacccaaaaaccuacagaaauaaauuuguuuuuuuuaaaaaagcuuuuaauucuauacuucaaaaggcucuuuuaagcuuagacgaguuuucaaaaguauauaucacaauuuuacauguauauaaauauaaacauaagcauaaagguaaauuuaugucaauaguagaaauauuugauaaaaaauaucagugggaguguuaagcuuaagauuucucaugggaauauguaccucucuccuuggaagacaauuuuacauucaaacuucugugauuuaggagucuauuuaguaaacuggaagccaaguugcggucaguccgcaaugaagguguaugggccaugaacugauucuacaccauacaauucucgugacuggucaugcuuuuuugugaacuaagucauggagaucauagaauauuggagcuaagcacaaacuuucacuguuuuugaguaugaccuccuaauuuuauggguaaagaaauuuaggucuagaagaguuaaguaguucuuuuaaccacacagcagauuagcccccaacucuccuuuaucauuuggccuaauagucacucauucauucauucauccaaucaucaaacauccacuggguucccacaaugugccaaacauuagaagcaacucaacagaauggaagaaaaagauacagauuggagaacaguuuuaucaguauuaugaacacagaggagagugggggaggcaaaugaggucauaaaggaaggucucccagaggaggcaaaauaguugagcugcaucuugaaggucaaguaugcauuacacagaucaauaaggacauaagagagguaagaccuccuaggcaaauggagcagaauguaaaaagacagaaagguaaacuucuauuuggaaaauauguauaggacuauauucauauguaguagaauugggcugaagagaugugcugagaggagcaguaguagauaguaagagauagauggacagcagaugaaggucacauugcaaaauaccuuuguccaaguaagaaguuauuuuucauugguuuauccuuucuuuucaauguuuaucuucccccaauuuaagacguuugaacuuuauccugaaaauaaugggaaacuaguaaaggauuuuaagcagggaacuagcaugauuaaauuuguguuucaaaagaucaacaggaagaugaaagauagauuucugcaaaauggauucagggaggcuagaugugaugcucuuauguuaauagagaaaagaaguaauaaaauaguaguagaaauggaggagaagagaaaacacacacaaaaaagguucaggaguuauagcuggcugggacuguugggauuuagguagaagagaagaugggcagggagugcuguggauuaauccaggcuucugguuuguaugaauggggaugguacuaugcuccaugaagguagggcacagggaaggaagaucaucaucaaaagucuagggaauguugaagaaaagauaauggguuugcucacaaaauguacaaauugauuguagaagucugguucucaggaggauuuucugagcugaaaauauguuuuaggaacuaucagggcaaaccagaacauauuggaagugggagaaaugcugcuggaaucuuuuagauuacaacaucauuucaaaaacggaaugauuucauagcuggccacaguggcaggcgccucuagucccaguuacuugggaggcugaggcaggagaauugcuugaaugugggaggugcaaguugcagugagcagagauugcaccacuguacccuagcuugggagacagagcgagacucugucucaaaaacaaaacaaaacaaaacaaacaaaaaacccaccaaaacccaagaaugauuucacacuacuauaaagaaugauccaagacugggucuuuaaccauuuauaaagaaaagagguuugacugacucacaauuuuguguggcugaggaggccucagaaaacuuacaaucauggcagacgaagaaggguaagcaaggcacgucuucucaugggggcaggagagagagaaagcaagaagggggaagugccaggcaauuaucaaacaaccagaucuugugagaacuuccucacuaucaugagaacagcaugggggaauagcccucaugauccagucaccucccaccaagucccccccuugacacaugggguuacaauucagauuacaauucaauaugagauuuggguggggacacagccaaaccguaccagagauggagaugaccauagcagagugcaagaacgaaggcagccagggugaugggagaaaaacacaggaggauuucccagagagcagaggggccagcaccaucagauuucauagugaagucuauuaagauggggaacuaagaguuuucuuuuaauuugacagcuggaaggucacuagagauuuugaugaaaggaguuucaggugaauggcgggaagaaaagccuagacgugguaggcaguggaaagaauggaagcagagagcaggaagacccugacaauggaugacucuuucuuucuuucuuucuuuuuuuuuuuuugagauggagucuggcucugucgugcaggcuggagugcaguagugcaguggcacgaucucggcucacuguaaccgcugccucccagguucaaaggauucuccugcuucagccucccaaguagcugggauuacaggcaugcaccaccacacccagcuaauuuuuguauuuuuaguggagauaggguuuuaccauguuggccaggcuggucucgaacuccugaccucaggugauccacccgccuuggccucucaaagugcgaagauuacaggugggagccaacccgucugacuggaugacucuuucuuauucuuaauaugacuuuagcauaugagaaugcacuuaauguuaaauccacucucuugacaacuuuuaaaguguccaauguagcauuaaugauaugguguuguauggcugauuucuagaacuuacuuuuauuguuuaacugaagcuuuuaugcccacugauuagcaacugccuacuuccccgucuucccagccccuggugaccucuuuguuucuaugauuugacuacuuuauauuuuauuuauuuuuuuaagacagggucucacucugucacccaggcuggagugcaguggagcaaucauaacucacugcagccuugaccuccuggacucaagccauccucccaccucagccuccugaguagcuggaacuacaggcacaugccaccacacuuggcuaauuuuuguauuuuuugcagagaaaggguuuugccauguugccuaggcuggucuccaacuuuugggcucaagugauucaccugcuucugccucucaaagugcugggaugaaaggccugagugaccacauucagcuggauuugacuacuuuagauaucucauauaagcagagucauauaauauuuguguauacauacaauggaauauuauucagaccuaaaaaagacauuuugcaauaugugacaacauggaugaaccuugagaacauuaugcuaagagaacagagguuccuugccagaagcuggggaaugaguggaaucuaacagagguaaugucagccaguaagccaaaauagccagucaauuaaaaucucuggggcuggacgugguggcucacaccuguaaucccagcacuuugggaggcugaggugggcagaucacaaggucaggaguucaagaucagccuggccaagauggugaaaccccgucucuacuaaaacuacaaaaauuagccaggcucaguggcaggugccuguaaucccagcuacuugggaggcugaggcaggagaaucacuagaaccucgguggcagagguugcagugggccaagauuacgccauugcacuccaaccugauagagugagacucugucucaaaaaaaaagaaaaaaaaaucuggguauauggguuaaaauuccaugguaauaacucauccacccucuugggauguuaaguguacacuugacucuaugagugcucagaaauaaaggugaggaaaaucauaaaguuaccaugugaacagucacaauaucuaaacaaacaauacaaaaaguagggaccauauuggaauuaugcaaaaaaauacugugguacuuucucagauauuccaguaguuuuccucaagaauaauuuuguuaacaggugggugauuuaaaguugagaaugaacagggacuggaguccaggaugaauguaaugaaugagcaagcccucugaauuugaaaaugaguuaguuauucagguauucucucccuccaaacaaauuucuugauuuuucuguguguugacuuaauuuggaaguuauuauuuucccuuggcaugaccauuuuuggcacccacauuaaagaaaguauauuugacuuaaucugguaaacagucaagagggagagcucaguacccuguuccaaagggagaaacaugcccgcuuucugacauaaagguccacccugaagcugugucuucuguccaccugugccuggucccagcaugcgggggcuguguuugcuuucuauguuuaagucauuugcuucuccuuucuuuuuccaucaggguaagugguaaagcauccagcuucucugaugcuucccauggccaauaauaaauuuuucuccuuaugaagucuagaguuucaaaaauaagcguugaaauaucccauuuauggaaaccacagcaucucaaccaccgaaagaaauguuaaggucauuuggcccaaaagcuacacuaggucuuggcugauuccaucucuggccauguuauagagagaggacaaagguagaugguuccauuuugaccucaugaaaugccuuugaggcugggcaggccacagccugacccugaaaauauagaaacauuaccaaaacugauuaucauauucauuuuuugcauugcauucaaaaagcugaccucaugcuaaauucucucaaaggaauuuuugguuaguaucacuguuuuuggaaacuagaggacacuaacacucuugguggaggagaagaaacaaaucgggcaccuguaaaaguggaguuaaagguuugucuagcagaugacuccuuuguccugcccauaccucaaauaaccaaugaaagauuauauaucucagaaucucugcccaauuuaugauuguuccuuugagugaucaguagaaacaaccuaacacuguguuucauuuucauugcagacaguaauaauuugcaugaaucagagagcuguguguggcccaguauucuuuguaaaaauuaggacauucucaguaaaaggagaagauaacaaucagcuuuaccuucagaaugagacuacaaggaacauacucuaggggaaaagaagagagacagcugguucccacuguaccuucagagagugcucagaagcccaggaaaggaaguuucauuguugaauuguuugggcaguggugaagccgccugugcaaaauuaugacugagacagugaaagagaucuaacuuaaucgacuccaucuugcuucuaaccuccuugcuguccuuauucauuccuggguguaggcggaacuaacuuugggagaaacuuacaguuuauaguuuaaaacaaggaugauaauagcccuuucccacagcagaccuccuucuugccuggugacuagauugccuuuguaggacuaacauuagccgcaagauuagaaauuauaguuaagagucaugcagcuggaggcuacaagauucugacccucccuaaacuucuccuaaaaucagugcuugagauauucugcagacccugcacuugaugggucagcuggcaccacccagaucaauaaacuggcucaucugaucuggugccucccauccaggaacugacugugcaagaagacagcuucgacucccugugguuucauuccugaccaaucagcacuccuggcucacuggcuuccccccgacccgccaaguuguccuuaaaaacucugauccccaaaugcuuggggagacugauuugaguaauaauaaaacucuggucuccugcacagcuggcucugcgugaguuacucucucuauugcaacuccccugucuugaugaaucgacucugucuaggcagcgggcaaggugaacuccuugggcgguuacgguggguguuccaguagaagcccugagcugugcaugggauccaggcugugugcuaaucucauauggcagacccucagcuuacaguagagagggacucuuauuacacaacaggaugggaccuaaggggaugaucugaaauauuuccuccaugugcaaggaguacaggugcaaggagguggcaaguuagugaccuggcaagagcagccugguuucccagcuucuucucccaucccucacucuuucucaagucacaauacuuuagucuucauauaacgaaugcccccagugaggcugaugcaaaauugauguuguucuguucuuuuuccuaggaaaauaaguuaaaauacagcacaaaaugcuuaacuuagcucuuuccacaucuacugcaaaagaaugccaauaagaaaaacguauuccagagagaaaggaaauuguagacuuuguuauuagcauuggcuaauuugguuaaaucacuguaacuaaaauaaauuauuaauuuguuguguauuuuauauucagcaagaggagaacgguucaauuuauuuugagcaaagaauucccuuauuccagugcuaugcuaaugaaaugcuacuuuuagcuuuacaaaucauuauuuaccuguuaauuggcuuuggggaauagcaguuaaaggcaauaaaaauggaaagcuuuuuuaaaagacaagggcaaaaaguggugaggaaagaaauaacugaauuaucuauuuccaagaguucaagaacuucucuaaccucagaauaugaagauuguauuuaacuauauuaaguagcuauggucacugcaacaagguuagguaaugaugaauggcauucuaaguuaacuagagcuaaauuaucaaaguaaggcauauuguauuaaaacagccaaauaugaaaugaauuaaauauaaucacuauacuguuuguacucacuucagaucaaguuuuauuauggugaaggguuuauuaugguguggaugauuaaacugggaaagggagaaagaaaauaggcuagaaaggaaaggaguuuuccaagacuuacuuaaaaaaaccaauaagcugggcgcgguggcucacgccuguagucccaacacuuuaggaggccgaggugggaggaucaccugaggucagggguucaaaaucagccuggccaacaugaugaaaccccguuucuacuaaaaauacaaaaauuagccagcugugguggugugcaccuguaaucccagcuacucaggaggcugaugaggcaggggaaucacuugaacccaggagguggaguuugcagugagcugagauugugccacugcacuccagccugggcgacagaguaagacucugucucaaaaaaaaaaaaaaaaaaaaaaagaaagaaagaaagaaagaaagaaagaaaaagaaaccaauagauuucuguuauuuauuuucaccaauaacaagaaguuguuucagaagcacaagggcgaaugcuuggggacugcuugaugaaaaugaggugcauaccugugauuuucaaaauguguucuucggaacuucugggcuacacagaguaacuuaacaggcugcuuaaauaaauaugauccuggcgcccucugagauaagacccagcacagucucugggacauuuaauuucuuucauucccacuguuucuauaggauauuaaaaacaacaccacaaggguauauaaucuccaaaaugaaaacguaaaagcaucuuuuuggcuugaugagaacuaguuuuaucauauguacaauuacaaccuuaucuacaaauucuguuaaagagucccugggggcucuucagcugaggaaauagaacagguacccuugcagcacaaacacgcuuuucacuauuguucccaguguccccugccggcagcucauuggcaguccuucccaggcucugcucucugguaacauuugguuauuugaaggcccuugcagugcaggauuuuuucuaagcgacucaugcucagaaaaaucuccuacuuccuucucucuuccuuucuuaccacuaccaaaucuuuuuucuccacuuuauaaguaaauuucagcugagcacucugaucugauuacaaaauccauauuaaguuaugaauggugaugauacacuuacuaaguauaggcauccuuaauuggugcaauucuagaccauucaaaacauucuugcaccugugagaaacuuuccuuccagugcaaauguccuagauaacaagaaagguaaaagcuuuuauaauaaucuccaggaugggauggagcagagaaggaauuuggaggugcuguagccucuauagaguccuccaaaucaucugauagcuguaauuuggaagaucaagccggccagaauuuucuuguuuuccccaguauggauguguacgcuuccaggaauauaggggcuuaaagcuaaaccugaugggaaccccucccccagggacuggaaauggaaacaggcuacuaguccuaaaguucucuggcuuaaauacagacagcuuccucuucuuuuacauguggaaaauccgcacagaaucacuuccaagaucugggccaugguagcugaagucucaggauccuuacaggaggaugaagugggggaggugaagccguggaguaauaacuucugauuuuuuuguuuuucacccacgggugggagguaaguauagggaaggguuuucaauuucccuaugauuccacuaagaucuuguaaacaauauagauccccuguccuguagaauaagaaucucagaggaagaguuugagacucagugucccugugauccuuaccaucagaccagucugccauauacugaccugggaaaaggacagugguagguggaguucacuggacacuugggaacaucuauaaagaaacaaagaggcccagaugacugggugccauugggauaccaauccaggaccuuguuugcuugguaagauacaaagaggugauaaugguguuacuauaguaacaucucaauuuaauucccaauuauuuuuuucugaauaauacaguccuuuuaauacuuuuuuucucaguuuuauaaccauggucuggagucaaaaauuccugucuuuuacuauuuaaauuaagaacuuuaaaaauaaaauaaaaaaucauguauuggcauucucauagaugcaaaagucuauuaucucaacuuaccuaugauuucagcuuauuaaacaggauagcaauauucucuuuuguuuccuaaccauccaauucuacauuguucuauguuaauauauaagccaaacaaagaaugagucaagauaaaauccuguggagucccuacugcagauggugaugugaguuugggaaaaccugguaauucugaaguucuaauguaaacauucaauuugguaguuaaaggugagcauuuuaucuuucugugauugaaugucacuaaacucaucugauuaggggugaauagaaauaaaugcaguugauuagcuucagguuguaucuuuuagaauuacacuggauuuugcugcauuuuauugauuugaauagggaccaaauuuagaaauguagaauugaaguucagaucaaaauggaccugaacugaaaugguaauuaauuaaaaauuaauuguauugcauaauauuuaaauuuauuuuacugaauugaacuuaauagauuucaaucaaggacugauuccacugagcagaauuugaugcaguagaaucaaaucacuuuaagucuuauucaaaugaauuagauuuuauuaauuugaauggaauuuaagugacagauuauaugggaguuuguaauucugagcaguauuaaagaauaggccaauucacucuaaguuaacuugguucuggcuugucuuguggucacuggcacugcaggacccuucaguaauccuggcucauuccuuuacaccauggucuccagaaacaagugugauuaauaccaaagugauggaauggaaacauaugcuauuuguuucuuugauucuuuuuguuucucuuauucuuuuaacaacaguuguuccuuuccaaccucuaucuauuauaaaaauaugucuucuuuccuguccuaaugcaguggauaugauccauuuaguucaauguuaaacuaaguugugaugacggucuuuacgugcuuccugauuuuaaagaaaacgcuuuuauguguaaccauugaguugagaugcugcuaucaccuguuaagaauaguucaucuuuauguuuaaggaagcuauuugucauuucucauuuguuaggauuuuuuuuugcaugaaucaauacuaaauuuuauucaauccuuugucugcucuuauuaaaaugauaaaaguuuuuucuccuuuuagcguucagagauuuuuucuaauaauaguacuuuuaaaaaaaucgacuuuguugugauaaaucauucuucauacauaugguuggguuugcuuugcuauuuuguuuaggauuuuugccacuguauucaugaaugacuuuggccuauaacuucccuuuguuguacuaucauuauguuuuugguaucaaguuaauacuggacucaaagaaugguagggggggcuauguuggaauuauuugguaaacuaucugaggcucauauaauuuaguaucuuucauuauaagauuauucuuauauccauuucuauaaguuuauauucuaauuuauguuauauuccagguagauguuguuuuuuuuaaaugaauuugcucuuugcauuuaaauauuuaaauauauugggaaauaguuguguuuauaucccuuuucuucauuucuacuaauauauuuuccugcuauuuucugaccagucuagccagaaguuuauugauuuuguuagucucuucaaaaaaucaauuuguuggcugggcgugguggcucaugccuguaaucccagcacuuugggaggcugaggcgggcaaaucaggaggucaggaguucaagaccagccuguccaauauggugaaaccccgucucuacuaaaaauacaaaaauuagccgggcaugauggugcacgccugcaaucccagcuacucgggaggccgcggaaggagaaucgcuugaacccgggaggcagagguugcagugagccaagaucucaccacugcgcuccagccugggcgacagagugagacuccgucucaaaaaaaaaaaaaaaucuauuuguugauuuuuaccuacuguaugguugauuuucuuguucauuuauuccugcuuuuacaugcauuucauuuguucuacuuccuuuggauauauccuauaauccuuuagucuauucuuuuuaaaaaaaauaguuuuuaauugaucuauaaaaauuaaauacauuuaacacauacaacaugauguuuugaaauauguaugcacugugaaauggcucaguggagcuaaugaacauacgcauuaccucacguacuuaucauuuuuuguguacucucagcaauauucaaaaugcaaugcacuguauuaacuauaaugaucauguuguacaauagaucucuugaacuuauuccuccuaucuaacuaaaauuuuauauccuuugaucaacaacucugcaaccucccauucccuagccucugguaaccaccauucaacucucuaauucuaugagugcaacuuuuaaaaauuccauauauaagugagaugaugugguauuugucuuucugugccuagcucauuucacucaacauaauguauucuauguucuucuguguuccagaaaucacuguguuuaaauccugcuuucucuuuauccauucauccauucauggacgcuuggguugauuccacaucugggcuacuaucaauaaugcugcaaugaacaugggaaugcagauaccucuuugacauacugauuucaguuuuaaaaaauacauagcagguagagagauggcuggaucauaugggaguucuauuuuuauuuuuugaggaacuucuaugcuguuucucauaauggucguccuaauuuacauccccaccaaaaguguacaagaauucccuucuuugucuaauaucuuaagauggaugcuuggaucaauaauuuucagccuuucuaagcuuuuacuauacacauaagacuauaaauucuaucaaaauaccacuuuaggaauaucccucaaguuuugaauuaugcugucaucauuauuugauaauaugcacuaauuuugauuauuauuauuuuuaguagagacgggguuucaccacauuggucaggcuggucuugaauuccugaccucgugauuugcccgccucagucucccacagugcagggauuauuuagaaguauuuuuaaaaugucuaauuauauguuuugcuuuaagcuuuuuuuguaaaagugucuuuuuagcugauuuuuaaaauuuaauuggucauagaaaacaggauuuaugauaccaauaaccugaaauuuguugagauuuauuuuaaagaaucgagucuguggucaauauucaaaaacauuuuacaugugcuugaaaaaauauuuauuuucuaauaguacuaugugugcauugacucacaguuauuaauuaugcuauuuaauccuaucuggguugcccaguagguaaccaauagccacacgcagcuauuuaaaauuuaguuuuucagucucacuagcuauaugugcuaauggcuaccauauuguacagaaaauauuuugaucaccucagaaaguucuuuuggauacugcugcucuguacacuuaaugauuuuuaaaggcuucugaccuauaauuacugagacaucaauauuaaaagcuucuucuauaauacuauaucuuucaaucuucccaaguuuagcauuagguauuuucaguaauuuggaaauuuuuaugcuauuguaaugcucugaauuguaauuuuuuuuucucuuucauuugcauucguaucaauaggcucacaauagcuuuuuggaauuuguaaucuccuggccuuguuuucuaucaucuuucuuucagacuuugugguguccuuaauguuuuuaauaucucuuguguacagcacauaguuuuucuuuuuaauugucuaaaauuaucuuuuaacuggagagucuagucuauuuauugugauaacugacuuggacuuauuuccaaauauuuguaccuuuuuuucucucuuguuugcuuuuuauuguuacuaauguuuaaguauuuuuucuuccuucugaauugauaguuuuucuucauuccauauauuuucuacugguuuagaauuuugcauucucuuaaauaucauucuuuuaguagauacccuagaaaguuuaaauuucauauuuaacuuaacagugucucaacauaguauauuuauucucuuccuaaacaauacagcaauuuuauagcuuguuucuguuccuuacauauaagguauuucaucuauuuuuuagcuucaucuuguuuuccuuaaauaucacaaauuaaaguuuauugcucaauauugucaauguuugcauagauuuacugacauuuuacuauuuucuuuguucccucuuuuuucuaucucagacuauucuuaugagaucuuuuuuucucuagggucagaggguaguauguuaucauuauuuuguccuaaaaagucuuuauuuagacuuuauauauguguuuuuuucuggguggcauauucaaggucaaugguuauuuucucacaauaguuuguuucuucaggguuccauugucaagaagucaauggucaguuuaauuucaauucuuuuguaaauaaucuguaauuucugucuagcuggggauugcuuucauucuggcuuacauccacuaugaugccuuaaucugaaucuuaauuugcauguuuuuuugguucuggucaauuuuuagccaucauucaccaaaauaaggccucaccacucuuaucucuucuuucacaacuccaauuagagauguauugauugguugugaucuaaucuccuugcuuuuaauauuuuauuuuucauauuugacaacucucacugggcagauuucugggaaauuucuucagaaucuauuuuuaauuucauuguuccuacuuuagcuggguagaaacugcuauuuaucucuaacauuaagcuuuuaauuuuaucuauuauguuuuuauuccuguaauguuuauuugguucuuuuucaaauguuacccauuauuuuuaauaguauauccacuuuucucuuuaaaauuuuuuucaauccaauaauuucaauaccugaagauucuguaggacugaaaaugcuauuaguuaucucuauugauucacaauuacaguaucuuguuuccccauacauuuggugauuauuuuuucuuuugagaucauguuucuuggaaauaugucugugagaauccugugagguucaguagaagguaugucucucucagaucaucugcauuugcuuuucucagauacauggagacauuaccaaucugggaccucuuuaaaauauauuuucagcuugaguuuucuccaaccauucaaaugcugugaaguuaggcuguaaacaugcaucagaacuggcuuucuauuacauagcuucaagggauaauuucuucuuuguacucugagcuaaaguucagauaaucaaaauuuuuacauuaucuucuuuuguagaguggauuuuuccauuuucaguuuuguuuuucauugagagucuaacccccuggauuuuguuuuccauacagggauauuugauauaauuuauuacuuggcauggacccuucuuccucauauagccacugaaagaaaagcugcugguugcauggaacugacagaagccuuuaggucagcuucuggcuuuggcauucauuuauaaccuugguucaugauuuuucuucauuuuaggccucaaggaucuuccucaauuucuugcaugcucaaucauacauuuaaaaggauuuuaaaaauuauuuuuauuuuuaauuuuuuugagacgaagucuugcucuugucccucaggcuggagugcaauagcaugaucucagcucacugcaaucuccaccuccuggguccaagcaauucuccugcaucagccuccugaguagcugggauaacaggugccugccaccacaucuggcuaauuuuuguauuuuaguagagaugggguuucaccauguuggccaagcuggucucgaacuccugaccacaggugauccacccaccucagccucccaaagugcugggauuacaggcgugagccaccacgccuggccuuaugcauuuuaaaaauguuuaugggggagcacuuuuguuguaucuauuuggccuuaauuguauagucgaagucuguuacuguagguuuuaaagcaagggagaggcauggucaaggugauauuuuauuauacaaugugacauaaaggaaaggcaacaguaaauagaggaacuauucuacaaauuaggugauaaagacuuggaguaucauggaugugacauucugccuaacagacagagggaaaacauacuauaaaaggacauuaguaggauguguugaccugauggaucagcuagugguaaaugcuugguuucacgauuacgcaaaucugaacauuuugaaagaaaugucaguaggagaguguuaauuuugggggaaaugaacacuuuuucaguuuaauuuuauagagggugaauuugaugugccagugggucucaacuggggcuggcacuaccuccucagguaugauucggaaacauguguaaggugccacugauauguagugccucaggucccaugaaagcugaaugucuuacaauguguuagauaguucugcacaauaaaugucacaccucaaaugccaguagcacccugguugagaagcccucugacauagcaacuuggaaaugaggauguacaagagaugggacuuacgacuucaagagagagagagauuacaaccaaaucuuuuuuuuuuuuuuuuuuuuuuuuuuuugagauggaguuucccucuuguugcccaggcuucagugcaguggcaugaucuuggcucacugcaaccucugccuccuggguucaagcgauucuccugccucagccucccaaguagcugggauuacaggugccugccaccacaccuggauaauuuuuuuguauuuuuauuagagacaggguuucaccauguuggccaggcugcuuuugaaugccuagccucaagcaauccacccgucuuggccucccaaagugcuaggauuacaggcgugagccacugcgcccagccagaaccgcaucuuuaauucugugagucauccacagugacaacugaugccugagcaugggacagucuguggaauggggcacauggcuagcuaaggccccaccucuuagggugcugcagcaacaggagaggaagaaagaauuuaggaaagcagcuacaaaaugggaagggucuaggcaacgugauuugaagaauguuacuucucugaaaucugcuuucauucucauuucccacagccacuaguauuuguucccuauuuguguuaagccacaguucaugcagaacuuaguuauugcauuucuuccucugauucauguauuguguugcaguuacuuuaugugcucaucuucccuacagacugggaguuccaccuggacacugauucuguacuccagcuucuagcagguaaacgagcggugaguguuucagaaagguaaauguuccaguguuccaaggguaaagguuggccgacaucaucagauuugaggauuagaaucaucugagcggcagacucauguuucaggugaucaagcuuuaagagguuaaggugauauaagaaagcaaacaugaaugaucaaaacagaaaagccuucugaacauaaggagagagagacagaccagccaaagggugaugaaggagaaaguguggcuucugcaagauggggcgggguggcgggggguggaguucugaaugaaucuguagucaaaaguaaaagaaauugacaaagaaggaaagaucaaagcucugaugauuggaccaauacugaucaauaacuacaaucacuauuaugauauuuacuacuucuucccaacgugcuggggccugaaccaacuccacauaaacauugccuuggagaauaucucaagcugaguuugguuucuuaacccaauuugaugaagacacgaccaggagaguccagaaaaggacaagggagacaaauaagccuuaauauugagacuuucugaccuggccucuucuuuucuacuauuuaacacauuaagaaagaaaauaaaauugaugacauuaaaauacuuagccuugaccuuuaacccuauuaggucagugcaaaaguaacugcgguuuuuaccauugaaaguaacaucaaaaacugcaauuacuuuugcaccaacccaauacuuguuacucuccagacagucauguguuacuuacuaucugaaaaaugcauccauucuucaacagcagagcaagacgcugcuuaugcagcucaaaaccugaggucucauaucaagccugcuauuuagugggggcacaaauccuuuuuuuguuuauaacacaucaaacuggcagagucacacauuauucauccauuacccggucuuccucccaggaaacuaagaugcuaaagccuuucucgauggcacaagcaguuaauaaaaguggcacaaauucaaaguccuccaaucucacagaagagcaguaagaugacggaaaauucaauaacaauaauaaguggcagauuuuucaaguggguaaaagggacacauauaaacagugaaaucacuaaaauuugcccuuauucuuuuuuuccugacaacagcaggaaagacacagaauacauuuuuccuuguauguauuuaacuaaaacuuguuucguuagccuuuugauuaaccugcugguauuaaaugcaauucuucaaagcucuucacauuaugucaauuagucauuuuuuuuuuuuucuggcgaggcaaaugauaucaguuugauuguaaugaaugugacaaauuacucaauauucagauauguuuuugguuauugcugcuuugcaacucuggaugaauaauuugauuaagaugccuauuaggaagcaaaucucaaaacaucaaaaccaccugccucucugauuucaacucuuaaucuuuauaaccugccuggaugcaucgccccauuuucugugaagaaugaauuccuuauuuaucacugaccucuuucauuguucaaggcuuuugcucacgcuguuccagccggucugccaucuugcugcuccuuaaacacccaagcacauucccacuuuagggcuuggcagggacuauuuuugccaccugaaauucucuuuccuuaauauccucaaggaccuuucauccuccuuccuuagauguucuucaaaugccauuuuguuaggcuggcuuucacuuaauaaccuccaaagagcaucuuugcuucacuccauaacccuuauccuacuuuauuuaucuauuugcauuuauccaccucuaauauuagauacuguuuuguuuauuguuuauuuuguccccucccacuagaguuuaugauccaguagaguugagcuguuguuuugguuucugauaaauagcaccuguccauaguuaggugguuaauaaacauuuuucagaugcacgaauucaagucauuauucuauuucuuuuuucauaucuaaacacauuuuuaaaaaaagaaaaaagagaaaauaaauuuuaaaaaucaugcgcacauuuugaauucugguguuucgguguauuuuuuccuuucuuuaugccucagucuaucaguugaaauuggauuucaccugaggcaacuuuaucacaccuaaucaguuucucccagugucaguugauuaaagaauagcugcaauuuuucuauguaaaagguacagcaauuaugccacuuauauaaccaucucugaacauacauuugcagaaucuguauugguguucauaauugggcuuaucuuucaaacagccaucauccauaagugauaaucuuauuuguauuccuugugucauaacuuuauaucacaucucuauucuuuucuuagcagcauuaaaaucaaauuuuaauuacucugaaucuaucuuuucaggaagcucaauaaucuacuugugucuuacacugucucaaaaaaaagaguaaaccagggacuuguuuugacagucuacucuuaagauaugguagugcagguugauuugggagggcaggauuuggggcugacuucaguaugcagucagcucaugaggcuggcugaaacuaauuggccugcagagaagaggagcccauuuucuaacuagcacaaggcuuucuauauucugggagacccugguauagccaacacucaaugacaauucaguacaauuuucuacaccuacccuaucuaucaugcuguacaguuauaucaguguucagaaucaugacccaaggaaagacaauuuuacggaagugagaaauuuaaaaauuguauguagcugauuacauuuacaaaagcaggcgaaucuuaaauaaacacacauacacacaaacaaaagauuucuguauauauuugucaaaccaaauuguuuuucuauuauacuuuuuauucacaagaaaauucacauauaaggauuucuagguucuaugcacuuucauuucugggaaauccacuuauuggauuuccuggguucuguccugucugucuucuuuagguuuaggguaaugaguaauaaaagcugauaucuugacagauucuugggagacuauagagguacauggcauaacccacaaaaagggaguaaagcagggauucuguuaaagccuggcucguagucacaggcuuuacaaagagagacucggaagccuuccuaccuccacucuggucccacuaggucggcaguuaugucuccagcauagcauaaauccuacagaucugcaaggguaauguugacagccuagaggcucacaaaguaacucuguucucuaucuguggacagaggcagggggcugagcaccaccucaccugaagcagcugauucagauguccacuauuugacaguggaccccagagaauucuguuccuucccaaggauauuacagauccugcauauuccagccagugcaagaguggcugugaaauagagaucagugagugaggugaucacugaaauuggagccaggagaucuggacucuauuccaccuccauuaugaucauaacguuccauuucuuccucaggcucuuuccugcugucuaacauggggcauggacuuugaugaucucuguuucuggcuuuauuauuucaugauucuaugauuuuuuuuucugauuauguuuucagaagugaccuaauuggauuauauugccacaugucuauuuucuuuacauugcauauauuguaacaacauuauucacaccucuucucgguaacagaaauauucuucucauuucuucaucaaguuugccacuguuuuuucuuuucuugguagggaugagggguggaugaagucucauucugucgcccaggcuggagugcaguggcuuaaucuuggcucacugcaaccuccgcuucccagguucaagcgaugcuccuaccucagccuucugaguagcugagacuacaggcacccaucaccaggccuggcuaauuuuuguauuuuuaauagagacgggguuucaccguuguuggccaggcuggucucaaacucaugaccucaggugaucugccagccucggccucccaaagugcugggauuacaggcgugagccacggugcuggccugcuuuuucuuuauguauagauacaaacauuguuuuccuauucuaacuauucuauucuucuagcaaagagaggugcauuuucuuacaaacauuuauaaaaccuuguccugcuuauuggagccucggucacacugccuauuuccuguguaaaugucagcuucuuucuagaccgacgacuacucagcggguggaagccaucucacuuuaucuuugcagcuacaaagguucauaacaauaacucaguauauauucucugcagcuacuaggauucauaauaauucaguauauauuaaaugacuucaugaauucagucccaugacuacaauacacaccuuugguaaugcuaaugccacauaagucuagucccacucucucucucccuccugugaacuccaguuccauauucuuaacaauuuaauagauuucugcauuugguggugcuacauauacucaauuccaaugguuucacucuuuggccuuucaacaaaacacauguaucuauuugugucuaugcucucaggaacuuccuuuucauucuucaacaacugaucucauuuuuaaauucauggaaaaauacaggauaucagagagaaaugccucaccauucugucuguaggaauaccaucuucuccugucucuuacagcaguuuuuccuccuaccucuggccacuuccuggucuuaugguaggguucuacccuuucuccaucuucucaggagauguacauuauuauuuauucuuuauuucucuuaggauuccucccacuggcaucuaagacugauuaucuuacuuggaaacacacacacacacacacacacacacacacacacacacacccaacuccaaucaucacaugaaaauggucuuuguuaaggucuacuccuccuuccauuucauuauauccaauagaucuuugcauuuuuuauuuuaccagaccucucagcagcauuugaugcucaauauugucccugucauuccuuugucuuggaacagucuuuacacuuaaccuaugucccgagagcugguccugauuucuccuacuucucugguugcuauuucuguuagucuuaacuuuuuuuuuuuuuaacucaaacaaugaaaaaguuggcacuuuccaagucccgucuuucuaugcucccucuucuucugcuuucugugcugucucauccauauucaggccuucaguagacacaggacucacucauuuguacguuuaaaucagcucuuuccucugagacucagacucacauauccaacugucgauuaggcauccccacuuagguaucucaagcccaauucaaaugcacauaaaagucaugacugucucaucuacauguggucacuuuuugggauuuuggaccucuguuaauagcccaaauccauccauccugcuauuggagccaccaggaauugucauacacaaaacuuuguccacuguuucuuuuguccaugaccacccuucucuguguaugggacucagguguggccgugugccuguguggugaugauggagcccuagaggagggcgugagguccagcuccugaaucaaggaaauucugaccacuucucaaagaaauccaucugcuuugcagcugagaggaccagagugagcgcuaacgcugcgggagaagaaagguuuuagucugucuaggagaggaauauuggagaacuggaucucaucaccacuguuuucaauuucauuuuuuccacacuguguuugaacagcaggcacuggcuuuuccacugacugucauuacccaccuaaggaaauacacaguuagggaaagaugcaagcaucuauguguaguaauggggaaaaauccaccccucaaacagcuccacucacauccccaucaguuggcaucuccuauuucauggccaccacagaggcuguaaaagugggcaaagcauuuuauuaugcugcuguauuuuucuguuuacuucagagcauguguuucucuccaguaucacucaucuccauaauauauaguuucaaagacacaauuucaugcagaugugggagaaauagaacaacaaauucaaagcuccucuugccaucagucuuuugauuacagugcccuuuccagagagguaaacaugacacuucccucagccccuacacggacuuauugcacaacuagauugcugaauuuuuauugcaggacugugccugcccuuguuuaaaauuguuuugaccuuuggaagagcacgcauuaaaaaaaaaaauuuccaucuuucuccagaauuaguaagcuguaauaaaaagaggaaggcaaguuugucauaucugaauggugccuggcagagucagagcaaauacuugcuugacaacuucauuuugcuccuggaaagagcugcuuugugacccuggcucugaaugccagcccuguguaaaugaugccuucgucgucaaaguccagauggcagcuccuccggccaauguugccuuauuucacauggaaucacaaucccaugagugacauucagucuggagaagaagcugucggaaauccccuguguaucaauuugcuacuuugcaaguugaaagcacuuaaaaauuaccauguucagaaauguaccauacauuguauaagggugaauuuguaaggauugcaaaauuaccguuuacuacaucacugaggccgaaagagagguucucuucaauaacaacuaugguuaguaauaaaccaacagaagugugugucauugugaaaaccguaacagagucaguaccaaaaagagcaaacccauccaaaugcaaugugcaagaauauuaacuaacaucuucauugagcccugucagaagaaagcuggugagaacaauacuaaauaaaacauugaaacugagcccagaagcuucaguuugguaagaauuuauucaguaguauuauggccugccacugucagacuuaaaagaaaacuaucucauguugaauauucucaaaaggauuugauguauguugccuuauucuuuccagaaugaaaucagagugacuuaaaaagaaucuaaaaggauccuuucuccccaucagaaacaaagaaagauuagggaguaacaauaacgggccaaguauaauuuauuaaacuagaauaaguuauuuccuaaaucuauaaaaguauuugauaaaaagacaaaaauaaacuugaguuuucagagaaaaaagacccuaaagauugcuaaaaauuuuugauauauaacaaacaauaacuuucuuucaaggaauacaaagacaucucaaaaaaaaagaauaauucaaauuacuaucaaaugauuacaacauaaguaauuagcaaagucaaguggcugguagggaggcugagucaaauacuguauuagaagcuagagaacaagaauuaauuugacauuguccuuaauuugaagagaaaaucaucaucaucaucacuaucaucaucaucaucauuuacugaacaauuacuagguguucagcuguuuuaggcacuguacaaauagauaauuuuccaaugaguaauaaaauagaauaccuauacaucacuccacuaaaagaaaaagaaaaaaaaaaaaacccuaaacuuccaaugcuaaacuuuccacugaaaaacauaccuaaagauggcuggaaaaauguuacuaccauagcugcaaaaaccaucagcauacucaguuucgcccuaccaaaauauaguaauuagaaaacucaguguuggaaaccaucaagaugacaggcaggacucuucuaaacuuugccuauagcagggcaccaugcuuuaauucuccaauguaggguauuaaaugguaauauucgagcagccagcaaacacuggugucugccaauuuaaaugauuuaauaucuuuuaaagauuagaaguaauaaacuagagcuuaaauauacagaaccaaagaccacaugcauuucaacugcugcaagagguaaaaaacaacaacaacaaagauaaacaaacaaacaaaaacaaugaaaaaaaaccagacacaacccagcuaguaucucuaauuuguaauuagaaaaaaugaaagccuuugucagguguucauuuaacaaagugucuugagcuuaucuaggaggaggaacaauucaauuauuuauaaaaauuaauuuucaaacaguacccuuucucuuagcuaugaaauaaaugaaggguuuuaccaaaacuuuucauuuagaaccuucuagggcacaaaauggaugagugauagaauauuuacuucgguuucaaauauuaguuaaguauucucuaguucuuuuauguucuuuuccauuacuuuuuaaauguggguguuuuauuaaugagaaaguccccauaugguguucauaauguuuagcucagugcugggcauagcagcuauuacacauggauggacugaccgauugguuaacauuuacucugagaccugagaaagaaggaaaaacaaaaaggcucuggcagcuggcaguuugcagguaccagccagacugagguaacagcuagacuccugaacauaauacaauuccauagacuaucagcaauaaucaaacagguucacuccaugaucauggccaaacaacacaaaaaagccuucguugugucugaacaccaaaaccauguguggccacaaaaauaaccgaaaaacucccucaucuggcuaaccugacuggcuaccacuuuuuucccaaugacaaacagccccacgugggcccuccugcuaucaauuugcauccauuccugagcaccacccaauccacaacaaaucuucacucccugaaaucacccgacaccagccccaauccuauaauauccuccucuccacauucccuuacaaggaugccccguaguuccccacagugcacaccccccucuaauguuccuguucuugcaagcccacagacccaccuuucuguggugugcuccugguggucucaggcuggugggaauuaacaaacuaaacaucacaccaauaauaagcacccuacguucaggcuuccuagaaaacaucgucucuaccuuaugaugagccagagauugaccaaacagagcaaaguaggggaauaucacucccccuaacugcuauuuaaaaaaaaauguggagggaaaggaaggaauaacaauaauauuuguauuacaauuugauuccaagguuugguaaagcacauaauaacuaacuucagccacuuuacccauuaucugguguuauugaagagggguugguccuuuucucguucuacaauaggaaaaauugcuguccccauucucucugguauaccacacaaacacacacaaaucgaaguucccaugcaaauaaacauuauuuuggcugagcaauauacauuuaaacguuuuucuccucugcuuuugaaaugauaaaaaaagaaacaaaacuuuucgcacagcagcacuaauaauaauaagcaauaagaggaggacaaugcauaagaaaaaagcccaauacaugucaguaagcaaaggagacaccaaagaagagugaaauaaagauggagaaaagaaagugacgugagagagcaggacagagagacagggagagacacucacgcauucgaaggagaauggaaagcacggggcagaguguucucuuccgguagguugucaggauuuacuuuucauucuuuuauauaaguuggaacuuauuugggucccaauguguauaaaauaaauggaauaauuuucaguucugcagugauaggaucagagugauucaguaugauuuuuaugguguugacauuuagcccuagaugggaccacagaacuuuuauucuuuaccucuguacucucaaauauuuuauucacugaagaauacuccuuaauuguguuguuaccacuuuuaucugcuucugaagguagggucacccagaguaaucugaugcugaaaacaucccaaaauguaaaucuaucccuccugcugaaguagaaaggguuauguuaagcauuuuuaaaaccauaauuauuuauuuuauuuuuauuauuuuuguagagacagagucucacuauguugcccaggcuggccuugaacucaugggcucaagguauccuacuaccuuggccucccaaagugcugugauuacgguaugagccauugugccuggucauguuaagcauuuuuaaaaauuacuuuguuuuauuuuccccaggucuauucacuggaagcauuuuugauaugguuuggcucuaucuccacccaaaucucaucuugaauuguagcucccauaauccccauguguugugggagggaccuggugggagguaauugaaucauggggcuggguuuuuccugggcuguucucaugauagugaauaagucucacacgaucuguugauuuuauaaagggcaguuccccuguacacaaucucuugccugcccggaaagacaugacuuugcuccuccuuucccuuccacugugauugugaggccuucccagccauguggaaguguaaguccauuaaaccucuuuccuuuauaaauuacccagucuuggguauguacuuauuagcagcaugagaacaaacaaauacaguaaauugguaccgggaaaugguguacugauauaaagauaccuaaaaaugugaaagcaacuuuggaacuggguaacaggcagagguuggaacaguuuggaaggcucagaagaagacaggacgauguaggaaaguuuggaacuuccuagagacuugugaaauggcuuugaccaaaaugcugauagugauauggacaacaaagucuaggcugagguggucucagauggagauaaggaacuuguugggaacuggaggaaaggucacucuugauaugcaaagagacuggcagcauuuugccccugcccuagagaucugcggaacuuugaacuugagugagauaauuuaggguaucuggcagaacgaauuucuaagcagcaaagcauucaagaugaagcagagcauagaaguuuggaaaauuugcagccugaugaugcaauaaaaaagaaaaacccauuuuauggggagaaauucaagccuacugcaggaauuugcauaaacaaacaaacaaagcugaauguuaaacaccaagacaacagggaaaaugucuccaggacauaucagaaaccuucauggcagcccuucccaucacuggcccagaggccuaggagggaaaaaugguuucaugggcugggcccagggccccccugcugugugcagccuagggacuuggugcucuguguccaagcugcuccagccauggcuaaaaggagccaaaguacagcuugagccguggcuucagagggcacaaaccccaagcuuuggcagcuuccacaugguuuugagucugcaggaacacagaagucaagaauugagguuugggaaccuccaccuagauuucagagaauguauggaaaugccuggauguccaggaagaaguuugcugcaggcacaggccccucauggagaaccucuccuaggucagugcagaagggaaaugugggguuggaaccccccacacagaguucccacuggggcacugcauaguggagcugugagaagagcgucaccguccuccagaccccagaaugguagauccacugagagcuugcaccgugagccuggaaaugcuguagacguucaacgccagcccaugaaagcagcugagaugggggucuauacccugcaaagccacagaggcagagcugcccaaggcugugugagccaaccuuuggcaucauugugaccuggaugugagucauggagucaaaggagaucauuuuggaacuuuaagguuuaaugacugcccuguugaauuuuggacuugcauggagccuguagccccuuuguuuuggccaauuucucccauuuggaauggguguauuuacccaaugccuauacccuccuugaaucuaggaaggaacuaacuugcuuuugauuuuacaggcucauaggcagaagggacuugccuugucucggaugagauuuuggacuuuugaguuaaugcuggaaugagcuaagacuuuggagguccguuggaaaggcaugguuggcuuugaaaugugaggacaugagauuugggaggagccaggggcagaaugauauaguuuggcuguguccccacccaaaucucaucuugaauuguagcucccauaauccccauguguugugggagggacccugugggagcuaauuaaaucauggggguggguuuuuccugugcuguuccugugauagugaauaagucucacaagauuggcugguuuuauaaagggcaguuccucugcacaugcucucuugccugcugccauguaagacaugccuuugcccuuccuuuguguucugccaugauugugaggccuccccagccauguagaucugugaguccauuaaaccucuuuccuuuauaaauuacccagucuuagguauguccuuauuagcagaaugagaauggacuaauacaauuuuauauuuuacauuuuucuuagcuaaguccaaaggcauacuaguauacacucccuaucuuuuuauuuuaacaaacguuucugguuagagcuccuuagugguaaggaguccaguuaguguuacuaauuuuaguuuucuugaucccaagcuggagcguggauuccuauuccugucuaucaggauagauuuaaaauguuagcuuuuauuauguauaaguacaaucaauuaacauuauuggugaccuaaugccaaacucaaauuuuuguuagcacuuuuacuuuauugaauguucauauuuaggcuuugaucagcacauguauugaaugguaucucuuaucugugcauaaaucuaaagagacaugaacuauuuuuucauucacacaaugccuacuaacaugcuauauauuuguguuuuaauuauuuguacauuuuucuuuuuuccucuuguuuggcauuuauagcaagaauuucacaugagaaggauacuugauacuugggaauauuugauucugugguaagauggaauugaggaaguaaucuacgcccccaaaaaaggguguuuguuggauaaagguuuuuuuucuaauucuuaagucaaaagcuucauaguauaaugaauugaaucaagauuuacuuucuuuuugaaugucauuuugugacgauucaugaaugagcaauuugaacuagaaaguuacggccaaaacaccaaaaauccuuccaggaaucuaucaugauguuuauuuguugaaagagcucaucuccagauuugcccaucuugcugccacccucagaagguagauugguuagacuggugagucaguagaaugcuaggcaaagguaauucugcuucacaauaaaaaagaaauaaagacaucaaaucauaagcauaaguuaaauaauauuuacucuccuauucgguucuguaguuuucuagugaaugauuuuaggcuuauauuuucccugaaauuggugcuugugggcuucaaaaauauaaucaacugcuaaaaagaagaauuacaaaguuggaucugauauguuaacacucaacugauaaauagucccaaaauucugugguaugauaacaucagaaauugaggaauuccaaaauaaccaaaucaugccuuauauguuauuucaguaaauuggaacacacagggugggcagguuucucuuucuccacagggcauuugugauagucaaagaauguagggugggccaaggaggaguagauucucuuucuggcucugccacuggcuuuuuccugcuagggacagugguaauuuaaaaaucaauuucacucaugugaauaaaaguuaaaacacguacgaaaaaagcauuacccaggagcaugucgagguaguggcuccaaccaaagcaagaaauccagagcugaaggaaagacaccagaacugggaagauaaagacagagaucauugaagcagaugugagaggagcuggccugugcaaauugugcaaaauaaauucccgaacuauucggccacgacucacauagucucaaagugaagaagaguggauagcaugugugcuuuggaggaguaauagggcaggaaugaacucaagaaugaagauaggguuaaaaaaaggggcaaaaaaaaaaaaaagagaaaggaauggagaagaauggguggauaaagaaauuguacccacuucagugggcagcagccccuguggacgugccaagccgguuguaauggcuguagugggggcugauaccccaaugagggcaacugaggcagaggaggagucccaggaggggaaaagaaccaauagaccuucuggcacugacgucuuuaagucccauaauacuggacuggaaaauaguagcuaauauuacaguucaaaugaaauagcacauguacaagcauuuuguaaagcccgagcccaguaaaauaucuggggcagggggccauggaggagaaggaauguggccuucaggucagacagacuuaaguucaaauccugccuacuuuugcaagacuuuagacuaguuaccuaauuucccuggcaucuuuccccuaauacaaauagcaacaacaacaagucacaugguuaaaauaucuaguaaauucuuucaauacauaucuaaaucauauuuaaauuauuuucccauuaaaugagugaaauguacuuuccaaaauauuaccaaacugcucaaauagagaucaucuggaagggaggccagugaugguuggucugaguucaugggugaccgaggggccauaauuacuccaaacaccuucuuugccaagcccagccaaaaguaaggcuaugcuggaaagccuccuuccuuucuuaccugggaccagguaauaguugaggguagggggagaugcuugguuagccugagggauaggagggacucugaaaggaucccccuauccucagaccacggagguaagccagaauuuguauccccucgccauccacaaugucucuccuagggucacaacagaugccacaagaggaucccauccuccuuauguuccauuuuccuaggugacuuccaccuguucucaaggacaagaaguguauuguuggccuuggauguucuaucucugauauaagcagaagcagacuaaaaaaaugcaaagaauuuaugaauugcggcauauaaagauuugcauucucugauuuuauguugaaugccaggauugccuuggcauugggguugagcauguuuucucugccacaagguuuauggguugagaucucagcugugggaccaguaacauggccucucaacuuccuggugcaggagugugaaugacagauggucagcugcuugggauccaccaccacaucaauuucugggccacccuuuccaugggcugccccaggcaaugcugagcagggagagauacucaggcaggcccauuucugcaagauguggggcuccucauaugggcuacuuuagcucaaggacuucccaugagccuugccaaaauuuucuagaacugcaccagagacuaagaaauuuccuacccaaucuuccuuccuucccucuuuccuccauagggucagaccagcguuauggccugagucucucucaguuaggcuccugcaacuuccucaccaaauuuucaacauagaucaauaccauaaaucucuugcacauauauucuugucuuggcaucugcuucuuggaggaccugaacuaacacaacaauucugccauuuacuagcuguguuaccuugggcaucuaauaugacuuugccuuagucauucaccuguuaaauggaaguaauaauaauguccaucuuauaggaguguugugaguuuaaugucucccucaaccuuagcaaaauauuuaguacagguuagaugcugaauacauacuuacuggaugaucuuaaaaaauaaaagaagaucaagauaaucaauuuaaauggauaaacugaugagaugauguaaaauacucuagguuaaauuguaaguugauaugaaauugagcuaaaccagccaauccuuggcacaaacuuauuaucugcaaucuauguuuuacaucauuccauaggcuuuuuuaucaagcaaggaggcuagaaaagcaaaaccacaacuacagucauuauucagggacacuuauacaucccuccggaucaagagucaguuaugacacugcaguuuauuuuuucacuucccuuccuuaguuauuuugaaauuacuacugucuugugagcugaaauuaacauccauuuauucuuguacuuguuuuccuugacggugaugugcugauucucccucuuccaggguugauucauuucuuuuucacuuugucugcauaaauuuggcuuuuucaguaguuguacuuugaaauucucauucucuuaacacauuguugucaacuuggagauuucccuuugauccauuuucucaaaccauuuuucuucuaugaaacuuacacugcaagcaauaucucaugaucaaacuauacacuaucauccuacuuuauaccuucgauaugcacuuuaauagacuuguuuucauuuugaaaaugacaugcugaugcagcaacaauuugauaaugcacugugucauauacacaguaauuuacuucaggaucacuguagcuguugaaagguuuuaucuuuuucuauauauuuucagcuuuaagagaacugcuaaaguggcugcauugaaauggaaagauagagcuccauuccaagacggccgaagaggaacaguucugguccgcagcacccagugugaucgaugcagaagauggaugauuucugcauuuccaacugaaguaccugguucaucgcacugggacugauuggacagugggugcagcccauggagggugagcugaaguagggcaggcguugccucaccugggaagugcaaggggucaggggauuucccuuuccuagccaagggaagccgugacagacuguaccuggaaaaauaggacacuucugaccaaauacugcacuuuucccaaggucuuagcaaccggcagacaaggagaaccuuucccaugccuggcuuggagggucccaugcccauggagccuugcucacugcuagcgcagcagucugagaucaaacugcaaggcagcagccuggcugugggugggguguccaccauugcugaggcuugaguagguaaacgaaguggccaggaagcucgaacuggguagagcccaccacagcucagcaaggccuacugccucuauagacuccaccucugugggcagggcauagcucaagaaaaggcagcagacaacuucugcagacuuaaacaucccugucugacagcucugaagagagcagugguucucccagcacaguguuugagcucugagaauggacagacugccuccucaagugggucccugaccccuguguagccuaacugggagacaccucccaguaugggccgacagacaccucauauaggcaggcaccccucugggaugaagcucccagaggaaggaucaugcagcaauauuuguuguucugcaauauuugcuguuuugcagccucugcuggugauacccaagaaaacagggucuggaguggaccaccagcaaacuccaacagaacugcagcugagggaccugacuauuagacggaaaacuaacaaacagaaaggaauagcaucaacaucaacaaaaaggauauccacaccaaaaccccaucuguaggucaccaucacauagaccaaagguagauaaaaccacaaagauggggagaaaccagagcagaaaaaccgaaaauucuaaaaaucagagcaccucuucuccuccaaaagauugcagcuccuugccagcaacagaacaaagcuggacagagaaugacauugacaagcugacagaaguaggcuucagaagguugauaauaacaaacuucugagcuaaaggagcauguucuaacacauugcaaggaaguuaaaaaccuugaaaaaaggcuagacgaauggcuaacuauaauaaacaguguggagaaaaccuugaaugaccugauggagcugaaaaccauggcacgcgaacuuugugaugcaugcacaaucuucaacagcugauucgaucaaguagaagaaagguuauuagugacugaagaucaaauuaaugaaauaaagugagaugacaagguuagagaaaagagaguaaaaagaaaugaagaaagccuccaagaaacaugggacuaugugaaaagaccaaaucuacguuugauugguguaccuaaaaguaauggggagaauacaaccaaguuggaaaacacucuucaggauauuauccaggagaacuuccccaaccuagcaaggcaggucaacauucaaauucaggaaauacagagaacaucacaaagauacuccucaagaagagccacuccaagguacauaaccgucagauucaccaagguugaaaugaaauaaaaaauauuaagggcagccagaaagaaaggucggguuacccacaaagggaagcccaucagacaaacagcggaucucucagcagaaacccaaaagccagaagagaguuggggucaauauucaacguucuuaaagaaaagaauuuucaacccagaauuucauauccagccaaaauaagcuucauaagugaagcagaaauaaaauccuuuacacacaagcaaaugcugagagauuuugucaccaccaggccugcccuacaagagcuccugaaggaagcacuaaacauggaaagaaacaaccgguaucauccacuacaaaaacaugccaagugguaaagaccaucgaugcugugaagaaacugcaucaauuaaugagcaaaauaaacagcuaacauaauaaugagagggucaaauucacacauaacaauauuaaccuuaaauguaaaugggcuaaaagccccaguuaaaagacacauauuggcaaauuggauaaagagucaagaccuaucagcgugcuguauucaggagacccaucucacaugcaaagacguacauaggcucaaaauaaagggauggaggaagaucuaccaagcaaauggaaagcaaaacaacaacaacaacaaaaaacaaaaaaaaaacagggguugcaauccuagucucugauaaaacagacuuuaaaccaacaaagaucaaaagaggcaaagaaggccauuucauaaugguaaagggagcaauucaaaaagaagagcuaacuauccgaaauauauacgcacccaaccaaaacaggagcacccagauucacaaagcaaguccuuagagaccuacaaggagacuuauacucccacacaauaauaaugggagacuuuaacacccuacugucaauauuagacagaucaaugagacagaagguuaacaaggauauccaggacuugaacucagcucugcauuaagcagacuuaauagacaucuacagaacucuccuccccaaaucaacagaauacacauuuuucucagcaccacaucacacuuauucuaaaaaugaccacaaaauuggaaguaaaacacuccucagcaaauagaaaagaacagaaaugacaacagucucucagaccacagugcaaucaauuuagaacucagcauuaagaaacucauucaaaaucacacaacuacauggaaacugaacaaccugcuccugaaugacuacuggguacaugacgaaaugaaggcagaaauaaagauguucuuugaaaccaaugagaacaaagacacaacguaccagaaucucugggacacauuuaaagcaguguauagagggaaauuuauagcacuaaaugcccacaagagaaagcaggaaagaucuaaaaucgacauccuaacaucacaauuaaaagaacuagagaagcaagagcaaacacauucaaaagcuagcagaaggcaagaaauaacuaagaucagagcagaacugaaagagauagagacacaaaaaaacccuucaaaaaaucaaugaaaccaggagcugguuuuuugaaaagaucaacaaaauugauagaccacuagcaagacuaaugaaaacagagaagaaucaaauagaugcaauaaaaaauuauaaaggggauaucaccaccgaucccacagaaauaaaaacuaucauuagcgaauacuauaaacacuucuacgcaaauaaacuagaaaaucuagaagaaauggauagauuccuggacacauacacccucccaacacuaaaccaggaagaaauugaaucucucaauagaccaauaacaggcucugaaauugaggcaauaauuaauagccuaccaaucaaaaaaaguccagaaccagacagauucacagccgaauucuaccagagguacaaagaggagcugguaucauuccuucugaaacuauuccaaucaauagaaaaagaaggaauccucccuaacucacuuuaugaggccaacaugauccugauaccgaaggcuggcagagagacaacaaaaaaagagaauuuuagaccaauaucccugguaagcaucgauggggaaaucuucaauaaaauacuggcaaaccgaauccagcagcauaucaaaaagcuuauccaccaugaucaagucagcuucaucccugggaugcaaggcugguucaacauaugcaaaucaauaaauguaauccaucacauaaacagaaucaaugacaaaaaacacaugauaaucucaauagaugcagaaaaggccuuugacaaaauucaacagcccuuccugcuaaaaacucccaauaagcuagguauugauggaacguaucucaaaauaauaagagcuauuuaugacaaacccacagccaauaucauacugaaugggcaaaaacuggaagcauucccuuugaaaacuggcacaagacaaggaugucuucucucaucacuccuauucaacauaguguugggaauuauggccagggcaaucaggcaggagaaagaaauaaagggcauucaauuaggaaaagaggaagucaaauugucccuguuugcagaugacaugauuguauauuuagaaaacccuaucgucucagccccaaaucuccuuaagcugauaagcaacuucagcaaagucucaggauacaaaaucaaugugcaaaaaucaagcauuccuauacaccaauaacagacaaacagagagccaaaucaugagugaacucccauucacaauugcuucaaagaaaauaaaauacccaggaauccaacuuacaagggaugugaaggaccucuucaaggagaacuacaaaacacugcucaaugaaauaaaagaggacacaaacaaauggaagaacauuccaugcucauggauaggaagaaucaauaucaugaaaauggccauacugcccaagguaauuuacagauucaaugccauccccaucaagcuaccaaugacuuucuucacagaauuggaaaaaacuacuuuaaaguucauauggaagcaaaaaagaccccucauugccaagaaaauccuaagccaaaagaccaaaacuggaggcaucaugcuaccugacuucaaacuauacuacaaggcuacaguaaccaaaacagcaugguauuggugccaaaacagauauauagaccaauggaacagaacagaggcaucagaaauaacaccacacaucuauaaccauuggaucuuugacaaaccugacaaaaacaagaaauggggaaaggauucccuauuuaauaaauggugcugggaaaacuggcuagccauauguagaaagcugaaacuggauccuuucuuuacaucauauacaaaaauuaauucaagauggauuaaagacuuaaauguuagaccugaaaccauaaaaaccccagaagaaaaccuaggcaauaccauucaggacauaggcaugggcaaggacuucaugucuaaaacaccaaaagcaauggcaacaaaagccaaaauagacaaaucagaugugauuaaaccaaagagcuucugcauggcaaaagaaacuaucauuggagugaacaggcaaccuacagaaugggagaaaauuuuugcaaucuacccaucugacaaagggcuaauauccagaaucuacgaagaacugaaacaaauuuacaagaaaaaaaacaaccccaucaaaaagcgggcaaaggauauuaacagacacuucucaaaacaagauauuucugcagccaacagacacaugaaaaaaugcucaucaucacugaccaucagagaaaugcaaaucaaaacuacaaugagauaccaucucacaccaguuagaauggugaucauuaaaaagucaggaaacaacagaugcuggaaaggauguggagaaauagaaaugcuuuuacacuguuggugggagucuaaauuaguucaaccauuguggaagacagugcgguaauuccuuaaggaucuagaacuagaaauaccauuuaacccagugaucccauuacuggguauauaccaaaaggauuauaaaucaugcuccuguaaagacacaugcacacguauguuuauuguggcacucuucacaauagcagagacuuggaaccaacccaaauguccaucaaugauagauuggauuaagaaaauauggcauauauaccccauggaauacuacgcagucauaaaaaaggaugaguucauguucuuugcagggccguggagaagcuggaaaccaucauucucagcaaacuaucacaaggacagaaaaccaaacaccacauguucucacuuauaggugggaaaugaacaaugagaacacuuggacacagggcagggaacaucacacacuggggccugucagggagugggggccugggggaggaauagcauuaggagaaauaccuaaaauaaaugacgaguugauggguggagcaaaccaacauggcauauguauaccucuguaucaaaccugcacguugugaacauguacccuagaacuuaaaauauauauauauaaaaauauaaaagaaauggaaagauacuuugcuucccuuauaaacgguuaauuucuuggauaauaccuuuggaaaucaguuuguaucuuuaguguugugaauaacuugagcuugaauuccuagagguagcuauaucauauacaaucagugguuugaggaauacuccaaaugacaguaauaagacauguauuuuuuaaaguucacuuccuuuuaucauuuugguaacaaauaccuuuuuacaagguacaaugacaaaacaaucauauguguguguauguguauauguguguguguguauauauguauauauauaugaguggucucagacauacuggccaaagcugagugcuaauguaaggggucccaguuauaaagauuuuaagcugaagaaccucaacccuaggaaguucuccuauuagauuuucucccgacugcccucuuuagucacacagaugcaauaaagaaguacauuauaggacauuauaacaaauuguaaauuguuaguaugcauuauuaugcacacgaaagaugcauguuauaggaaauuuauucugugauuucggauggucuuggauacgacacaagccaaauagaaugcuuggaggaguacgggggaaugguugaaauugaugcaaaugacuagugauuugaaauuggugcuuauauuuucaaguuuuccuaguugcauuuuaaaccucuaaugcuguaaucacaguuaugugucaggcauuuuauaacccaugguuugucgggcuauuaucuuuuuugaugauggacaggccaaaaggauguggucgguuuucaaagcuuccuugaagugguuugcuggaauacuguuucaucggugauuagauuauagcugcauuaccacaaaauaccauauuggcuaacuaacuccuauccuucgugucuuaauuuuuuuuuuuuuuuuuuuuuuuugugagauggaguuucacucuauugcccaaguuggagugcaauggcacgauccuggcucacugcaacuucugccuccuggguucgaacaauucuuccaccuuagccucccgaguacaccaccaugcccagguaauuuuuauauuuuuauuagacaugggguuuuaccauguugcccaggcugcucucgaacuccugaccucaagcgauccucaugccucagccucccaaagugcugggauuacagccaugagccaccacacuugguaaugucuuaauuuauaugccacuuuaaggauauuuauuuugggcccuuuagauuaggcuaggugucccagcguugccuucucuuaguacuugggaaucuuccuuucauugcauuaaugauucuauaaugcaauggcuguuuuaaauucuuuucucuucuaauuggauugcaaacuuugugagauuggugguugccuaaaucugguucaauuugugucaucaucagucuuuaggacaaaguugguaugugguaaauacucaauggauguguuggaugccuguguaacugaacagccauggagauuuaucugcauuuauuuugcauuuauuuaugcauaauuucucuguccuuuguguuaugaggcauuuauaagcaugggcuaggucuuauuuaucucuacagcucuauuacacuaauauaaugauucauacacaguggaaguucaaguaucugcugaaagcauggucugauggcucaauaaccaccauuauguuggaaaggcaaugggcuagguuccaagggaccauauuuguauuccugcuuugacagaaacugcuugugcuuugggaguagaagcuuaguucuuucucacaguagacugcucuuuucaucagaugaggugaaaauccuuaucacaaacagaagugugguugacauagaaaggaacaccuacaagaaaagcagcuggggugauauuaagaguucaauuuaguagacuagugaaaaaaagcuguaauuguuuuuauccacuugaggaaaagcuacaggaaagcaaacagugggucaguaucuuucauuccaaguugucaccugaaaucccuuugucaucaucuuaaagauaguuugauaggagagauaacacauagcacuuuaauucaggcuggacaauauaugaacccuguauuguugcauagaguuuccaaauauuguauuagugcauuuucacacugccaugaaugaccugagacucgguaauuuauaaagaaagagguuuaguugacucccaguuccucauggcugaggaggcaucaggaaauuuacagucauggcagaaguagaaggggaaucaaggcaugucuuacaugguggcaggaaagagagagagagagcaaggaggaaacugccaaacacuuuuuuuuuuuuuugagacagagucucacucuguugccuaggcuggagugcaguggugugaucucggcucaccacaaccucugccuccuggguucaagugauucucaugccucagcuucccgaguagcugggauuauagacacccaccaccacacauggcuaauuuuuuuuguuguuguugagacggagucucacucuguugcccagguuggagugcagugguguguucucugcucacugcaaucuccaccuccuugguccaaacgauucuucugccucagccuccugaacacugggauuacaggcgcagaccaccgugcccagcuaauuuuuguauuuuuaguagagaugggguuucagcauguuguucaggcuggucucaaacuccugaccucaggugaucugcccaccuuggccuuccaaaguguugagauuacaggcaugagccacugcacccagucuccaaaucccuucaaaguauuagauuuugugagaacucacucaccauccugagaacagcaugggggaaaccgcccccaugacccaaucaccucccaccaggucccucccuugacacauggaaauuacaauucaggaugagguuuggguguggacacagagccaaaccauacgaaauauuaaagccaccuuuuuuauugccaguuugcaauaucaguauaucuaucuuaauauugcauauauacauauuuaugagagacagauaaguaagaccuaaaucaucuauuguacaaaauucauuucuuaauggauaaugauacuauaaccaauucugugggcaauauuugccaucugcuuuauuucuuuuacuuuuguaaauuuuauucaaaguuacuuugcucuugagaagaagccccauuguacuaacacauucuuugaaaugaaucaucaagucaagagaugagauugaaagagguuagacuuuaccacagggacucccauaauuaagauggauauuaagagugauagcaagauaauaucugaacucuaguaauauuuaaaauaaacugacauugaggaaaacugucuuaaaauauguuaacucucugguuuucaaauagcuccuuggaaaaaauaaauacuaccuucuugugagacagcuuacaaacuugcauuauuagcugcacugcagaaaauaugacauguuuuuuuuuuuuuuuuuuggucuugaucuugucagcacaucauuaauuugcuauuaaacuaccugcuuuacagaguuuauuuuguagcacggcauggcuuuuuucucuccuuggugaucucaugagaugacaaauuacuauguaacauaacagaugacuagaacuuggcagauaugauauuucuguuguuuucccugcuuccauugagaugcugucgaucccuaacagcauuauaaacagauggcuaauuguuacgaagcuauguauuguuaaugcugaaacuucccuacuucuugguaacauaugcuugaaaaaaucaucuuagggcauuuauaaggauaaugcaaacccaggacuaguucuugagaagcgggaggacauucugaguuaucugugaacuuacaucuuauauucgcuuaaggauagaacuuugguuuccuaagagauaagaggaguucugacauagccuuauauagaaguuucccaggguugccgaaacaaauuaccauaaacuggguagcuucaaacaaaauaacuuaauuuucucacaguucuggagacuaaaaguccaaaaugcaggugccagcagggcugugcucucucucugaagucucuaggggagaauauuuccaugcaucuuacuaguuccugguaguugccagcaauccuuaauuccucuuggcuuguacacguagcuuuuagacucuaacuuuguccucaccuggcgcccucccuguguggcuaugucuacaugucuuucuuaugaggauaccagucauugaauuagggcccacuuuacuucaguaugaccucauccgaacuugauuacaucugcaacucccaaauaaggucacauucacagauuccaggaguuaagaauucaaccuaucuucuuuggcagugacacaauucaaucuacauaccaggaacuuauuaaacaacaucucaauaacauucaguuuucuucuuaguggagcucuuuugcucuaagaaaacagaagcuuuagcacuggaaagcuuuauuuccauguugaaaguauuuucauuuugauuaggccgggcgcaguggcuuacgccugucaucccagcacuuugggaggccgaggcaggcggaucaccugaggucaggaauuggagaccagccuggccaguaugaugaaacccugucucuacuaagaauacaaaaguuagcugggcaugguggcaggcgccugucaucccagauacucaggaggcugaggcagagaauugcuugcacccaggagguggagguugcaguaagccaagaucacgccacugcacucuagccugggcaacagagugagacuccaucucaaaaaagaaaaaaagaguauuuucauuuugauuaacguccaguccuuguccuugaaaguaauaccucauccaguucaacauacuugggucugaaaugagugcaaagcugauaguuuuaaaaagaucguacuguguaguuagaacuggaaaggcuucacagaguccagucucugaagggaauugauauuguccauguucuugcugugacucacacuauuuuaacaauagguacauaauuacuugcagccgaggcaaaucacuguugcuugaauguaauuuguauuagagauguauauucauauuagagauuuacgaauuuuucuagugcucuaucuggcuuuauugauauuuuguugugucagaguuuuauuucugaacuuuagcuucuaagugguaaaugggcuguacuucuuagaggcaaauauucccaucagugcuuaggaggccuguucucaaucagcaucaagaaucaaccgaaagcaggacuuccucugacgccaaguucuuggccauuuguugucuugaaaauccugacauuacaaaaccaacucaacaauuuaguuuuaauauuuaucagguuuauuuugaugaugaaccugauuagugccaauuggugagauuuuagagucacauucauacuagcuuuauaagaagugcaaauuuuuuucaaauugagugaauagcauuugaaaacuuuugccaacagccauguaauauguagauauuuagaugcucaaauagccuuggaggagaacagagaaaacccauuuuaaaagacugaauuucaaauguaguaaaacaacuaacauuaacauacaucuugcacggagacaaauguaagaauuccauguguuagaaaaauaacuacuuaauuugguuuaugucaaaaaauacaggaaacauccugauuaaccuuuacauaauuuuauuuuggcuaccgacuuuauuuuaauuaaacuaaccaagauaaaaaguucugacaaauauaccaaaacauuuaguuuacaacaacaacuuugaaaacacagccuggguuaugguuaucauucuggccuaauguuaccaauaaagucugucaucuucuuugucccagccucugucucucccuuuccugccuuucaucacauuuaugucuggcugugacaaacuuuccuggggaacccugaaaaauggacugauucugucucuugagacagauuuccuugggugagggguacacucaaaucuguagacuuuuaaggaagaucuggauuuucaaauauuacugacaaauauuuuccaaaaccuaaccaccccacuccccccaaaauuuccugaguuuuauuauuccuggaauuuuagcuguucuguaugauuacuccuuuaacagaaauauuuucccuuggcuauugccugauaagaaauuaaauuccaaacuuucuuucuaauuuuugacuuauacgaacaaaauguuucuagagcagaaaaaaaaaaaaagccaaacuaauucuaacauaauuacggcacucuuugugucaacagauaaguauugggcgcuugaaacaugcaaagccuugccucaaguacugcacacaggcuaucuuugguaccauuuucucucuuucccugccuucgaacauagaggaggauucgugugcaaguuaugaggaggguguuucggcauuuccccguccacauuuauucauucuauuuuuucaugagaagggugaguuaugauaugagaagggcgauuagugagauaggaaaagugccagggcacacaugaguccgcugcuuggccaauuucuuuucuucaaguucuccuuaguagcugaaaaugcucauguagugagucuggccugggcucugggccuuauuuuaugcucgagacuagaaaggugauuccaaaaugcagccaaggucuagaacuauggcugaacaagaaacccuauaugggcuccaggaggcagcagggucggccgguugaagaacugagaaauguaccuguuucugcguuggguuagcaagaaaaagcauuuaucuuggugauccagguggucuccucgaccucaaacuaaucaagcagagcucuguucuugggcagaaaaaccaauucuuuauugagucaggagagguucucccagggaguuuagacuggggacacaguuucacuucuguggguccuucauaguccauguggaaagggcaaggccuuuuacaaaaaauagguguucaaaucgacaugggcagaacaucuuuuuagacaccagagagccaaccuucaauguugccuccaccagaaaugggaguauaaguuuuuugcagggcugggcauuaguagauguuucaucuuuaauauauauuuuuucucaccuaggauuaaggaauggcuacccagggaaagcugaauuauguugcaauaggaaaauagagaguaaaagagaguuuuacacugcagauuuauuuauuuauuuguuuugcaauuguacuuauuuuuuuuuuaguagagaccggguuuuaccauguuggccagacuggucucaaacuccugaucucacgugaucuguccacuuuggccucccaaagugcugggauuauaggugugagccaccaugccgagccuacacuguaauuuuaauaguuaauguuaaucaaagccuagagaaguaacagcuuuuaauaaacaagaguaggagaagaagcauccagguaagaugacacucagagcucaguaauccuaggucugagaagaaacaaacaccuggcaauguaaguaacuucuuggugggagauuucuuccacuuaaguucaggcucagaagucaugcagagacacaaacuggcccagaccaguuggcuuccugggagucagaagguuuucuccuucucccccuucauuaguuuguucuucuuccccuagauacaaugaaaucuccaccaugacuuuuacacaccaacuagagggugaaucuacaucacacucuaguagagugagucuaauagaaauacaaugugagccgcauauguaauuaaacauuuucuaguaaucguguuaaagaaguaaaaagaaacagaugaauuuuuaaaagucaauuuucguguuuuauuuaauccuguauauccaaaauacaauucuuucaacauguaaacaauuauaaaugggcuauuuuauauucucuuucuugggcggugucuucaaaauucuuauguauuuuguacugagagcauaucucaauuuggccuuuucauuuuaauggaauuaauuauucuaauuagaaauaacuaauuuauacuuagguuccauguagcuuaugguugaaaaaguagaugcacauaccugaaauuguuucaaguagacuucaaagucuuccaauagugaauugagaaucaguuuuuaaauauaauuuuaaauuaauuaaaacacaaugaaaauucaauuccucugucacaguagccauauuacgagugcucaacagucacauguggcuaggaaccacugugcuggaugaugcagggcuagacugcacuauauaucugguucugagaacauaaccuugaaguaggggcuggggaguuuuauauuuucuaaauguuguggguaugcaguugauacuguaaugacuucauguauccuagccacucuuucaaaaaguaggguuugaagggccuaugucacaagagaaacacagucugagcuacuguuuugauuucugucugacacuugcuuccaucucuuuuucaguugguucagcacucagagugcagaaggggaugaugaaugaucaacuucuaaauccuuaugaaguuaaaaaauauauacuucuuugcuuucaagaagcuaguaaucauuuccaauaagucugcuauuucauugcacaugagcuuauauuguuauucuucaaggugaaauaacggcaacucuucucuacccauagucaacuuucccucagaaagaggaagcacauuuuuauguuaugaauccuagauagaagaauuagcugguauaauggccgaauugauguggagguaggcacacaagcugucagcacauaaacaucuugcacaguguguacaacugaucuaaaccacuguuaacuuuccacuagcaacaagcuugaauuguucucucugaauuuugaacgccauuuuuaaaaaccgugagauaauuuuucuacaagauaguuuagguuuucuaaaaguaacuucuagucuuacaaucuuucuacacuaagucaaacuuugcaacacucauucacuuugcagcauaaacaugcuuaaaaauguuuugagucuuaacaaagcacuuuauauaagcaaaugccuaaucagugaaauucuaaauuaaccauaaaaaagaaugagaaaaaauaucaagagauaaagguuaguauuuauagaucaucaaugccaaccaacagcuaauauagccuguuaaauuuuauggcaaugguucauccagaaauaauuguguuagaguucagauuaugaaaugacugugccaacccaaauucuagugcucacagggcaaagcagcuuaauuagugccuuuuaaacagaaauaacauauauaaucgagcuucuaauuuagauuccucuccuguaguauuugugaaaauucagaaaaggguuguguugaaauuuacuuaguguaggagauaaauaaauaggauuuuuaaagcgguaguuaaucuacucaagaaaaccauuguuaaagauuuaaaacacauuacuuucuacuaauguacaaauggguugucucuaugcuuuaaaucaggccguuuaagacauuuccuucguaacaguucuagccaugucucugaauuaggucuagaauugaaugcaauaaaucugcacuucuuuuaaaauacuacuuuggugauuucuaauucagacuugucuccuccccaauuaaucuucacuagugaguuaugauugaauauaaauggagacugucagucuuggauagugguggugcuacuuagauacuucagaaaauaaaugacauuaggagacaaugaauagaaagaaaaggugggaguagcacagccuuacugccaucugugacuuaaaaagacacuuuauugacaagcccuuucuuccuggagaauuuaaaugugacacaugaaguacaauguuccuuccaucugugggccaacuuuuaauguuucccugguccuacuugagcacuggauuaaagggguaggaguaaguggagaagaaaaagaaaagcagagagaggaugacagcagcagauccauagucuuacaaaauaauaucuuaaaugucuagguuucaaccagcagaggauccguagucucauaaaauaauaucuaaaaugucuagguuucaaccaagagucacucacaaugucaaggaccaggaagaucucaaagugaaugaaagaaaaagaaagaaaaucaauaggugucagccgugagaugacagagaugugagaauuaccugguacagauuugaaauuagccauucacugagcaauuacaaacauucuugcaaugaaugaaaacuagaaaaugcaaaaaauguaaucuuuaaggaaggcuuuguauagucuacucaaucucaacauuagaguguuaauuuuuuuauuuuaacguauuugaaauuuugaauggaucugaaauuuugucaagagucgacauuaagacuucuagagaaagauguguagcuauggguuuugucucaucuaaucauguugcuaagucacucguagaucaaggaaucagaacuuuucagaacaucuuaacauauuuuuggaaugauacagaaaacuuuucauucauaccuccucuguaauuguaguuugcaaaauaggaagaguggauggaaagaaauucuuggcaauaacaauuaagguuguggggcuauaacuaagaguguuugugauaagugcggcgagaucuucuuugauguaauaauuaacuacauaauucaugaauucauguuguaaaguguucggccaugugauaacaaccugaggaccgugagguugugcauaccucucuucacacuggaguucccaaagaggcaaagcacuaaaaauuaaggucgcaauauagacuuuuucaagcaacuauauuuugggacccaggauaaguaguucuuauacuagcuacauuugcugcugugcugcagccaaggaauacagugauuuuuuuuaaacaaaucagaaaaauaauuuauuauuauucuuauuauuuauuauauuuuaaguucuaggguacauaugcacaacgugcagguuuauuacauauguauacaugugccauguuggugugcugcacccauuaacucgucauuuacauuagguauaucuccuaaugcuauccuuccccccuccccccaccccacgacaggccuuggugugugauguuccccuuccuguguccaaguguucucauuguucaauucccgccuaugagugagaacacgugguguuugguuuucuguccuugugauaguuugcugagaaugaugguuuccagcuucuccauggcccugcaaaggacauuuuuuauggcugcauaguauuccaugguguauaugugccacauuuucuuaauccagucuaucauugauggauauuuggguugguuccaagucuuugcuauugugaauagugcugcaauaaacauacgugugcaugugucuuuauagcagcaugauuuauaauccuuuggguauauacccaguaaugggauggcugggucaaaugguauuucuaguucuagaucccugaggaaucaccacacugucuuccacaaugguugaauuaguuuacagucccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucaugugucuguuggcugcauaaaugucuucuuuugagaagugucuguucauguccuucgcccacuuguugaugggguuguuuguuuuuucuuguaaauuuguuugaguucuuuauagauucuggauauuagcccuuugucagauggguagauugcaaaaauuuuuucccauucuguagguugccuguucacucugcugguaguuucuuuugcucugcagaagcucuuuaguuuaauuagaucccauuugucaauuuuggcuuuuguugccauugcuuuugguguuuuagacaugaaguccuugcccaugccuauguccugaaugguauugccuagguuuucuucuagaguuuuuaugguuuuaggucuaacauuuaagucuuuaauccaucuugaauuaauuuuuguauaagguguaaggaagggauccaguuucagcuuucuacauauggcuagccaguuuucccagcacuauuuauuaaacagggaaucuuuuccccauuucuuguuuuugucaaguuugucaaagaucagaugguuguagaugugugguguuauuucugaugccucuguucuguuccauuggucuauauaucuguuuuggcaccaguaccaugcuguuuugguuacuguagccuuguaguguaguaugguuugaagucagguagugugaugccuccagcuuuguucuuuuggcuuaggauugucuuggcaaugcgggcucuuuuuugguugcauaugaacuuuaaagcaguuuuuuccaauucugugaagaaagucauugguagcuugauugggauggcacugaaucuauaaguuaccuugggcaguauggccauuuucacgauauugauucuuccuauccaugagcauggaauguucuuccauuuguuuguguccucuuuuauuucgcugagcagugguuuguaguucuccuugaagagguccuucacaucccuuauaaguuggauuccuagcuguuuuauucucuuugaagcauuuauuauuuuuuaaagauuuuuaccaaaaagcauuugaaaguagaaacauuucuuuuugcucaaguaaagguuaaucuugaauggucuuaaaauguugccucuuuccagaaaaggaucuuccccaguaauacauauaauuaagcugugcuugaaggcugaagcagccuauaagcuagauacugaagucucagcuaguuaucucuucucccauccauguacuagccaaaccaacccugcuuagcuucugagaucaggcauauucgggaugguaaggccauagacagguugccucuuccauuuuugguuuguguccauuucgcuugcacauccauuccaaugccuaacaugccuauugcuaaaaaggacuuaagugaaagugaugaccaucucacuugccuccugaccacaaauguggccuuggugacagaaagggcauggcuggguccacagagucccuggccugcucgcaggugugcagggcuggagaacagcuuauucaggaauuguccaagacaauagaacaggcaggaggaagagguuucuuugcauguuucuacuguacaaauggguguccuguggauacuuaucaaaauaaagacgugauucaucuuaaauuaucuggcucuaaauugauaaugcugcauagguauuuacauaaugacaagauuacuucagaaggggacagauaagaugaccucagaugaggacagucuggaguaaaauccugacucuuauucagcaaaccaagaauaguuguagugaaacagaucauguucuaaaagucuacacuccuguuaucucaaagaugauuaauuuguuuuccccuacaaacaaugaugcugagaaaugaaaauacucaaucuguugguauauuaacauucauaaucguguuuauugaaacacauggucauuuacuugaugaaaauguaauauuggccuugagauauuuucaucugugcagauugucauaaugauauuacuauauuaugcuaauggucacuuuacaaaaaugaaaguuauaaaauggcaacagaauguugcuguuuuaugccauuuuuccaguagaaucucaaugauguauuaaaucaaucauauuuacuauaccucuaggagaaauuuuacugaacaauuuucauucugauuuaauauacuuuucagaguacguagcuggagccuggcauaagugaugugaguuacagaaucucuaauauggagauguuaaggcuuuuccgacucugaucucacuauuugagaaaaaaaaacaaaauuaaaauuccucccaaacugucaacaauacaguuauucauugagagguuuggucuuuuguguaugaaucaugauucauaaauucuauucuaugaauuuuuguucuaugguauuuaagcuuucucucuguuucuguaauuuggaacuauuucaggaaauuaaauauuuaguuauuuuuuuuuuuuaccauuaacuaaaguuugaagcccaaaugccuuuugaaauucagacaggccaaauucuuagcagaaaaagauacuugaaaugcaacugaagggaggaggagccaagauggccgaauaggaacagcuccggucuacagcucccagcgugagugacgcagaagacgggugauuucugcauuuccaucugagguaccggguucaucucacuagggagugccagacagugggcgcaggccagugugugugcgcaccgugugcgagccgaagcagggcgaggcauugccucaccugggaagcgcaaggggucagggaguucccuuuccgagucaaagaaaggggugacggacgcaccuggaaaaucgggucacucccacccgaauauugcacuuuucagaccggcuuaagaaacggcgcaccacgagacuauaucccacaccuggcucagaggguccuacgccuacggaaucucgcugauugcuagcacagcagucugagaucaaacugcaaggcggcaacgaggcugggggaggggcgcccgccauugcccaggcuugcuuagguaaacaaagcagccgggaagcuccaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagcuggcgaucugagaacgggcagacugccuccucaagugggucccugaccccugacccccgagcagccuaacugggaggcaccccccagcaggggcacacugacaccucacacggcaggguauuccaacagaccugcaccugaggguccugucuguuagaaggaaaacuaacaaccagaaaggacaucuacaccgaaaacccaucuguacaucaccaucaucaaagaccaaaaguagauaaaaccacaaagauggggaaaaaacagaacagaaaaacuggaaacucuaaaaugcagagcgccucuccuccuccaaaggaacgcaguuccucaccagcaacagaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagcugaugcgaucaacuggaagaaaggguaucagugauggaagaugaaaugaaugaaaugaagcgagaagggaaguuuagagaaaaaagaauaaaaagaaaugagcaaagccuccaagaaauaugggacuaugugaaaagaccaaaucuacgucugauugguguaccugaaagugauguggagaauggaaccaaguuggaaaacacucugcaggauauuauccaggagaacuuccccaaucuagcaaggcaggccaauguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucgagacuaggaagaaacugcaucaacuaaugagcaaaaucaccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaacccaucucacgugcagagacacacauaggcucaaaauaaaaggauggaggaagaucuaccaagccaauggaaaacaaaaaaaggcagggguugcaauccuagucucugauaaaacagacuuuaagccaacaaagaucaaaagagacaaagaaggccauuacauaaugguaaagggaucaauucaacaagaggagcuaacuauccuaaauauuuaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauguucuuugaaaccaacgagaacaaagacaccacauaccagaaucucugggacgcauucaaagcaguguguagagggaaauuuauagcacuaaaugccuagaagagaaagcaggaaagauccaaaauugacacccuaacaucacaauuaaaagaacuagaaaagcaagagcaaacacauucaaaagcuggcagaaggcaagaaauaacuaaaaucagagcagaacugaaggaaauagagacauaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacacuucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccagcaccagauggauucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagucagcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaauggguaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucacacuaccugacuucaaacuauacuacaaggcuacaguaaccaaaacagccugguacugguaccaaaacagagauauagaucaauggaacagaacagagcccucagaaauaaugccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauugaggacauaggcgugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacacguauguuuauugcggcacuauucacaauagcaaagacuuggaaccaacccaaauguccaacaaugauagacuggauuaagaaaauguggcacauauacgccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaaaaaaagaaaaguaaaaaguaaaaaaaaaaaaaaaagaaaugcaacugaaauauuuaaaucuaaauauaaaagcuauuuuuaaauggcugaaauuauucucuucccccuuguucucagagcugcauauacuuauagcaguuauugaaugaaaacuuaaaauacauggaauuaaaaauuauauuauuaacauagaauauguggaaauaaauauaacacugugauucacagaacuggcuguacuaucuuaugaaucugcaacaaauugucuguaucaaaauuucuuagucuguaagggacuaauugcuuauaugugucucucacgaaguuuggagauaaugcucuccucugaucacacaguuguuacuuacuaccuaugugaccuuugguaaaguauuucacuuggguguuaauuuccuuaucugcaaaaugggaauaaucauguaucuaguuuuugugguugugaagagcaaaugaauuaugcauuuauauuaauaaaauauuaagcaccuguguaacacaugugaagugaaacauauguauuuauuuuuaaugauaauaaacaauuaauggcaacuuugaccaauauaaacuguguaucauaauuuuuacuuucugaauucaguuugguuuauaauuuaaaaucuaccauuuuguuaaauguaucauauuuuagugauuuuaagguuggugauuucuuaaaagaaaguacacauuauucuauggauuaguaggaauuucauuuuucuuauauuguuauugaagccaaauauuuaaaaauacauaauugaucaacacauaaaaauuccauuuauauuuuauauuuauguauaaauacuauuuuugcauucuucaacauuucagauguauugacacauucuugcuuuaauuugaauuauucccacuugggacuuguucaaacaaucucuuaaucaaaaccuggaugaccuauucauauccuuuagcagggccugaauauccuguguuccucaugagcuagaaaugugaauaacuuugugaaauagguagcguagggucuuuuuuuuugcaaaacagagucuaugaaaauugcgcuuugccccaaauuguuaauugccuuugcacaccuuguagcaccuguagcuggggagucucuuuaugacugagaucucagucucggucuuucccucacaggaggugcucaugacauuuuaucuagucaguucucacacaaaggacuugccuuagauacugacaaaagccugaaagaaaacagacgaucuggcaaaugcugugauaguguguuuguuggcgauuaccucucucaacacugucaaagauucagauuguaaaaaauauccacacauacaacuuuuucuguuaucauuauguggacucagaaaauaaagcaaagaaaugaggcaauuuucugaacaaucaggcaagaaaaauggccucaauuacucauuuugucucucugucucacuugucuagacauugcuugggggcagggggugaaaauuuacuacaguuuucuaauacauugauuaaaaacuaauauuuuugacaauuugcugaaauaaucuuugcugaaggccuaauugaauuugaagccggagguaguggcuauuuuuauuuauuacaucaugaggucaccuagauuaugcuuaaccaacuuuacaaguaauuuuucugaguucaaggguuugauuuuuuuuuucauaaagucaugagggcuaauuuccaaguggauuuuggagaagauuuaugauucuacuuucugaucauccaaaccaagaaucuagaucccauucuagacaaggucuuagagaugugaugugaguaccuuucuaucuucccuuuccuuuccuuucuguccccaugaaucauuucucuucuggauuacauucaauucuuucaaauucauucugaucuccauucgauccuuccuuuccacugugaccagagugauuuuucuuaagcacaaauuagcccauguccacuuccuacuuaagauccuuugauucugcauaagugcuuucaggaugaaauuccacacuccccagcauaagacaugaaacccccuguguaagagcaguguuguacuuucucuccuaucucccucccgggcacucuccuagagcuaccuggacaugcugcaguaacucagacacccccaacugcagauaggcuccuuccucugcccccaccagugguucuuaacugggaagaaggugcauuccaggggagauauuuugcaaugucaggugacauuuuguuuucguuuuuuaaaauuuuuaaauuuuuauagauuuaggggguaaaagugcaguauuguuauacagauauauuguacaguggggaagucuggcuuuuaggauaacuaucacccaaauaguguacauuguacccauuagauaauuucucauuccccuucccacccuccucccuuucugagccuccagugucuauuauuccaugcucuaugaccauaugugcacaucauuuagcuccuacuuauaagugagaacaugagguauuuggcuuucugcuucugaguuauuucauuuaacauaaugaccuccaauuccauucauguugcuccaaaagacaugauuucauucuuguuuauggcugaguaguauuccaugguauauauauguguguguguguguguauacauauauauauacacagcacacacacacacauauauauacacacacacacacauauauacaccacauugucuuuauccaaucauccauuagacacuuacggugauuccauaucuuugcuauugugaauagugcugcaauaagcauacaagugcaggcauccuuuuuauauaaugauuucuuuuauucugaguagacgcccaguaguaggauugcuguaucaaacugcaguucuguuuucaguucauugagaaaucuucaggagacauuuugguugucacacuagcaccucauggacagaggccagggaugcuguuaagauccuaaaacacacaggacagccccugacaacaaagaauuauucugugaaaaaugucaaaaauaagaaacccugaccuaaaacaaccuucauggcuuucuuuacucacuuucuccuacucuuuaagacucagcucaagagugacugccucuggaaauguuccuuuaccgccacccagccucacugugauuuaccucucauuacuguucuuguuaucuucuuuuucucuucuauagauuaaaacauauuuuaaaauacaaucuuuggaaucuauuagguaccugugaugguuaauacugagugucaacuugauuggauugaaggaugcaaaguguuguuccuggguaugucugugagggugcugccaaaggagacuaacauuugagucaauggacuggggaaggcagauccacccucaaucuggguggauacaaucuaaucaccugccagcauagccaaaauaaaagcaggcagaagaacguggaaagacuagacuggcuuagucuucuggucuauauuuuucucuugugcuggcuacuuccugcccuugaacauuggacccaaaguucuuuagcuuugggacuuggacuugcuuccuugccccucagcuugcagguggccuauugugggaucucaccuuaugaucaugugagucaauacucuuaauaaauucccuuuauauauaugucuauccuaucaguucugucccucuagagaacccuaauacagauuuuggcacaaguagaguggagcccuacugaaaagauaccaaaaaauguggaagcaauuuuggaacuggguaacaggcagagguuggaauaguuuggagggcucaaaagaagacaggaaaaugugggaaaguuuggaacucccuagagacuugcugaauggcuuugaccaaaaugcugauaaugauauggacaguaaaauccaggcagagguagucucagauggaaugaggaacuuguugggaacuggagcaaaggugauucuuuuuaugcuuuagcaaagagacugacagcauuuugccccugccauagagauuuguggaacuuugaacuugagagagaugauucagaguaucugguagaaaaaauaucuaagcagaaaaacauugaagaggugacuugggugcucuuaaaggcauucaguuuaaaaagagaaucagaauauaaaaguuuggaaaauuugcagccugacaaugugauagaaaaaaaaauccuauuuucugaggagauauucaagcuggcugcagagauuuggauaaguaaugaggagccgaguuauucaccaagacuauggggaaaaugucuccaggacauguaagagaucuuuguggcagucccucccaucacaggcccagaggccuaggagagaaaaaugguuucgugggguggccccagggucccugugcuguaugcagucuagggaauugguguccugcaucccagccgcuccaggugugacuaaaaggggucaagguacagguuggacaaugguuucagagggugcaagccccaaguccuggcagcuuccacaugguauugagccugaagguauacagaagucaauaacugagguuugagacccuccaccuagauuucagaagauguauggaaaugccuggauguccaggcagaaauuugcugcaggggcggggugcucauggagaacuaccaugcaccuggaagagcuguagacacccaaugccagcccaugaaagcagucaggagggaggcuauagccugcaaagccacagggacagagcugcccaaggcugugagagcccaccaucagugugacccggaugugagaccuggagucaaaggagaucuuuuggagcuuuaagauuugacagcccugcuggauuuuggacuugcauagggccuuuagcuucuucagucuggccaauuucuccgauuuggaaugauguauuuaucuaaugccugcacccucauuguaucuaggguguaacuaacuugcuuuugguuuuacuggcucauaggcagaagggacuuauauugucucagauaagacuuuggacuguggacuuuugaguuaaugcugaaaugaguuaagacuuugggggacuguugggaaggcauaauugguuuugaaaugagaggacaagagauuugggaggggcuggggcagaaugauaugguuuggcuguguccccacccaaaucucaacuugaauuguagcucccacaauucccauguguugugggagggacccagugggagguaacugaaucauggaggugggucuuuccugugcuagucucaugauagugaauaagucucaugaaucuugaugguuuuauaaagagaaguuucccugcacaagcucucuucucuugucugccaccaugugagacgugacuuucaccuucugccaugauuguggggccuccccagcaacauggaacugugaguccauuaaaccucuuucuuuuguaaauugcccagucucggauaugucuuuauuagcagcaugaaaauggacuaauacgguacccaacaugcuuauugauuauauaaauggauaauacuaauuagggcaaauucaccuauccaugaacucggauggcauggugaaauguaacagguuugagucccuuuuagcuaugcuuacuuauuuaugaaaugccuuugggacaaagcagaacuuucaugaauucauuuagaaacucagaggagaaaaauuaagacauuacuaaaauaaguuaauuuucaaauuaugacuauguacagauuuuucuacaauuucaauuuuauauguuggaaacagaacagcuauaaguuugaauaacagacaagagcuccauccaaggcuaaauacuaucacucacuuauuuuccaaauauuuaugaguggcugcuauaugccaggcaucaugcuacccaugaaaugucaugaugagcaaaauguccugugccugccgucagagagugacaguccagcaggaaagacagacaauccagaaauauaaaugaaaaauuacaaacaaugaucaugacugugaagaagagggaaaggguguuaggagaguuuacaaagagaguguauguguggggcugaucuauuauaaaggggcaggagggcuucccguagaguugcacuuuggagcugauguugacuggggagguggugcauggugggggaggagugugccagccaaaggaggagcacauagaagccugaggugagaaggguccuagcauguucuggaaccaaagagaagaccaguguggcuggaauacugggggaaggggaaggcugggaggacacgaggcuggggagguagacagagccuuuuauauaauauuaaauguugacagagucuuuaggcuaaaaaacauuuaggggagccguuacguguguaauuauuccuaacugaaaaguucaaaguacuguuauuugagcuauauuuuguuaaaaucaacaaugacaacaacaaaccacuaggacaacaaaaauuucuuccuggauugcuuuuuagauuggguauuuucauaguuguauuaguuuccuaaagcugcuguaacaacugaccacaaacuugauggccuaaaaccacagaauguauuggcucacagcucuggaggccagaaauccacaauggaggccagaaguccacaauggaggccucagcaggacugcacucccuccacagcuccaggggaggagguuuguugccucuuucagcuucucauggcuccuggcauucuuggucuugugaccacagaacuucaaucucuuccucucucuucacaugggucuucacaugaguugcuucucugugugucaaagcucucucuccuuucucucaugaggacuccagucaguggauuuagaguagauuucuaaguccaggaugaucuuaaucugcagauccuuaacugcauuacaucugcacaaacccuguuuccaaguaaggucauguucacagguaccagggaugagaacuuggacauaucuuuuuggggcacacaauugaagucacuacaguaauguugauuuccaaucauuauuauuacuagauuacacuugagcauuauugcuguguuauuucuuaggguauuaaccucaauacugcucauccauucaccaccacuaaagaugacaggugcacagagaagcaagcaguacacugauuuggacaugggacucagccuggcuuggccacuaucuuggccacuaucugcugugugacacuuaacuccugcaagccucauuucuucacccuuaaaacgaggagugacacuuuaccucuacauauaugauagccuuuacauguuuucuaugaaucuacaacuucaucacucgauucauggcucugcucacuuuuucuugaccaugcugacguuuuguccucugguccuccuucuuuaaaauauuuuaauccuuuucugagucaguggggaugguggugguggggccuucccugaccucuguggcuggauuccuacuccaaguccuugcauagagagaaaugguuuuacaggggaauguuucauuggagaugaaacaaugauacuuugguagccggggcaauucuuuuuuuuauccuuauuggcagaucaguccccaggugaaguuuauuuagcacuugucauuaaagaaacgugaguugguuagaagccagugugagcaaguggagagaaagaaaguuucugauucaguugaauuauaauaaaacaagcaccucuguacaguuuaagauaaaccccacugaacugaauguuuguuauuuauguaagcuaaaacccucauuaaauugacagcagcauuauuauuaggcaaagugugauauaacauagauacagacucaaaauggacauaaaugacguccacuguauuuauuuaugacaaaaauuagucagaauuguaaguacuggugauguuagguuuucuauugaaagugauucuuucuccauacgucugggguuugaguucauguagccaccaaacucugccagaguuuaaugaggaucucaaaggugggagauggauccauuuggucgauguaggugucuaugaaagacccagaaacauuagucugucagaguaccaaagggaaagaaauaauugaaaaggagauauaaaaggagaagaaagacagcuauuaaaaaguugaauucuaguagaauuacgaggguauuuuuacaacacucuguaguuuuagauggcuuccuccauagaccccaacacaaaaugcaucacagaaaaguacaaaagagcaauaguccuuuuuaugagauucuguucauuggaaaagaaaaagaagauuuagccagcagcaggaauuuguuccaccuagcuuuaaauggaaaucacuuuuaaagcagucauggaaaaauuuagcuggguucccaaacaauauaacauguucagugcaaagucugauucacggagcuucugccagcaaaucauuauucuugcacuacaagaaaaaggguguauuguucccuguuacaggagagcuagggaaaaagaacaugauagucagcagaggagcuaaagagacuugauuuauagauuauauugacucacuaguguggaaagaaaaaguaacccauaucuaaucuuucaauucuuccuuugaggugucuuucagauguguaccuuccucuccaugacuucugaaucugucuucaugccguccccucccucuuguucaccugcguugccaucauagucccucgcuccccagcugggguaccagauaucugucugugacacucagccccauuccuaccucauucuaugaucucuccuacagcacagggacuggcaguguaggaacuacauuucccagaaccccuugccuaacagagcuuugucuuggaugcgaccaguaagaaacuccugugggagauuuggauggcagagaaguguguauuggggcaguggccugcugacaugcagaguuuggaaccuaaaggguuuuuaguagccuuuagcaguucaccaauagauaccggaggcugcugugaccuguggggaaguuuccuugaguuucugaccugccuggaggcaaugucuaaucccucgguagccauuagagaagcugaggccagcagugacuggccuuccucaaccucaggacuccuuuccgucacuuucauaagcacauagugacccacaucagaucccuucuuccuuggagcaucgagggaagguucuauuuuccugauugcuuacaucacugcucucuggagcucggaaauuaucuaucacagcuccuuauuuuaugguugaagcucggagagauuaagugacuugcucaagaucacgcagcuccuuaauuauggaaccaagccugggaucucuaucuccuaacuuccagauuggcgcuaauuucuauuguuucaugccucuguagauuuguauaccaucuccucauguucccgcauauuuuuauaccccuauuuuguuguaucuacgaugcuagcaguuaucauuguuucaugaaaaaaaaaaaaaaccuaagaaaaauaccaccaaauaaacggacucaguaaauuuuaaucacuggaaaauuuugugcuugcugaaagaacucuuuucagcuugauuauaaauuuuuaaauuauuuauugcauauacacaaaaauaaaauauaaacaaaauaaauugggugagauauuucugaaacuuccuuucauguagagucugacucuuugaaucauguuuuugacucagaguuauuaagccuaauuacauauaauucuguauaaauaacauauaaaauauguauaaauauaaugaucuauauuauagaauaaauauauauaacuauauauaauuaaauuacauaguuaauauauaauuaaauguacaauuuaauuaaauguuuauaugucauuaaauuauaaaauauuuauuuaaaaauauaaaaacaauaucuugaaauauauugaaauauaauaugaaauauaauauauugaaauauauugaaauauaauuuuauauauugcuuuauauaaaaauauaaaaauauaauauauugaaacguaaaaauauauauuucaauauauuucaauauaauauauuucaauauaauauauugaaauauaaaaauauauugaaauauaauuaaauauacuuaaaauaaaauauaagcaaaguuaauugggugagauauuucugaaacuuccuuucauguagaguuugacucuuugaaucacguuuuugacucagaguuauuaagccuaauuauauauaauucuguauaaauaauauauauuaaauauauuauguauauagauauauguauaaauauagauaauggaucuauauuauauaauaaauauauaaaaacauacaauuaaauuacauaguuaauauauaauuaaauguauaauuuaauuaaauguuuauauaauuaaauguauaauuuaauuaaauguuuauauaauuaaauguauaauuuaauuaaauguuuauauaauuaaauuauauauuuauuuaaaaauauaaaaauauaauuguaugauuauaaaauuauauaauuauauauaacaguuuuaaaauauaaauuucuaugccaucaagagauaagaugagguaauauuuccuuaaaaaauguuaacuuauuuuuaaugucguggguacauuguagguguauauauucaugggguacaugagauauuuuggugcagguaugccauguguaacagucacaucauggaaaauugggugucaauccccugaagcauuuauccuuuguguuccaaaaaaauauggaaucuuuaugcauuuaugugucauucuugugcaggggccuugcugaucuucccuguauugguccaguguuagcauaugugcugccaaagcaagcgcaauguaacauuuaaaucuguuaagcaacuaaaaugcuguggugcuagacucuuaagucauuuggcaaugacauagaacuagacuucuuuuuuuacuuuugcuuccuguauguuaaacauauauaauacauugucucacccaucuucuuucaaaacaaguagguccuaggaauaauaagaguggucuguaauugacucugagguuuucuugcaagaugcugacaugugucuuacacguuguucuccuacaugcaagcauugcuugugacaucacgacugccaccuggcugaaggcaacuauaagaugucauagauuccaagaugcauccaaauuucagaaauauuacaaugaaaaaaaucaugugucacaaaauguauucaauuuuuaguucuguucuguucauuucugugucuucaguaagaguguaugcguuuucaagguauaguuaguagcauauaauuauuuuuagugucucagaauacaggcguacuuggggauuauuaaaauaugguuuuuccuuaaacugaaacuuguaucuuguguauucauaaugcuacuguuuuaauguaauuaaucacuauaauuuaugauuaauuuaaugucuuuaaggcauaacauauacagcuuuaauucauguuuggacccaacaaacauuuauuguucucauauuaccaggcauauuugugucucaggagauuauuaacucucaugcuuaauaagaauuccucuaacuugaaaacucaaagauuaagauuucugugauaccuauguauagauagcaaggcuaugguaaugcaauugguaaaagcuuguuuuguuugagaaaaauaaggcagaaaacaaaauuuaauucuuugagaggauacacuugccaucucuucuguuucuuagaaaauggguuuucaccaugcuuacucauaaccaguaccugcuucuugaacauuuggcugagaagaaaaaguaacguagcagucagcaggaacucacuaauacaagagaaugcuguauggaaugaaguaaugcguacagagcauggcaccuggcagauguguuuccaucuguugcucagacuuuuaucuuauuuucccuccaacccauuauauggucuuuccaugcuuggcaaauaguaggcagucaaugaaugauaaguuccuucuauuuccugcuuuugcuccaaaguuaaagcagggcgaauacuugggcugaaaugauuuucccuucuuuacagcuugccuacaguuuugaagaaaguagauguaguggauuggauguuuaugugacccccaccaaauuaauaugcugaaaucuuaacacccaaagugauguuaggaaguggggccuuuugggggggaaguaggucaugagaugcagagccuuuacauaugguauuagugaccuuauacaagaggccccagagagugcauuuuccccucugccaugaaaagucacagcuagaaagagccaucuaugaacagaaaacucccccucaccagacaccagauccaccaauaccuuggcaggucuuggacuucccagccuccagagccgugagaaaugaauuccuguuguuuauaagccaccuaguuuauguuuuuuuuuuuuuuuuaauagcaacccgaauggacugagacaguacguacuccaagccacucacaaucucagauucacauauguauugaaugccccauggaaacaaaguccaucauagcauguuuggacuagaacgggugcaugagacucuuuuggccuaagguugcuauggagauccacuucuggagcaaggcagcuccaggauucugggagaccuucucgggguaagcagaugugagauuucuacagggacuccgugggauucaccagagccuguaugugacaccugugaccucugcuuuacuggggaccauguggccccccucgcugcucuguauuccccacaaagauucaagcagaugcccgguggucacucugaccaucacaggccuguuccaauuguuacuguggaaaggaccuuaggauaucugaaaguugaccguaugcuccuccaauuguucuuguauacacaucauuuaacacuggaaaguaguagaguguucaugauuugugugggcuuuccagcuagccagacaaguuccaauccuguuucuguuaccuagaguccuaugaccuugaucaauuuacuuagaacuuccauuuaagcauuugugauaucggaaaaaugccugucucacaggguuuuuguaaggauugaaugagaucuguaccugaaaugccugguaaaggguaagcacuaaauauggagagcuauuaugaucacugacaaacgugacauuuaagacuuuuaauucaacaucauuagcucaucugucuuauugacacuuaaucaagacuuucuaaagugugagcucguauuaauuucccgguaacucaguugucuacuugaguucauuuucuuucaccaaacugaaacuaacuccuguggcaugauugauuuugccagagugauucugcauauccuaaacaggaucuuuccaucugcugcucaaccccaucuguucuugccuccagcugauccaauuucauauccaguugguagagggccaccugaaaaaaaaucugcauuauguucugauguccugaagaaaucuugagaaaaauucagcauaaagaguucagucacugggacacacuaaaggcucaauaaauuauuuuaggggaaauggggaacuugccauauggugcugguuuuuuugguggugaaauuaggucauaucaaaguuguauuagaaaaaacaaggaaaacucgugccuagcagagugcuaugugcaguacagacucuucauacccaagaacuaaguaauauaguaccauuauuauguaggaggauugcaaguccuuugaaggugauaaauguuccaaagauguaucauuucauuuuuaagguauuauuauuuuuauauuaaaaguaugauauuuuagaugauuagagaaacuaggacauuuaagacuuuaauuacucuuucacaaaauacgcacuagacugcauucacuugagcuggaguaucagugaacauuuaugaagaaagagaugcuucccugagugguguagcaugggguaauagcaacagcacugagcaucaccccaaaacaauuugcuggugcuuauuagaugccagauguugucagaggcacuuugccuuuauuaccuucauguauuuuaucaaauuaagauagaauuuauuguuugaugccucaugacuuuauguggcacuuccaaaaaagaugugccauugauuuuaagaaucaucccaauuaaaaugugaaaugugccuaugucauagaauggaagaaugcaguaaucuaugauuccuuauaacaccucuaugaggcucauuuuacauauggauaaauugaaacuuagugguauuaaaugaaaugcccaagccccuuccaguuagaaaacaaggaaaucuggacuucgauccaauuuugucugcucccuacaaucuguauuaaccuugggcuucaaugcccugguucugcagugacuguaguuccagagauaguaaguagcagugaacaaagcucuagaaugaauuuguaccucuagugcuguaccuggaagcacaucuucauaucugaaauaaguauacuacauucacccauuucuucccccuuuuuucuaguuucuuucuucauucguugaugaucuacauagaaaaucauguuuuaaacgaauuccuuuucucuccucuguacccuaaaggaucguguguuuugaaagcaguguagcuagcaucagaaaucauaagaauaggaagaauggcuuucuuuagggaaaacuuaaagguuucucuccuuucuuguagaauuucuauuauuauagaaauaauagaaauaugcuuuaucuuugauuaaauaaaugauggguuuaauacaagaagucauugcauuacuugcuuuggccuggaaaacaacuggucagaaaccucccuggcauucuacccucucauacuuucuaaaucaucuccuuccuaccuuuuugggcucuaugagacuauagccagcacuacaggagcuaucuauuucuucuuccugugacucuaagauuccgcaaguucaaaacccaaagcuuggcaagaaaaaaaauccuaaagguaaguaacauauuucaaucauuuuacaaaucucuuuccucuuuccucuaccaaauacaccgaggauaucccuugagaaguuuuacaaucuaauuuguuuaguagaucuuguggcccacacuauuuagagcaaaauauucguuuacucaacaauuuuuuuuguuaugugcuauguuaagcacuuuacauuuuaugugcuaugcuaagcacuuuacauuuauuauguacaacuuacacaaccacuuggguaaguuugguuccuagggauuaacuggauugcaaggccaugaagccacagagugcuugacaccaugcagagggaagucagguugacucagagcccuuacuccaucugcuuggggcaaacagagaaaacuuuuggccuaggauauuuuucaucaacagugaguaauuacuaaaguuauuauagaagggauuucaguccuuaaaauguauuauguauucagauuuuauccugugaauggcgaaaccccaucucuaaugaaaauagaaaaaaauuagcugagcuugguagugggugccuguagucccgcuacucaggaggcugagguuggagaauggugugaacccaggagguggagcuugcagugagccgagauugcaccacugcacuccagccugggugacagagcaagacuccgucucaaaaaaaaaaaaaaaaaaaauguauucagcuuuuauguaaagggggauauccacuuaaugauauucuuucuuauuucuugaugagaccauaugaugguuaaaagaaccaacugaauucauuaaauuuuacuguaaugggaaauucuguccacuuuuguccugugacuauuagaaaugcauuuuuuacacauauuuuuucacuucaaaaaaauuccaagcccuuuuucuuuaucccagcguucucuaucuguugaaauagcuugcuguuuauaucagucagugaauugaguuugaagucucuuugauaucucugauaaaauauuagaaaaaaccugggguauaaaugccaaauagcuguuuuagacuccccauuaaauuugaauuugauaagucuauggaucauauauauagcaugugcuauggcuuuuuacuuuccauucucuggccaguauuaaacuguaaauugaaaggaaauucuuggucaccaucaaauugauugauugagacauaagccaaucuuuaagucaaacuaaugucaaauaggacauagaauucugggauaguuccaauuauagaaucagaauuauggauucuuaauucagaauaaauuauaggauuauacuaucacuuauaaauuuuaaguauucauugaacuagauuuuguguuuuccuuuuguguuccuuucauuauuucuauuaaggaguucagccaaaauauccaauuacuuuuucccuaucacuguuaaaacauuuucuuaguguucucagcuucagucuuucucuaaacucauccuucacacaacuggcauauugcuguuuauaaaagucauauuauaucccagcuuguaaacuucugauggccuucuauugccuggcuuauaggagaaugccuacaacuccuuagccugauguaaauuacuacccucaaucuauccucaaaguucucacccuaauuuuacuaccuacuaucccuccacaaaaaccaaggaaccgaagugagaauggucaccuuaagguuucgugcaaaaacuuugcccuuuuucuuauauuuuacaucccaccuucuaucuucaacacccacaccccauaucaucuuuuuaaaaagccuuccuuggccuccucagugcagagagaucucuguugcccuccaacugucagagcacuucucucucuccacucuuuguuuagugguugucaucucuucucucauuucuucucuauuucauuucuucucuugauuugcacauauauaucuucucuuuuuaucuggauuauaaacauuuugugaaagauauuaucccaguguuugcagacagcgagugcagguuuucuauucucaacagaaauguuaugucucuuuagauguuuauuuuuaauuuuauuggagaauacuauuaucauacaucaguguuuucuuucugaggaaaaacaauccuaguuucuccucucaaaguacacuuuuauaauaaugaauuacucuauucauagcuuuguuauaaacuuucuucgaguucuacccaacuauauuaauugaaguuguaaaauaagguauuagaugcaauuguaauauaaaacacaucaacucugaguagagcagaagggcuugccccaguaaauugcugggucaauacuccauuaacaaccaaccuggugcuacuaagaacgcucacuagaagcacugcucaggauaucuauaaacugcacaaacccauagagacaaauaaguauauauuguuugccucuuucaauuuucuuuuaacagcucaacauauaaaauugaaacaagaauuauuuuuguuucaaaggaugaaaguaacuauaacuauugaauccuaacauuuuuaaugcuuuaaaaauuagguaaauauuugauacauaaaaucuuagacucuauuuaagcagcauuuuaccuucaguauaauccguagcaaguaaauuuaccaguaccucagaauacuguaaaauucauuuccuuuccauuacuugaguccacuacuuccucaauccacguuaagcaaaauuuucuuuucccugucugccuucccuauauggaaagugcuggaugccauuaugguaucacgugacacacuucuuuuguuucuagugucccccagacaacuacucagagcuuucuuuuucaggcauugugugaccaccauucacuucucuuacuucuuaaauaucgauuugaggcucugcaauuaaagaaaaaaaaaggaagcugguaaaagaggguuuuuuugggugauauuguguuuugggacaauuuuuucaaguauuaagaaucauaucauuuuaugaccagggaggaccaaacugaaguccaggaaaaugacuguccaagaagauccacaguuaccuuuuuugauacucauauuggcgauacagacaugccaaaacucguuccuucugaugugagauuuaaugauagguaccauuuccacauggccucaauuguuugguaagcagggcuguuaacuauggggaaauucuguaguauuuggaacuucccccaccucuccauacauucauacacaacucuaccguggacuugaaugagguagcaaggcuuacuagcuucucaagacuucgucaucauagccagacuugagaguagaguuucuggguccacaucuuacagauaugugccccaucuuuacuacuagaagacaaggaaggaagaaauucuacucucugcgauaguuuaaucugaaaugcaagcuuaagaauuccagaaaccggaaaaauauuauuucagccuuuugaauaaaggagagacuacacaguuaaaccucugaaggcuucaccaagccccucaaagugaauuucugcuaaauagaaucucgagacacuaaacacauaauauuggcaugcagaaugucuggguauugaauaaaagguuuacugguuuauauagauaagccauccccauacaccuucugaaugccuugaugucugcuagaaagacaacacaaaccuuagucaugccagggagacaguaaaauagccuucuuauauugaguuauuugcugcuuuauuuauuuuucuuuuuaaauauaacaguuguuggcuuuuacaaauuaauaccaaaaugccaaaauaaauaaaagagaacuuuacuacuuuugcuucuauuuugugagaguaccagcuaugccaguauuuucuuuguuuuaagccauucaccuaugggcauauucuguagcuucaguaauuuuuuuuuuuuuuaagcccuugcuugcaaguaauugguauugauuuuugcagguuacugcuaauguguuuaguucugaaaagaaaccuaacuguacccuucucauccuauagucccuugaagacaauaacauguauaacuucagagcaaauugcagugguauccaacuucuuuaggcaaaaauuagggguaggagccaaguuuuuucagggcgcgugucuucauaccucaaagguagugauaugucuuaaccuccccauuauuucaauucaacgugcugauauacgaagugugguuguuagugguuaauacuccuuaugcuagaggaguaaacaacuaaacaacguagaaaucucauuuaagaacaaggcccuagggagugacaagaaauaagucuaccccuuaaaucagcacauucaacugggucggucauuaacaacauuggcacuaauagcuuuuagcagcagggcagcugcugauuacaauuggguuuccugcaacuguggcugcagaagaacugaagccuccauuacaaaggcagaaaacugggggaaugcacaugaauucaagguagaagggaaaagcaaguggaguguguagacuuggaugaaaaggauucacaauuuuccauauaguuaaacacaacuuugcauaucagucaguaaagggagucaaauauaugguuuggaaaacucuggauuauugcgaagcaagcuuuauuauccagaaucagcucaagaagguaguaccuacuguagaagacaagguuuccuucugauaaaaugauauuuucuguaccaacccuugucucuugcagaguugacaaauagcaaauaagaguagaguaauacaaauuauaauaagaaauuuacauaucauuguuuuucuagguaaaaaggcaaaaagcucacaccuuaaacggcagccauauuuuugacugaaaaugcugucuuagcgaugucauauacaucgcaaugauaaucaucagcauccaacuuugaaacauccacuuggcauccuauuaguggcaguaugaaugaucagggcacgguucccuauggcaguauuaaugaugcaguggaaucagucaaggacaguuaacacagcugagguggguaaauaggguggauaaaggaacacgagauaaacuguuauuacauaucaacauuuugacauaaucuggcaggcugacaaaauagacaacacuccaaaaauauaucuagaagucagauuaaaaauuucaguggaaacuugcaauacuuccaacagggugggauuuuauauaaaauagacucuuuuuggauuuauucaugggauuuugucacuaaaaaagugagaacaucuuguuauaaaggagcuuuucauguaagaauuuuugauauguauuugcuaaaccaacacacagauaugccagccuggauauacacaacaucuccauguaucuacgguuacauagagcacuugaaagagucaucuaaaucuucuuucuucacuucuuuauuucucauucacuuucauguguugggagugagguggggaggugaguauaaaauagagaguccauccacuuuccaucauauucuaguccaucuucucuacccacgacuccauagaaauugcucuugucagaccauagaagacuuccaugagacuaaaucuagcggacaguuucucuguccucaguuggaacauuugggggacauuucuucuuuuuuaaacacuauuguuucuuggcuuaugugauguaacuucugauuuucuuccuuucucacugccaaccccuucuuaaucuguuauuuuucccccaauaaaaugaaugcuuuuuguuuuuuaaucuugaucagaucauuauacucuuucaguaacuuccaauaacuuuuaguaguuuuucauuucauguaaaauaaaacccaaauuccucaucauuucccuaaaguucagcuugauuuagucccuaccugucgccgcaauuuuauucugcaccacauucaccgugcucuuccaccuugccuucuuuccuguuucucuucagccauuucccuuuucagggccuuuuccuuugcagguuccuccccaacacccaaauucuucacaucucugaauccuuccuggcauuccaaucucaguuccuaaguuaccacacuggaagaccuucuccaggacuuccauuucacauucaucuugccucuuucugucauguuuauguuauuuauagcacuuaucacauucugaaaauaucuuuuuuauuuguuuaugauuuauuguguuuucccuccacuggaauauacauaccauggggaugaggaacaugucagucuuguugccuucuguauuaccauugcuugauacauaaaaggcacuuaauaaauauuugucaaguaaaacagauauuaaaaauuucaaggcccaaaaaauaucuaaugggaccuagaaaacauuauuucaaugaauugcccacucaauguuuuaucuacucugagaaagaauacauuuccuauaucacuuacucuuuuuaaaaauuaaucuuuucauaauuaauauagucauguuguuuaaaaauauaauaaaaauuccuauuccucuuuauauuccugucacaaauaugucuaguaacuauauacugcuaccugccacagguaacuaugucuuuaguaucauuuguguucuuccaagguuuuuaaugcaaagucaagcauacaugaacauauguuauuuucucuuuuuuuagacaaaagcuagacauauuaaucuguacauuuuuuccauucagcacucuguuuuaaagauacuuccacauuaguaccuaaagagcuuaccauaaaacucagaaaugaagguacuguaacacugccauaaacauaggcaaauaaaucaaugggacagaaaagauaaucuagaaauaacccacagcuauauggucaauucaucuuuaacaaagguuccuagggaauucauuaaggaaagucauuuuaaguuuuuuucacaaauguuucugaaaugacugaauaaucuaauaugaauaaauugauccuugccucacaccagauacacaaauuaauuugaaauugaucaguaacaaaucuaaaagcuaaaauuaugaaacuuuuggaagaaaacauaggagaauauuuuuuaugaacuuggggaggcaaagcuuuuuuagauaacacagagaaagugcuagccacaaagaaaaauauuuaaauugaacuuaaucaaaauuaaagacuucuccucuuugacauauuaccacuaagaaaauaaauaggcagaucauaaaaucauagaccggcaggaaauguaucauucaaauauauaucucaaaggacuuagauucagaauaaaguauuuauauaacucaauaaagcagcaacgaaaaaauagacacauuaaacagacauuaaacaacaaauugaacagacauuaaacaacaaaagacaugcaauaaccaauaagcaaauaaaacagugcccagaaucauuaaucaucagggaaauacaaauuaaaaccauaaugacagaucacuguacacccacuggaauggaccaaauuaaaauuaaaacucugacggcugcaccaaauguugguaagggaaaagcaacuagaacuauauuauuuugcugguggauauguaaauagguauaacuccuuuggaaaauuaucagauucuuauaaauuuaaacauauaucuaccuuaugaccuagcaauuccacuccuagguagaauuuuaaaaaaauagaucuauaaaaagauuuauacaaaaauguuauagcagcuuuauucacaauauuucaaagcuagaaacaucccaaauggccacaaacugaaaaacaggugaauaaacugagguguguuauuuaaugaaauaccauuuaacaacauggaguaaacucuaaaauauuuuucugaugcagaaagucagaccucgaagaguauauucuguauuacucuauuucuauaaaauuccacaacaggugaaaugaaucuguugauggaaaucagaucuacauucuccuuugaacugaaaggcacugaugaccuaggaauuggcaugacagaauuuucuagguugaugaaaauguucuauuaucuugaugggugugggauacacagguguauacauuugucaaaauuuaccaaacugugugcuuagagucugcauuucaugauguaaaaauuacauuucaauaaaaacacuauaauuaaaauauaauaucuuaagguauaaaguaauaacaauauaaguaaaauuuaaauaaaggaaaugaauguuuaaaaugaggaucaagaucuggaauacagaauucauuauuuagaugggauuggagaaaggaagagaaacguauauauaaugggcacugacugguagaccuuuucagcaacguuguugaaaagcugaagugaaaaaggcaacaucaggaagguggacaaaacuaaaggucugcauuucccauuguaccuuuuuucuagugcugguacagcuuacagcaaaacuucaagagcuagaaccaucuaucugagacaauucuuuucccauuauaccacuaacgagguuuaugccuuuccuugcuuucucaucucuaugauuaaaauucuauggugaucuuuaaguugaauuacucuuucuuuuauccagaaacugaauuaaccagagcuuuaucccaagcuuaaauuaccuguaaaccaaauugcucuguagaacagagugagaaaugcggcaagaaacaucaagaaacuggauucaaugucucuagaaugcuacaaaaauagaaguucugcuugacuuaacauucauggaauuuaccuugaaggauauuauuuuacuaucaagcuaccuucucuuccuucccugucucugaaguaagaacuauaacaauaaaugaaaugcagagucuccuaagaaaaugagauuugcucuaauuuugccuuuaagccauuuuguuaauuucuuuuuauuuuuuaaggcugcaaaauaaaaccuaauaaagaaaaggauuauaauuaaccacugggaaaagugcacacaagcuuagaauuagcauuguuaaauuuuugaggaaaaaaggaagggauuaagauagaauugcauuuuuuaaaauagagauaggggaaacgucucucauugacaguggcuccaccuauuuccaaauaauucugcugucugcaucucccaacagaccacgugcuuccuuuuaggacacccaugggagaucuagcaaucgugagugcacggggcauccaucacuuggcacucauuacaucagucuucuaagacugauggcugcacuucucucuaagggaaagcaaauaugaucaauuauugcuccugcucccuuguuaguacacuauuagcuucugcaaauuauggaguaggguaaaauuucauauaaauuguauuagcagaacuaauauguucuugauugaagacugucuauuaauaggaauuucaaagagaaaggaacuuuaucaaugaacauaggccugagauacagagccucaaagaaauuagaccaccaugauaagaaaccaagcaauuuaagaggacaauacuugauaaaauaaggaugccuacucguaccaucacagagcaaccacacaauaauauuauaccucuuuguagaaaacaaugguuuuaagauauacaguuaugugggaauaacugauuuuuuuaaaaaaaaauuaaugaaaaauucuguaacuaccaauuguauacagaaaagaugauauaaugaauccccauaaacucaucauuuagauucauuaauuuuccagcaaaaauaagccacaucugcuuaauuuuuuucuuugcuauuuuuuuuuuuuuuuuuugagacagagucucgcucuguugcccaggcuggagugcaguggcaccaucucagcucacugcaagauccaccuccuggguucacgccauucuccugccucaaccucucagguagcugggacuacaggcgcccaccaucaugcccggcuaauuuuuuuuguauuuuuaguggagacaggguuucaccauguuagccaggauggucucgaucuccugaccuugugauccgcccaccucggccucccaaagugcuggguuacaggcaugagccaccacgcccggccuucuuugcuauuuuuuaaauuuuuucccauaaguuauuggaguacagguggcauuuaauuacgugaauaaguucuucagcggugauuugugagauccuggugcacccaucaacugagcaauauacacugcgccauauauguugucuuugcuaaaaauuuuuaaaacaaaucccagcaacauguaacaucauaccuaaaauacuucaguauccaucucuaaaagcacaaacauugucucacaagauaacagugauauuaucucaccuacauauuaacaauaaugucuuggaaucaugucuagugcauacuaaaauuuuucuaacgguuucaaaaaugucuuuuucuuaguugauaugcucgaauuaagauucaaauacuguauuugguaaaucucccaagucauuuuucuuucuuucuuuuuuaaauuuacagcugugcuccuccuucuuccccucuccuuuuuucccaugucauuaacuuuuggcagaaacugugucaguaguccuauaaaauguccuucauucuggauuucucuguuuguuucauuguggugucauuuaacugcuuccuucccucucuauuuccugguggcuggaaguaagugauaaaggcucaauuagauuuagguucaacuuuugacagaaaugcuucauagauggugcagucugcuuuauguuacauuaucuuaagagaaaaaauaaguucuaggguuccaaauucuaguuauaaugaaaaccuagucccucuauugucuaguucuuuuuaauauuuuauccaaaggauuuaaucacugaugaacguugcuuugaucaguuauuuuauuaacauugcaaaauggugaguuuuauucuuacacauuaaugaacugcaauauuuccauaaaaaaggcuauucaucaucaagugauuauuuugauuacugaaaaauauaacucccuuuaaagucagaauaaauauuuaguuuuuuccccuuuaauuaucaauuuucagagcaaguaguuggugccuuaauaauuuccagagaauuuuugaaaaagaguucccaagcagaaaccgaacuguaggcuaaccaucuccauuauuuuuaaaauucuagcucaagauccagguuuccagaauaauuccaaucucaaauccucuuuuuuacccuacauuuccauaagauuaauguguucugucauuuuuuucaucauaucagaauacaugaaaaaauuaauaauugaaaaaucaauuccaaacagcaaucucagaccuucccguacauacccgucuuugcuaccuuuccguucaccuugguaacauucuuucuccaucccccauccucagaaugguccccucucucaagcccuccagcucaguaacaccuguguacuggagccucuccaaggcagggcuccuggugauccacagaaaccuugagaugcuaaagacacucucuacucuuaagaaaauggagaggaugaacuucuccuguguggaugggaaauucuguuaaaguaauauaaaaaacgacugcucaugcuguugcuugggacaauguuagugaaacagaucguugcauuuuuauacaaaaucacuuuaacucuuucacuguacauuaagcaauagucucaacaccacuuauuaacacagcagccagagucugagaauauguaaacacaaggaaaggauaucugggguguaucuuuggaaauaagauuaagaacugcugaaagagaguacuggugagcucugaacugugaggccaguggacaucacucgauucugugacacaggcagcccgcggagcccugguggucaucuuuuguacaagugcuuuugugcauacaagcuauucguggauugaacccuugaagaacaacucaaaacauguuacauuugugauaagcagcauaauggcccuuuaaaaauguccacaccuggaucccuggaauaugugaauauguuguauuccaugguggcaaaauggacauugcacacgaaauugugguuacagaccuuaaaauagagagaugauugucugggugggacauauugaaucauaugaacccuuaaaaguagagaguguucucuggcuugaagcagaagaaggauguggaagaagagaaagucaaagagauuccaagcuugagaaggauuccauguuugcuggcucugagaugucggggcccacaugcaagaacuagaggcugguucccuguugacagccagcaaggaaauaggaauuucaguccuauggucacauggaacuggauucugccaacaaacugaaugagacuggaagcagauucuuuccacagcccagcuguuaaucaucuugacaucaucuuccuaacacccagaacagagaaaccagcagaaucaacucagacuuaugaccuauagaauugugugagauaauaaguuuggguuaagucacuaagcuugugcuaauuuauuauggaagcaauaggaaagcuaauuaauauugcuauugugucuacacuaucacuucauaaaagggcaucauacucucuaauuaauggauuaccaauuguuuccugacugcagacuaucugaguuaucacaguguauaugaggaaccacucucucccuccaaccccuggugcucucuucuuucuaaccuugucccuaaaacguaggacuacuauuucagcuauauuauuuuguucauuauuuucccagcuacauuauuauuacuagguauauuauuaacaaaaauguucuaauuauuuugcuuugcuguuaccccaggaacccaauaauuguuuauaggaugauuauuuguaggacgacuauauauauaaucaugucaucauuuauaggcugaauauagaucauuuauaggaugaacauguauauucaaauuugaaacacugacuuagcagugaucuucugaaauaccucuuguuugaaagucaggaacuacaugcauuuuacauggugaugaguuucccgauggcauguaaaagugcuauacuaaaaguaauaaaaguuuaauauguaagacuaauuggauucacaaucaauagguuauauaaaaugaagguuuuaaagggcgaggcaaauacuuucuuuaauugaauaaugugccucuuaagcuguuuuccacagagagaguaaucaggaaugacuauuauuaaaccaagcuaauuucaucuucuguggaaaaaauaaagaagaauguugaaggaauaaugccaaaugcagcuacaccauuuugauggagacaaaugcauaacaagguucaguccuacaggcaaaaaagaccagaaaagacaccaaaauaauuuaauaaaugaugaaaaucauguaacaaaagcuuucuagaugaugguuuaaugggauguuacuaauguaaauuuuaugccuuguuuagcuuuuuauucugguggaauuuuccagugugacacccauauuuaauaucagaguuucuaggaaaauaaaagaacuagaaugguauuucaccuguaaauuccuuggaagaucugaggggacugaaauaucaaagucacauuagaaaaaguaauuaacuuaaaucccuuuuggaaaggcaaaaagaaaagugaaucagaaauaaaaauuaucuuaccgagaacauuuaaaaagugccgaacaguaaauguuagcuauuguuccugaauacuuuguccuuugagcuugucgacuuuuuagucacaaggcagugcaccaucauauugcccaaacaauuuacaucacaaaggaacuauaauauucuuuuaaaacgaagagagggugaauuaauaagaaccaucaucauaccagauuccuucaaucucaauggaauggccaaaugcuagcugggaaaauuacuucagacuucuuaacugcuauaauugaagugagauuuuccuccgugcgugcaugugcagaauauaaauauuuuaauuucaucuguucagugaguaauaucacaggacugcuauuuuacagaaguaacauuggagaauuaaagggugagcuugggaguggaccauauauuucuagagagacuuuuuuugcuaggagguucagugagcauguguucauuuccuccuuuuucuuucuccaagaacaguaggagugaucuguguuucugcccagaagguaacccuguuggaugcuaucaacacaacugugagacuauuaaugauuacauuuaaaaaucuagcuaccuucugcuucaauuaguuuccucuccacuacauaaauacacaugaggguuuggagacauaugacuaucuuuuucaucuaaaaaggcuuucuucuucucugagauucuaggcauaaaccaucccauugacuugccaagggaaugcaucaacuuccugguaaaaaaugugauguuuugaacuuccccuggugagacuaguacuccauaaagguaguuuuugguaaaguuauuuuauuggcaugaaaucuuaaacuaaucuuuccuaaugcauuucgacauaguauaagcuaugaguccaucucccaucugaacuugcuuuuuuuuuuuuucaaauagugaaaugauuugaaacuauuuucaaauagugaaacaauuuuuuagcaucaaccaaggaucaaauguucucucagauucugugguuuaauuaaauucuccuugcuccauagaagccaggugacuauaagguaauuuaauuuauugucuuauauucugaugucuuuaauauauacuacauguauauuccuugacacagaucucuuaauagguauguguguauuauuaauauauguuagucuacaccagcagagcaccuugauccaucaugugcucauuugcuuugugagaaggggacucaacuuuuaugugaaaucucuuccauuacccauagccagccaaaauucuccgaugaaacaagcauuuuuuaaaaagaaguauauugucauaacaaucacuuauccuuuagugcuagaaacucucucugaggagcgccucucugaaaaccagcgagagcagagagaggaccugaggccuuguggcugggauggugccagaguggcaggauauugaacggauaggguggggagggggcagcugaaaguagaaugaguggacacguugugauugucuaggaaggggcagguccuguauugacuuuuuuuuuuuuuacuuuuuaaauuauuacaguuuuuuuuuuccuacuuauauaagaacucuguacuguaaacaucuccggcugaccugugcuucuuccuaacagaauagaugaaugccucuaucaagguaaaugaucuuucaagaguuagauguuauuuuaacaaaccaaauaguacauauuuuugcaaaaauaaauuuccuuaaaguaaaacaucaacaacgaaaaagucuaaugugagaaaagaaagacuaaguuacaaaguuuacuccugaacaccggccuccuuccucuuccuggaacaucucagacacagacuugccuugagccucuggacuggccgcucucccuaucugaauguucuucccccacauagucacauggugaaucccugcaccucuuccaacucucucauaaaugucaccuccuuccugaggccaauucccacaacucuauuuaaaauuauaagccauccucacaacuccaggcuccuucgccccuaacauugcuauuauuugauuuuuuuccuucuaaucuacucuauacuuuguuuacugacauaguaccuacuuaauguucuugcguuuaguauuuaucagccucucuuuccccauuagaaugcaggacccacauggagauucuucuacuuauuugcucauggagaauauggucuucacucaacaaguauuuguugaaugaaugagaaaaagaaucaagaauuuuuuuuacauuaaggauaucaaaaagcauacaaauauaaucugaauuauuugggucaagaaugcgaguaaaauguauggggaucauugaauaauuaggcuaaauggaucugucaaaggauggauacaguguuuucaagcuccucuuucccaaaggguuuaagcauauuugauaaucauauacuuauuugcuauaaaauacaguaacgauuauuuaaaaauuuucaauuuggcacuuccucccuaggggacacugggcuucuagggagucuucaugagccaaacaucgguaauauuauauuuucaagaacugcugaguugggaggcaauuuguaacucuggaucugaaagccaugauuuggugacacugugaaacugcucuucuuuaaaaauacuguaguaggcugggcaugguggcucaugccuguaauccuagcacuuugugaggccuagauggguggauugccugagcucaggaguucgagaccagccugggcaacuuggugaaacucugcgucuccacuaaaaauacaaaaaaucagcugagcgugguugcacgugccuauagucccagcuacuugggaggcugaggcaggagaauugcuugaacccaggagguggagguugcagugagcugagauugugccacuucacuccagccugggugacagagcaagacucugucuuaaaaacaaacaaaugaacacaacccccaaagguauaguccacauuuuauugaaaacuggagaacaagacuaacuaagguuacaugccuacuuccuaguaacuuuaucaaucaauucugacauguacacuguaacugagugccucucuugaacaggauucccagccuagucugacucuuuuauucugccuucauguagcucccauaccacagaaagagaaaggaggaaccccgguucuugcuuuucauugguagaguagaacuucagucauucuuuguuagagauuacuuuagacagaguauucaaccagucguguuguuguuuccaaauaaauuaaaaacgaaauuggguauuuuaacuuuauaagaagauaaaacugcauuugaaaucauagcaaucaaaauaacauuuguaacaacuuuugauuuuagugaucucuuucauucacuuauucuaaugugaaaagacugcuuuuuuagaaagccaacaaaauaaaaauuaauauuaaacuuucuaccuguauugaaucagcaaguaugcauuaaauucuggaacaugaaagagguuggcugagaccuauucugacuaaaaaaauuuuuccauggcaggaaagaaccuacugauuauauggcaagcucuuugacauauuaucuauuaauaauuuuguccucaacaugaacccugugagguacauauuauucauguuaguacagcuguuuuuuuuaguacagaaaagugaaaauaagggagaaaguagauuucuuaagaucacagagaauguaaauccaagucuacuuugccuauccagagcucugaguccuaugaucuuccaaaauaauaugcuucuggugugcuaaaaaguaaaauuauauuauugauauauaucuauaucuauauauaugauauauaucaauuauauaguugaagguuuuuaaaaauuaaaacuaaauaauaucuauuuaagaagaagaauuaaauaauuagguuuagcaguacuuggcaucugccauacaaaguacuuacaagaaaauacuuuccaacauccacguuuacucuuuuuaagcacacauugaauaaaagcauagagcuggcuugagaugagucaucuguucugucacauuuacaaaugucuacccaaaacaaagcuggcaguuuccaguaaaacucaauaugaguugaagccaagaccuugacuccaaaaucaaaugugacugaaucagaaccccuccagccuuccucagcaccucacacgggaaugaagaagagauucuacauucuaacauacguuucaaguaacugagaacaaauagguucugucucugcaguguagauuuucucauuagcaaaccauauugugucucauucccuauacaaauuguagcauaacacaccagaauacaauauggagcaaaaaauaaacuugcuaguuguggagccaauaacugauaagagaaacugcagcugaagacaaaaaagaaaaauaaugacgcagaaaagcuggucuaggagaagguggaagacaaacagcagauuguauuuuacauccugguggagaugcauaguaaaggcuaagggaauuuacagcuuaucuggccugacccugaugcuacucaugggggaugaguuucaauccaguugugcugagagggcuugggcaaguuguuuuccuuuccauaucugauauucauuuaaaaggaggaaauaaaaaaaaugcaccuuucacuauuauugugaggauuagcacuagugcccagcacugugucuggcacugaugcagguucuuaguaaauaguagccuuuguuauuuacagauggggaagcugagggccagggaggaaaaguaagauucaagauggcauuaguaugugcugaaacuggaaacaaggagagaaaacagauuaaucugaaauaugccaugucagaucaguauuagagagcuuuccagccacauuguaccucaucuagguucgucccaggaaggcaagcugccugcucgugcugccaguaguaggugggaggauucuagaaguaaagcuguugucacuaaucacugaaucauuuuuuuuuuccuuccugguuggcugagaaccucuccuaaaagccaaaccauucuucccagaucccugacaacucaacaaaaacucaacuuauucuauguaaugggcucaucuuggugcuuuagaaaauuuaaaaaaugaguauauccuacugccugccuuugaguuuucaaaauuauuagaaagguaaagcauguguauuccuaaccauagucaaaacuagaauacauuccagaaacacauuacuacaaauuuuagaaagagaaauccccucuucuuugggauagucaauaaggacuuuauagaagucagauuuaacuggguuuuaaaggaugagaaggaauuucacauuagaauacuaaaucugcuaacaaaggagaugcauucuagcagcauuuuuauguggucuucaauugcacuaccaaacagagaaguaacauuggaggcaaagaaauuaauuacagaugccagguaagggcagaaagaauuggaugauggggacaaggguuagacacagggaagugucauuagugucaaccaauuuaugucaaaucuagagaaugagugcaaauauacauaugguagucuuugggaggauagaaagaauaagguaauuugaggaggagggaaugcaguagauaguugccaaagauagccaccagcaaucccuuuuccacuacauacaugagagauggaauugauuucuccuccccagaaucuuggcuggccugugacuuucuuugaucauuauaaugcuauagaagugacgcugcccuuuccgggccucgauguuaugggucccagcaguuccugcuuucacuuuccuggcucucagcuaacaaauugcaaagagguacagaauaucauccaguauccuacagaaagaggccauauggagaggccaggacaaugggacuucauauauauaguauauauagagagaggaaaggggaaaggaggggaauugagguaucccaggagagucagugccaaggucccagacaugucaagucaaaauuuauuuacagagaaucacagaagucucaaacuacuuuuuauuuuuuuuuuuuaaaaaagaaagugaacauaucacuaaagaaugaaucucaaacauuuuuugaguacuucccauaugacuggcaaauguuaagggggcaucaaugaaagccugauaaauaucuggcaacccaaacuaucuuuuauucaugauuuaaugcuuaacucaaaacaacucuuagaaaaacuguccugacgcucacaucaccaacuagggcauauuagaagcucucacucauguuucuagaaaaccugaucuauucccccaucauauagugauuuguuuguuggucugccuuaucugcuaaacucaaccacauaugcacagagaccaauaacuuuuaccuuuaguauacagcaggugcuuacuaagaaauauaaucacuuuaagguuacguacuaggcacucgauugauggauggguggauagauggauagaaugacuacgugcucugagaacacagugaaaacuuaaaauuuagcuuuaauuuuuuuuauuuuuaauuucuauggguacauaauauuugaacauauauaugggacacaugcaauauuuugauacagcaugcaagguguaaugauaaaaaucagguuaauggggaucuccauguucuuaaacauauaucauuuccuccucuucuuuuuuuuguuuucguuuuuuuuuuuuuuuuuuuuuuugagucaaggaccugcucugucauccaggcucgaguacagugaaguaaccauggcucacugaagccucaaucuccuggguucaggugauccucccagcucagccucucaaguagcugggaccacaggcauacacccucaugccaagcuaauuuuuuaaaacuuuuuauucuuuuguagagauaggggucucauuauggugcccacuauggucucaaacuccuggguucaagcgauucucccaccugagccucccaaagugcuaggauuacaggcuugagccacaaugcccagccauauauaauuuguguuaggaacauuucaaucccacucuucaaguuauuuugaaauauacaauaaauuauuguuaacuauagucacccuauugugcuaccaaacacuacaucucauuccuucuaccuaacuguaguuuuguacucauuaaccaucaccucuuuauuccuccuuccccacuacccuuccuaaagucugguaaccaucauucuacucucuaccuccaugagaucaauuguuuuagcucccacucaugagugagaauaugcaauauuugccuuuuggugccuggcuuauuucacuuaauauaaugaccuccaguuccaaccauauuguuguaaaugacagaauuucauucuuuuuaugguugaauaauauuccauuuuguauauguaccacauuuucuuuauccauucauauguagguagacacuaaggcugcuuccacaucuuggcuacugcaaauagugcugcaauaaaccugggagugcagauaccuuuuugaaauacugauuuucauucuuuuuuauauauauucagcagugggauuacuggaucauauaguauuaauagcucuauuuuuaguuuucugagaaaccuuuaugcuguuuuccauaaugacuauacuaauucacauucccaccaccagugggcaaguguuccccuuucucugcauccucacuaccaucuguuauuauuuuaucuuuuugauaaaagccauuuuaacuugggugagaugauacuuauuaugguuuuuuauuugucuugcucugauuauuagugauguugagcauuuuuucacauaccuguugggcauauguaugugaaaaaugucuacucagcuauuuucccuacuuuuaaauacaauuauuaguugcuuuuugcuauugaguuguguucuuuauauguucugguuacuaauccuucucagcugaauaguuugcaaauauuuucucccauucuguaaguugucacuucacuuuguugauugucucccuugcuguguggagauuuuuagcuugauguaauccuacuucuccauuuuugcuuugguuucuugugcuuuuaaggucuuacucaagaaaccuuuguccagaccaauguccugaagcauuucccccaauguuuucuuuuacuaguuucauaguuucaggucuuacauugaagcccucaauccauuuugauuugauucucaagaaaauacuagcaaaucaaaugcaacaacacauuaaaaagaucagucaucccgaucaaguggauucaucccagggaugcaaggauggcucaacaaaugcaaaucaguaaaagugauacaucacaucaauagaaugaaggacaaaaaccauaucaucauuuuaauagaggcuagaaaaagcauuugauaaaacccagcauuccuucaugauaaaaaacucucaaccaauaggguacaaaagaacauagcucaacacaauaaaggcuguaucugacaaacccauagguaaugucauacugagcagggaaaaacugaaugccuuuccucuaagaucuggaacaagacaaggaugcccacuuucuccacuuuuauucaacaugguacuuaaaguccuagucagagcagucagacaagauaaagaaauaaagcucauccaaauuggaaggggagaaaucaaauuauccuuguuuuuagaugauauaaucuuauauuuagaaaauucacuccuuuaaguugcaacuaauuaaucaagaaugauacugggcuuggcauuguggcucacaccuauaaucccagcacuuugggagggcagaugaccugaggugaggaguucgaggccaggcugguaaucccagcuacucagaaggcugaggcaggagaaucgcuugaaccugggugguggagguugcagugagccaagaucacaccauugcacucuagccugggcaacaaaacucaggcuccgucucaaaaaaaaaaaaaugauauugaaucauuugucauuuugauugagaggaagcuguuggaaagcagaaacaagaggagauuccaggucuggauuucuauucugccucagaggauaacuggauuaugaggugagacaagugcccugaugcucaucaauguaggguucuaagaacagagaaaaaggcaacuguggacauagcuuggugugggagguggugagguuaaaaacugaagcagggcugggcuggguggcucaugccuguaaucccagcacugugggaagauaagcuggguggaucauuugaggucaggaguuugagaccagccuggccaacauggugaaacgccaucucuacuaaaaauacaaaaauuagccaggugucauggugcaugccuauaaccccagcuauucgggaggcugaggcaggagaaucacuugagccugggaggcagagguugcagugagccgagaucgcaccacuguacuccagucugggugacaaagugagacccugucuaaaaauaaaacaaacaaacaaaaaaacaaaaacugaagcaagagagugggugagcaccuugaaggucaugcucagggccucugaguuuuaucuuagauggagugugaagucuuuggaagguuucaaaaggagaguaaucugauaagauuuuguggcauuguggaguaaacucucccugcccagaagagcaccagggagugguacagaauuuccagugugauucuacaugucucucuggaaauaccuugguaaguagaugucaccacaguuuucauggcuaacagcuguuuuuaaaccaugaacagcuuggcuuuuagagaaccuauuaauuaucaauuuaugaaaacagacaauaauguaugaaaaaacuccaagucauaguaguagaucccuuuauagaucuggcagcuuuucaaguaagugcuucugguauuuauaaagaucuagaugcaccaucuggaacuagacuagaucauaauucaucuaaaaauuugguaauaaauugaaaaacucagaaggguugccucaggcaauaguacuauugcuccauugucuuagacuguuaagaacacagucaaagaugcucuuagccacagaggaacuuacauucguauucuuucuucaacuuaaaaagacagacauguaaacgagucaaagaaauuaagugcaggcaauagggagaauaaauuggauucguuuccccauuguggagagagcucuguggcagauuacugaguauaaacaacacaggguucuugugagauaaggcagcugucucugugugguuccugcagacaaguauucacauuaaagcauccacuucucuaaauggcaguaauuggcccccagcugacagucucaaagcaggccaagaagugggaguuaaauggaguggauggaaacaagacauagccuuccagagccagguggagacucccuuucgcagccccagaggaaauccagggauauccuuuguuucauaucauucuugccucuugagguuugaaauauauuacuaucucuaaggucagcaaaucucccagucuaugacugguagaaaugacaaggcaagacucccuagaagaacaugaguagagccucugccuggcagagaacaugcaguuucuaaccuuuucccugcggugccaccagcagguccacgggcagagugacccacaaugcccaguucauccaauacccaaguuugcuggcugcauuucuaugaauacaaaacacaggguugcgcuucauggacccugucccccaagagcagaauuaggcucuaggcugaaaaacacuggacuauccacagagaaagaggucacauuuuggggggcauaagguuuuugcugguuaauuuuugcuaaauaaagucagaaacugaauuucuauuucuaaaggguguuuuuaaauucucaguaaaaacauuuuuaaacugguuuggucccuuucucucaaauaacuguaggaaugugaauuacaguacuuuuccucuaaagccauuuuacaaucuaauuuucacaaucguaaauuuuucucuuguucauuauuauuccauuuguaucauuuccuuugucuguuuauuagguuucauuucaauuauuuagacuauuuauuauaauuauuacuauuauuauugcuguuuccgaaguuauuuuuucuaucugaagugaggguuuugagaagugaaaauuaaccuacacguuaccuuaaaagugcagguugauaaaacuucauagagcucucccucucccucucccucucccucucccucucccccucccccucccucucccucuccccuuuccacagucucccucugaugccgagcggaagcuggacuguacugcugccaucucggcucacugcaaccucccugccugauucuccugccucagccugccgagugccugcgauugcaggugcgcgccgccacgccugacugguuuucguacuuuuuugguggagacgggguuucgcuguguuggccgggcuggucuccagcucguaaccgcgagugauccgccagccucggccucccgaggugccaggauugcagacggagucugguucacucagugcucaauggugcccaggcuggagugcaguggccugaucucggcucgcuacaacuuccaccucccagccgccugccuuggccucccaaagugccgagauugcagccucugcccggccgccaccccgucugggaggugaggagugucucugccuggccgcccaucgucugggaugugaggagccccucugccuggcugcccagucuggaaagugaggagcgucucugcccggccgccaucccaucugggaagugaggagcgucucuucccggccgcccaucgucugagauguggggagcaccucugccccgccgccccgucugggaugugaggagcgccucugcccggccgcgaccccgucugggaggugaggagcgucucugcccggccgccccgucugagaagugaggagacccuccgcccggcaacugccccgucugagaagugaggagccccuccgcccggcagccacccuguccgggaagugaggagcgucuccgcccggcagccaccccguccgggagggaggugggggugucagccccccgcccggccagccgccccguccaggaggugaggggcgccucugcccggcugccccuacugggaagugaggagccccucugcccggccgccccccccgucugggaggugugcccagcaggucauugagaacaggccaugaugacaauggcgguuuuguggaauggaaaggggggaaggguggggaaaagauugagaaaucggaugguugccgugucuguguagaaagaaguagacaugggagacuuuucauuuuguucuguacuaagauaaauucuucugucuugggauccuguugauuggugaccuuacccccaacccugugcucucugaaacauaugcuguguccacucaggguuaaauggauuaagggcggugcaagaugugcuuuguuaaacagaugcuugaaggcagcaugcucguuaagaaucaucaccacucccuaaucucaaguacccagggacacaaacacugcggaaggccgcagggugcucugccuaggaaaaccagagaccuuuguucacuuguuuaucugccgaccuucccuccacuauuguccuaugacccugccaaaucccccucugcgaaaaacacccaagaaugaucaauaaaaaaaaaaaaaaauuaaaaaaaaaaaaaaaacuucauagaaguugccaaagacuacauaccuauuuaacaugcauauacaugauacacguuucuaagaaguaaauauacacgaauguaugcaugauauauaauaaugauacauaauauucucucuauguuugagaacucuuacaaaucuuaguucucccaauuuguaagucuucuuugaggugauaauaaacagagcacacaucccaggcuuuguacgaaauauuuuguuuuccaguagagucacuuugucacuucccaauggggauauguucugagauauguguuguuaguugauguugucauuguaugaccaucauagagcauacuuacacaaaccuagaugggauagccuacuacucaccuaggcuaucugguacagcccauugcuucuaggcugcaaaccuguacaguauguuacuguacugaauacugcaggcaaaugugacacaaugguaaaauaguaacuauguguauaucuaaacauagaaaaaguacaguaguaauauggcauuauaauauuuugauacuaccauuuauugguccaucauuaugaaacaucauuaugcagcacaugacuguauuugcagugaagguccaugcuggguucaaagcuuuuuaaagaccuuuuccaaucacggaagcccacaaugauuucagucuugucuaaauggcugaagcaauuuugucuccuccauaugcuauagaacuugcuaaguugagguaugaugaugauagacuaaggcucauggcaacaaacguagggagaucuauacacccaaaugaggcguguccuucaaaggagucuuugugggaaguuagucacuuuuuuuuuuuuaaagugagcugccuuugcuuaaaaugcuuuucuauaauucucuuuuuaaauggccuuaaguuuaugguucuuauuuuaugcuucacaguguacaggucaaaaaaaaaaucucauuuccuccuugcaguugggucuuagucuauaauggcauuccuuaucaugaucagccaccuuauucagcugacuuugauacaaauaacuuugggagggauccccaaaucaaaucuucccucaacgaugaagauuuuuauccagcacacagcauauaauaaauaugugaugacagaaugauugaaucugacacuugggaguauagacaaaauuuggcacuacuggcucaaaaaauggaguuuaaaaauugccacaagcaauggcacuauugccucauugucuuauauuauuaucuuauuuaauuuugacacauacuauauauuuauugugugaagaauuuguaucuucuauuucuuuuguacucauccacaaaugcccaugacagaggccuguuaaguauuucccuuacugcauauaucauacuguguauaauuuccacugaaagauuuaacggcaaagaucaggaaggagagaggaaaauaguauucugccucaacuauaauauugaguggugugaaaaaaacuugauaacuugacccaaucuuccuuucaggcugauuuucugccuuagcaaugugucucacucuagacaccauauuugaaccauagagguuuacccauagcuucuggaagacaauuucugcucucaugcaucugggccuucacucaggaucuugucuuugccugaaaugauuuccuuccuguagccugacuaaugacaaucuauacaucuuccuaaauucugcacuaauuucauuuauuugguaaagucuuuuuggaacuacugaacaggaaaaagauuucuugccuuuuuuuuaaauuuaauauacauuuuuacaaugcuuuguagacauaacaaauagcuuacauauuauaauuacuucccauaucacauuggagacacagaauuuggaguuccauagcugggaccacgucuucuucccaaugcucauccaguaccuaccucccugcaugacaaauguuaugauuuacuacaugauugcaggaugaaugccuacaggauuauugauggcaccuaaaacuagugugcuuuccccucuaccccucaccucaucuuuuacccaaaaagaaaaacuucaucuuuccuccuggaguuuccaccaagaaaaaggaaacucugcuaauauauucugggaaguaaaugucuaccauucuuucuauccuucuaauugcucuucccugaggagaagugacucacagaacugcugagauaagggcagaauucucuuauuauuuucaugccugaaacucuccuucuuucucuugcuguguagcacauggguuaugggaaggccugggguuuuacacuggcugcuuuugcauguguaggcaggugagagaaggugagcuucagcaagcuuaccaucauccaucuucuuugccugcgaucuaguuggauaaauucaauauggagggaaacaaggaggaaaacacgguuagacuucaucagagacccugugugcuggguaauagugugaacacucucaguuacuauguucaguguucauucucugcucuccuuuuuccuucccccaaaaucgacuccucuaaaguagcugaagagaggauaccuuuaucccuacauccaggauagucugauuugucuaaaucaaucaugguaaauccauuucccuugucaggauuuaggaaugagugugugacccaauucuagccaauaaaaugagagggaaauucaugaaagccuuacuggaaagguuugguuuucuuacuccuaaguaagaguggaguuucuguuuuuccucugaauguuuauaugucuagauguuacaucuguagcuaacacagccaucucacuuccagugcaaggaugaagccauuacguacaggacaaaaacccagagaaucacugaguuguaucucuagagcccugacauccuggaguaaacuuaccucugaacagcuuuuuauuugagaugagaaauuacccuacuuuuaagucaguuuuauuuggugauuuuuguuccuuguagccaaaacuaugcuaauugaccuacuaauaaagcugguacuguauuuaauuucucaucugacuauuggaucuauuucucgguugggugguauccauaagggaaaaugauguaauuauauugcugaaauuugcaugcuccuuuugccaaaccuacucaaguuacaccaucaaucuugcaaaaagccuugugaaaugaaguucuccgugcacugugacaacaauguauuuggcagaaguaugguuaauauuuucuaaaggagcacauuauucauuaucuauaugcccuacuaacgcauuuuuaguuuaauuuucuucggucuaagugggaagacaaguuacggcuguauuaccacgauagagacacgaauauaaaaguacucagaguagcaacauaguguuauuugaaggguaauuauugauacugaagauuuaaauaacuucuuggugucauuaccauauucuucaguuuauguugaaauuuuuaaucuauuuguuuuaguguuaacauuuugaugaauaguuuuuguauuauuugggaaugaaaguaggaaaaaaagaucuagucuuuauagcucaaauauguaucucuucaccuuuaguaauuuaugcuggaacaucacacaaaagauauuucucagaauggauaugcauuaaaaauguugggagauugcauuacauuacauuccucuauucaagauucauaaggcacauuauacuauccagagcuccaagaguccuaaaguguaaaaaaaaauuauuuuacuuuguguuucuaaaacuuauuuugacaaaauaucuguuaaaauuccauguaaguaauauuuuaugaaacauauuggggggaugcuggcagaggaugguuguuaucaaacagcuuaaaaacccucaaacguaggguuugacugaguacaagucuuaaauacuucccauuuuuagauaccuuuuuuuuucauugauggucaauaagaacauauuuaguuggucugaagggaaucuaaaaugcaacauauagaaguaaacagguauucaugaaacaaaguuaaguugagaauuuuuucuaaaggaagacuaaagucuaaaaccauucaauauaauacaguaucaugaauaagcacaggugucucagauaguuuuuuuuacaaagguaaccauguaggugaaauuaggggggacacugauguucccucaacgagaauuauaacaggagaaugugauuuguaaguuaauagcaaguaauuugacagcaugguaucagggugggacuaaguaagaacuaguugagagggacugacacucagagaauaagccugaaaacacaaacuuuaagauauuucuggauucuuuauccauuagauuauugaaacuaucuccacgaucuugaucauuaaguaaguagaacauucagcugucuaagacccacucuuuguuaaugguaauaaagagaaugaaugagacaaaaaaacggaggucuuaaaagccugagaugcuccaugaaacagcuggacuggugcauuuuuaaagauguuaaggaaaugugcugcaggagggcaucagcacgaagcuuuuacagacuaauugucucgacuccagucaccccaugaauccccugcagcaucucugugcauccuugcccagcugugcuugguuauagagaagcuuccuuguuuuuuugucaucuguguuuuaugcguauucaauuguugauuaucugcaugaggguauuccuuguuauggauaauucacaaaacauguuuuauguuuuuuuuuuuuaauaaauccuggaccagcuuccugcuauaagcaauacacuuuguagccaugucuucuacugcucuguugguaagugcuuagcaaacagaaccucauuuaaacacuauccuagauaaaauauaauuagguaaauagaucugucaaaaacaauauuaaaauuccaagccaaauagaaaugucuuugggauuauuugugcuaaggcuuccuucaauugucauuaauaauuaaaggugccacuguguuuauucucccuuucauuuuaaaaugaggccaauuagagcgggucuccuguguuuuuguuauaguacauaagccacucuugagagguaugcacacuguagacagucaauggauaauggauuugcuaacaaaauaccuuuaaacaaauuauuggacauagauauaggacuccacauaaagcuuuuauucucaugaggcaucuuggacuagcuuauauuuguaaucacuucaaagucuguauuuccuucuauucucaaaucauggucucuuacacauaaggggauaaucugugggcuacuggccagugaguaguuugggccaaauaauuauuuuacuauauuguggaucuaguuaaauccuaugcuucaaaaucaguuguagauaagauugccuauugcaagaagcaaaaugccuaacucugccuggcuuaugugcuuauguauuuagauccauaugaucacaguauuacuggaaauuuagcauaucagugcuaaaagggaaauuaaauaaaaucaaauucaacccucucauuuuauaugucagaaaauaaguccaagagagguuauaugaauauuccaugaucauucaacuaguuaauaacagagcuagaauuaaaacccagauuucuuuacuagcaccuaaugacucagucacugaaccaaacugaaaagauguuugggagaggaggauuugugaugaaccucacacauaucuacuauggggguagaaaaguauuaugaaauauuugcccuugaagaccuuagacagauaacuucuaauuuaaaauggaagagcaaugucuucucugcuucuccuuaccaccugaacaccugaaaccaacgaaagcugacaaauaaaauuagaaaugaaaagacaaacaggagaaaauauuuaguuaaugcagugaaagcaguaauaaaacaauugagaaacaaaagacaugagacauaggaaacaaaaaguaaaauggcaaauauaaguacaaauaugucaauaaaaacauuaaaagugaauagauuaaacaaucuaauuaaaaggcagaaauugugagacuggauaaaauaaaaaacaagauucaacuauuugcuguuuacaggagauacacuuuagauucaaagaaaccagauagauugaaagugacaggauggaaaaacacaugucaugcaaacagcaucugaagucauuaaaaaaagaggagcaaacuaaaugcuaggcaagaauagggaagaaaauaauaaaagcuagaguggagauauacaaaauaaauuauagaaaauaacagagauaguuaacauaaucaaaacuaauucuuugaaaagaucaauaaaauggacaaacugugaacuagacucaccaagaaaacaaaauggaaaagacucaaacuacuaaaaucaaaaaugaaauaugggguauuacuacgaacuuuacagaaauaaaaaagaugauaagggaaacuaugaacuaauauaugccaacaaauuaaacaagaugcaaaggacaaauuccuaaaaaaauacaaacuaccaaaacugacccagaaagaaauagaauauauuaacggccuuuaacaaauaagauugaauuaauuguuuuuaaaaaaaaaacuacccauaaagaaaaguacaagcuucacuggugauuucugcaaaacaaacucguaacauagaaaaggagguaucccuauucauucuaugaggcuauuauuacccucaugcugaaacgagaaaaagacaucaccagaaaaaaaucauacugaaaucucuuaugaauugugguauaaaaaacuucaaugaaaugcuagcaaaucaaacccaggaauauaugaaaaggaucauaucucaugaauaaaaugaauguauaagauugguuuaacaucugaaaaccggugacucuaauauaccauauucauggaauagaacuaaaaccauaugaacaucucaauaaauacagaaaaagcauuugacuaaauucaacacccuuuaaugauagaaacacucaacaaguuagaaauagaaggaaaugucuucauccuggugaaggacaccuagaaaauaaccacagcuaauaucauacuuaauggugaaagacugaauaccuucccccuaaaaucaggaacaagacaaggauguaugugcuuaucacuucaauuuaaaauuuuauaggagguucuagucauggcaauuaggcaagaaaaauaaauuaaauacauccagauuauaaaagaagaauuaaaauuauuuaucuaaagauaacaggaucuuguauauaaaacaucauaaggaauccacuaaaaacuauuauaacuaaaaauuagcaaaguugcagaauaaaagauccauauagaauaaccaauuuuauuuguauacacuugcaauaaauaaucuaaauauaaaacuaagagaaaauuccauuuacaacagcaucaaagauaauaaaauacugaggacuaaauauagcaaaaagggcacaaaccuauacuuuaaaaacugucaaacauuguugaaagaaagcaaaaaucugaaugaaugaaaacacaucacauauucauagaucaaaagacuuaauauuguuuauaugggacuucucccuaacuugaggucugauuuaaugcaaccuguauuaaauccccaccugauuucuuuguagaaauugacaagcugaucuuaaauuucaugugaaaauucaagggacucagaacagccaaaagcaucuuaaaauagaaaaacacaguuggaggacucacacuuuccaauuucaaaaacugcaaagcuauaguaaucaaggcagugugguauuggcauaaaaauagauauauagaucaauuaaauagaaauauacucucagaguuauggucaacugauuuucagccagagugccaaacaauucaauggggaaaaagcaguauuuuucaauaaaugaagcugcuacaccugguauacacaugcaaaaguauaaaguuugaccccuaucucacaccauauacaaaauuaauucaaguggauuaaagacaugaacauaacugcuaaaacuauuaaauucuuagaugaaaacauagguguaguaagucuucaugucuuugaauuagaaaugguuucuuagauaugauacuuaagcacaagcaacaaaguaagaaaauaaauaaauugaauauuaucaaaauuaaaauauuugggcgucaaaagauacuguuaauaauguaaaaagacaacacacagaugauaaauuuuuugaaaaccauauaccugauaaaaccagaauauguaaauaacucuuacaacucauuaauaaagaagauuaauaauucaauuaaaaugugggcaaaaaaucaaaauaagacuugcuccaaguaagauaaacaaauggccgauaaacacaugaaaagaugcccaucauuagucaucagggaaauuaacaucaaaacccugaauuauuacuucaccuggaguaggauggccauaauaaaaaagauggacaauaacauauguugccaagaauaugaggaaauggaaaccuuuauacacuguugauggggauguaaaauggugcagcugcuuugaaaaacagucuggcaguuccucaaaggcuacacauacuguuacaauauagcccagcaauucaacucaucaauauauaugaagaaaauuaaaagcauauaucuacagaaauacuuguagaugaauggucauagaagcauuauuaauaacaggcaaaaauguaaacucaauuguccuucaguugauaaauuauaaauaaaacguggcauagucauacaaugagauauauuauucagcaauaaaaggaaugaaguacuaagauauauauauauacacacacacacacacacuacaacguggauugacuucaaaaacauuaugcuaagugaaagaagcaagacacaaaaugccacauauugcaaugauuccauuuauaugcaaagucuaagauagguaaauccauagauacagaaagugguugcuuagggcugagaaguuggcggagauagaaaaugguuauucauggguaugggguuucuuuucgguuacugaaacgauucuaaaauugauuguggugauaguugcacaacaccgugacuauacuaacagcauuaaaugguauaauuaacaguggugaauuguaucuucauaaaguuguuauuaaaaaagaaacucugucuuuauuuggaaaugccugaauaauauacuauaauacguggagaaagauucugagagcaaggcugcaggugaaggggcacagagagaggaccacauccccuguagaacuuaggcagagcugaccaagcaaagaaugcuucuaauuagguggugcccuuaggggaaacacuaggagacccaccuuggaacaacaaggcccauuugugugguuucugggccaagccgcucuaugcccggaauggcaggcaacacggagcaguggggaagaggagacuugaugaggaaaugacauccguguccuuucgcugaagccugacuuguccauguggccacguagagaagaacauguguauggcgcauguuccugaaguuaccucuuuuugccaacugaagagaaguaagagcucaaugaguacagaggaaacccacaaugggcaucucacagcuucacagggaguuuuccugcuagcugagggcacauuuaugucuggggcagaggaugcaugaguaugcugaagacaucagaguacagugcaaacuguguugcauuguccuggguuacuauccuugucccuuccuuauacucuccuagugcaaauagcugguuuuuaucuucauaaccgaauuaguucccuuauucagugaugaguaaauaccaaaaagaaagcaugagaccuaugcaaagauacuaccuaaaugaaaaaaaaaaaaaaaaagagagagagagacagcaaacagaaggccagagaaagacuauauauaucaaacaagagguaugacaaaucagauaaaauguaugacuauaugucauguaaguaacaggagcccaaagaaggucuagaagcucccagguaagauauuauaggacaauggagguaguugaaaagugaacugauagauuuuggaaagaaauggaagggaaaaaaucaacacagaaaugaaaaucagcaagaggagaaacuggcuuuacugaaaaugucaucagaggcaucuaggacaaaugagaaaaaaaugaacaaaauaaaauggaaaaggacaaaaaguugauuaauauuaguaaagagacaaaaauaaugaaagacaaaacgugcaacuagaaauaacagaugacauuuuaaaaauaauaauguaauagaaaaguaacuuuacaagagagaacugaauuugcugaaaguagaaacuuccaaggaauacuuguaggcuuugguaaaaaugagaauauuacaggaaauuuaucgaaaaagaagagcaaauauuucuguggguauccagagaucaguccuaggagauguggaacgucugcaaaaugcucagagguggaaguuaugauccaauaaugaccaugcccauaaaaacugccacauagguggaggguuuauauuacccaacaaacaaguguucucggacuuuaacucucacgagcauuucuuuaaaaaguuauuaaauaguaaacuacagucaaccaugagauggauaaggaagacacaguagagaaaugauggcgaauauugaauccaugcaaacauagaauagcaucuaaacaacugugaaauucaaguuauaaaaugggauaaaaguaacauuaauuauaacaacauggaaauaauaugauuagcagaguuuuggggauagaguagcguagagaacguaggguuauuacaauaaaucagguuuccuuuuagcagggaggugagccaauugauaaucuccagagguuaaaaaucaaauuauaggaagaaguguaucacuauucuucauucgacaaauacuuacugaacucuguuccucuaugcaggcauuaaggagacaguaguaagcaaagccaagcuccuccugcccacauuuuggaaagaaagacagaaaauaaauagggaaaugaaucaauacuuucggauagugauauauauguugaagaaagugagcagggcuggaggggugcuggggugggugguggacuuucugacacaggacaguugaggaaggcucuuccuaguaggugacauuuaagcgggaagcugaaugauaaacagacaugacaacuaaagauuuggggaaagaaccuucuaggcagaaauaaggguauaguaggucaggguucucuagagggacagaacuaauaggauauauguauauaugaaaaagaguuuauuaaggaguauugacucacacaaucacaaggugaagucccacaauaggcuuucugcaagcugaggagcaaggaagccaauaguggcucagucccagucccagacuucaaaaguaggaaagccgacagaacagccuucgguuuguggcuaaaggcccgagagccuggcaaacugcugauguaaguccaagagugcaaaagcugaagaacuuggaaucugauguucaagggcaggaagcauccagcaugggagaaagaugaagaccagaagacucagcaagucaacaccuuccaccuccuuccgccugcuuuuucuugcccugcuagcagccaauagauggugcccacacacugggagacuuucgcucccaguccacugacucaaauguuaaucucuucuagaaacacccagaagcaauacuuugcauacuucaauccaaucaaguugacacucaauauuaaccaucacaaggggcaaagguaagagcuuggaagcugucaguacauucaccuguguggcuggaugucugggcaaagcagaggagucauggguaagacuggggaggagucacaguuucauccuaagagugauaagaagaugccagagaauugugagcaguggggagacuggauuuguauuuuagaaaauaaaauauucugccauguaguaaauagaacgaccagccaagaagugacugcaguggaggaagugaaagguuguuugugguuuggauaguggugagaaguuagauauaggguaggucuuaaaguuggcaacgauaggacuucguuucuaauguuaaaguguacucuauugggccgggcgugguggcucacgccuguaaucccagcacuuugggaggccgaggcgggcagaucacuugaggucaggaguuugagaccagccuggccaacauggugaaaccccuucccuacuaaaaauauaaaaaaauuagccaggcauggugaugcaugccuguaaucccagcuacuugggaggcugaggcaggagaauuucuugagcccaggaggcagagguugcagugagccaagaucacaccacuuuacuccagccuggcugacagagcaagacacugucucaaaaaaaaaaaaaaaaaaaaaagaaaaagaaaaaaaaaguauauccuacuggaugauucaugagggucuccaugaggugugggaguaagagaacggaaagagguuccugggauuuuugggauuuuuugcaucagcaacuggcugcgucaccgcugcauccaccaagaugaugagggggguuggaggcaggucaggccaugccaguaucgagaugcugaugagguuucugaagggagcuauuaaauagcaaguugaaaauacaagucuucagcucaggaaagaggauggugugagagauaaauuuugaugucauuugcauauagaagguauguaaggccuagggaaugaagauaaggaccuacagugccauuaacagugaagauauucuggcaugacuuugagcaacaaagagcauaaacaucacugaaguauggucucugugugggacucugguugagcaucuugauuucucuaaguauuuguuagcuuaucuggaaaauaagugguaagaacaaacauucaagcauucaagccacaccccacuaugccugaaaaggucauauugcaauugucuaauuucucagaagguaaaguuauacauucugcuucuuacaaaaguuaccucuuuaaggucuucagaggagugcaaaauuugacuaggacaguuuaggauucaucaaauugacaacuugagagcaaucuauacuccaguagauguuuaaaacucuacauuuaguugugagucucuuaaauaugcagcaaauaauuuaagugauccaagauucugcacaaauaacaagaguuaauaaccucuguugcauuucuaguggcaaaggauuaagaaaaugaaaugcauccuguccagaauaauacuaucccaaagaauacaaaaucaguccaccuuauaaacucaguccuucaagaauacaaagagaauguacuuccacaauccacaaguugagaaaaguaacucugcuuuucaacccaucuuuagucacuuauuuuugugggaggaguacaaaaucuuauacauuuugcuuaagcaacuuauacuuuuccauauucauuacagcauaugcauuaaguguuguuuuaaaaugaguccagucuaauuuccauaauaaaaaagugauuacuagcucucauuauugccuaauguggcugccuaauuaauuauuauaaaaugaaaaaagucuuacuaaugagauguuacuaacuagcuuucucagcacugauuuucuuugcuuguuaaaagucugcuauuuuacaaaccuguuuucuaagcaccuuaaaaaauuaccuccucauacucauaacuacuucacauagguaaauauuguugcuuuuuguuaaaguacagcucuaggcuauaacuacagaauacaaaaacagcuaaaaauaaugaauaauuuaagccauuaauuaaugauucuaaccaugugguauacaaugacuauuuuggaaucgcuucaaacagaauuaauauuugauuugacuuugugucaccucuccccacuuuuccaugaaagugauauuuacaaaauugggucuacaaaucugucugaaaaauucaguugcuccuuuagacauauccugugagcuguaccuggcugauacugaagcacccacaucauaccaaauugccugggacuccugggaccacauccaccccagcugagugggaugcauucuccagccaucugcaguaccagugcugauguuuacaugcuuugcaaucccauuuucaugguguaauacugaagugaaagcgcacaccugcagguauucagguauucauucucuaccauaugcaucacuauucccaucaucagcccuguacuucucugaugcccaacaacucuugaaaucuuucuacugucuugucuugucuugucuucucucucucucucucuuuuucccucccuuccucccucccucccuucuuuccuucuucgagacaggauaguggccuguuguccagccuggaguucaguggcaugaucauagcucacugcagccuugaaauccugggcuccacauauccucccaccucaguuucaugaguagcagggacuacaguuacaugcuaccaugccuggcuaauuuuuaaauuuuauguauagauggaggucuugcaguguggcccaggcuggucuugaacuccuggccucaagugauccuccagccucagccucccaaaguguugugauuacaggcaugugccaaugugccaggccuccacagugcuuucugaaauccauuccaaaaaucuuaagaguucucucaaauaucucccuugcaagucuucccucccacucuguacuaacugcacuccccacgcugcugcuuccucugcaggcuuuucaaaggguggcugccucucucugccauccccagcaguccagguuuguggguggaacugaggcuuaaguuucuagucaugccugaucuccucaagcccuuguauaaaggucacaguugugaggcucaugccauccggcacaucauccucucagucuccaucuugcugucaucuccaaccucccagacccccuccucacuguugagagucuuugggucuggugaggaccugcccauccuagaguaugcaugccacucaucugagaauaugauuucuaauuuuguaucucauugcauuuucucacugugucgcccaggcuggagugcaguggugcaaucuuggcucacugcaaccuccaccucuggguucaagugauucuucugccucagccucccgaguagcugggcaugcgccagcuaauuuuuguauuuuuaguagagacgggguuucaccauguuggccaggauggucucgaccucuugaccucaugauccacccgccucagccuuccaaaguguggggauuacaggcaugagccaccgugccuggccuuucuuuucuuucuuuuugagacagagucucacucuaucaccaaggguggagugcgguggcacgaucuuggcucauugcaaccuccccauccuggguucaggugauucuccugccucagccuuccaaguagcuaggacuacagcccugcaccacuacaccuggcuaauuuuuguauuuuuaguagagaugggguuucaccauguuggcuaggcuggucucaaacuccugaccucaggugauccauaugccuuggacucccaaagugcugggauuacaggcaugagccacugcacccagucuguagcuuauuguuuuuaauaaucuuuuuuuaacuucagcugcuuaauccaucuucaucuguauaucuuuacuauaugucauuguuauuacacuuuuuuccagcuccaaaaucucuaauucaagcauccccaacucuuaucacagccuccuauauuuucuagcugguucgcuuauuuacccuauucuugcuuucaccauuuuuguccuuccuggucccucuucaaccuacuuuguucuggcuuucccaccuauuauucuaccaaauaguaaguuuuagggcaccaagaagcuccauauuacaaaguucacuggcuccuuuggcucucaucuuauugggccucucagcaacacucagcucccccuucccuccugagccauccucuucucuuggcuuuccugaguccagagcuuccugaguuugaaguguguuauucugccuagaagcuagauguugaagugucuuaaagauuauuuuuagccacucuuccuguuucauucuauuuucucucugaaggugacaacuuucccacacccagguuuccaucaacuguacauagacaaccucaaaauuuaugucucaucaagaccuccucuugagcuccagauggaagcauacaauugccuacuugcuaugugcacuggagucucacaaagccacauccaacuccaguguuauauuugcaaauauaaaaucaugguuuucuccacaaaacuggucuguauccaguguuuucucucuuggcauuguggauaagaaagugggaaucgucccugguguuuccccugcccucuucccacagccacugcaucacaauaucguguucauuuuacccaacacauagcuacugaaggugaugguuuuuaucaacaaccaccaccaccacugcagcacaguccagcugccagcucccagcugucuucuaccacagucugccaaucacuuaagccuggcuuuuaucaguucuaacauugcaaucagcauauauauuuauauauauaaaaaaacacaaauccgaugaugucaaaugucuacuggaaaaccuucaauuacuggaaaaccuucagugguuucccauccuccuaaaaccaagacccuuuuaccucuuucaucucauuucccacucugcucacccaagcucuuugcacucaaaaaaacucauauauauauauauauauauauauauauauauauauauauauauauauauauauauuaguccagagcccagaauauuaagagaauguguaugucugagaaaccuguauauauuuuuaugcuuuuauauguuauuauauguuacauauauauauauauauauauauauauguuuuuaguuuguagagggcuaugaagauaaucuuuguguuuuaaaauguucuuuuuuguuugguuuuaucuuaacaaaugagcauuguuauggguugaauagugucuuccaaaaauuuuuacguugaaguucuaaucccaaauaucucaaaauaugaccuuguuuggaaaucaggucauugcaaauguaguuaggacgagcccuucagggugagcuauaauccaauauggcugcuguccuuauaaaaaggggauaucuggacccagagacaugcacaaagagagaauuccaugugaacacaaaggcagagauugaagugaugcaucuacaaaucaaggaacucuaagggcucccagcaaaccaggagccaggagagaggcauggaacagauccucucuuagucucaggaggaaugucuuaguccauucauguugcuguagaaagauaccauaaacuggguggcuugcaaacuauagaaauuuauuucuuacaguuuuggaggcugggaaguugaaguuacagcugcuaguaaauucagugucuggugaaggcaugcuuacuguugcacagacagcagccuucuugcugugucuuuucauggcaaaaaggggagaaggaacucucuggggucucuuuuauaagggcacuaaucccauuuaugagggcuucacucucaagaccuaaucaccucccaaagcccaacuucuuaauaucaucacauugaauguuaagauuuuaacaugcaaauuuugggaugacacauuuugucuauagcaauaaacgaaacuuguggucaucuugaucucaaauuucuggccuccagaacugugaggugacaaacuucuguuguuuaaggcacccaguuuguggcacuuuguggcaucaguccuagaaaacuaauauaagcaccaaaaaggauuuugaucucaacauucuauuuggagagaaccaaacagcccagaggcuuggguaauauggacaccuguaguaagucuauuaaauuucuauacaacuuauucuuaaauggaaaacuuaaaaugugcuugcaaauucacaaacaacaaugaagacaaaacaacaauagcaacuaaacucucagaaaagccuacaauuugaaggaaaagcaguuaaaauauaauuuuaugaacucgcuaauuacaugggcacacaauucccaacuuaccuaaaacauacaauauugauauaauuuagauuucaguauuaauuuccaacauuaugcauuauuuucuugauuucacacuagggauuguuuaagugaaaacuacguuauuucauuugaaaaaggcuugcuucauuuggcaaauauuagaauggcugugaauguaccuggcacuguccauacuuugaauauuuagagauaagaagauacugcuucuaauuacaugguuucaaauuucuuaauuugcuuaaaaauauaauauggauaugauuuaaacugcaguauuauuucccaacauuaugcaucauuuucuugauuauacccuaaggugacaaucacagaugauuagcacauaaauaguuacuauacaaccugauuguagauagcugagaaggcagaggagagagagaguaaaauuagcggguggagcaaugauuaugguucagaggaaaugacauaaacaggcugcuguggucuaaauuuuuguguccccucaaaauuuauacauugagacugaaccccuaaugcaaugguauuaaguguugggaccuuucagagguaauuuggucauuaggauuccacccucaagaaugcgauuagugcuuauuuuauauaagaggccugagagagcuucuuuaccacuuccgcuaugugaggaugcugcaagaaggaacuaucuguaaaguagagaguggcuucccaccagacacccaaucugcuggcaccuugcuuuuggacuucccagccucccaaacaaugagcaauacauuucuauuauuuauaaauuacccauuuuaagguauuuuguuguagcagcccuaauggacuaagacacaggcaaaauacaaauagaaugccuuggcugcaagacauacuuuucacauuugcuguuagcacgcuugugcuuugccuuugcaccuuccugauuuugcaaaaauauuugaaccuagaaaugaccuuagcacuuacugaauucaaccuauuuuauucacuaacuuucaaauguuucguaguaauuuauuuuuauuuugcauuuacucaaauggugagauagaugucuauaaucuucugauuggguauuagacacgcacuggaacaaaaucaacauccuggcccccuuuagagauucuacuucauagucaccccaacuuugauggaggauuuuuuuuuuuuuuuuuuaaacggaaucuugcucugucgcccaggcuggagugcaguggcgcugucuccgcucacugcaagcuucgccuccuggguucacgccauucuccugccucagccucccgaguagcugggacuacaggcgcccgccgccacgcccagcuaauuuuuuguauuuguaguagagacgggguuucaccguguuagccaggauggucucgaucuccugaccucgugauccgcccgccucagccucccaaagugcugggauuaccggcgugagccaccgcgcccggccugaauggaggauucuaucaggugcaugaaaggcuuccuugacuaguaagcuuuuaggagucuuguuuuccuugagauuuaaucuaaguucuaaccugauuguaaacaauaugcagagggauccagucuuuugauagauccuccucuucaaagucauucauuaaguauagaacuggagauucugagagucuucaggugaugccauaacugaagauugcauagauuaauaauuuuaccaucugcaaagcuucauccuccuuaguauuuccugaaccccgucagcacuauccaagcucuagccauguccacugccacuguaaaagcugcaaguccaaucucuuuuucucaagggugagcaguguaagccccagggaguuaggugacuuauuugccauuaccacaggcaaaagggacaaaucugagacuugagcccaguucuucuacuuaguguccagcuaccuuucuacaacagucuacugcuaacuugauuuuauuaaguaaaugaaaugucagcagucauaaggcaacauaaagagcuccucuaauauuagaaaaaugaucuaagaaaauaucagcacugccauacagaaauauaaaaauaugucauuuucauuauuuccuuuuugccauuaucuuggcaaaagaggcaacuaauaaguuaccaauaguuacugaagcuccaggguccuugcugcauuugauauucuguaaccacuggagaacuauaagaaccaaauuugucccagaaagugauauuaagcagaguguaggauuucucuauucagaggaaccugucuccucacuuggaaguagaaaaaagaauaccuguuuuaaacagaaccuggaaaauuauacaugcaaaugguauucucccuuccuggcuaagucuuucacauucaacaaacaaacaaaacacuuccuaaggcacauaccugaagccuuauuacuagcagaccccacuucuuauacuucuauuccuuguguuagacuaagaaacccuauuuauuugcuaggagaggagugaagaaaagcgucaaaaggggaaccggaaugagcuuggacagguguucuguaagacaacuucaggcaaauucaaagugaaucauucacuugcugacaguagcaaugaaaguaguuucaugccucuuauuuuuugguccugaaugucauuuugauaauucaaagugaaaccagcaauuacucuuaaggaccagcagaugggaaacuuuauuuccaaaguaaauuauauuuuggauuuucuguggcuagauguagaucuguagagguauaaauacugaccucagaaauauucuuauaauauuaaaacuuuaaaaaaaaccuguuaauuuuuaaauuaacaauugguuuguuaauguaaaaguauugcuuuuuaaaaguauggaugcauauacuaauuaacuguauauagugaagcagccacuggcaauuauacuagaaugccucgugaauguuuuccguuuucauuucugagcagugaggaccaauaucaaacuaggaaaggcaauuuugcagacugacauuuugcuccuucagaaaugucuguguugccucugugccugucauucagagcagucguaagauuagcugucuauauucugucucauccucuagaacuuucauuuacaaauauuugaugauaaauaauuguacaugccaaaagaucccuugaaaaucauucacaggaauuacacaagguaugugaaaaaaugauuuuguggcauaaggaaauaggaaaaauaacuacaucuaaaaucacucuaccuagucucauacucugcauuacugugagcuauguauuuguuaaaagggaauagauuaugcuuucaaggaggccucacauuucucaaaaguaaagugugaugcuuuucugcucacuuuuuaaaauuccuauauaaggaaacuaguugaaaagguagacuucuggugaacuccagaugacuugcaggagauagcaaguuuuaaggcaguuucgcagacacauuuuucaaaacauauuacucugugaaaacaucccugagucuaguauuuuccaagaauacuauaggaauuuaaauacaggucuugaagucagaaaacauggcuuggaguccugauucagucauuuaacaguuuugcaacagcguguaucuuccugcacuucgggauugcuaaaaaacagcuugaaaaaaugagauuacauugaucauaauaaacuauaaaccaucugacaaagcauaaagaguaauuauuuguuucagcccuuuuauauguaaagacagagaucuuuuuuucuucuacucuacguuucuccuucauuuauauaccuaaauuuauaaacauuacgaccaacaugaaaauugccauuggucuuguguggcauacaaguaccguuuaaacauuuucaucaaaaaucuuauauccacuaagauuuacauuuauucuaaucucccgucuucaauccuuaguugaugcccauaaauacuaaguggaugggcccaggaggaugcgcuuagcagcaccaacaaaaccagcugcaagaggaugcauaaugguucugaaaauuauagcagcuauaagcuuacuuucuuucacugaauuuuuuauucacuauuaucuggaggguacacccucuuugaaaugguuggauugcuuacaaaaaaaaagauugcaugcuaauuucauaauagaaaaagaguaauuuguguauuucucaugcuagccuuauuuuuagcuauuuuugugaauaucuucuguuuuuauuauaaaagguggugaaacccauuuguagaaguaccaauguuuucucccuuccacacauagaguacuauaagaggucaacuauggguuuguuccaguaagaaaauuccuauguuuguuacaaaagaaaaagauauagcagcuccuuugauuucauaaaauuucuuucuuuccaggccgggcgcgguggcucaggccuguaaucccagcacuuugggagaccaaggcaggcagauuaugaggucaggaguucaagaccagccuggccaacauggugaaaccccgucucuaccaaaaauacaguaaaaacacaaauauaaaauuuauuuuuuucuggaacaucugcaaauggaagcuuagcuuuauuuuccaguucagggaccgagguaucacugagcuguggccuccaugaaacuacaggugcuaccucuggcuuaucaaucagugggcuaaucuuaccauuucuuuucuccaaauuuuaauuccacagauaauagucccaacucuuuuagcauggcauaaacauuaaaugauuauuccagaaugugauuccugaacauuuuauauguuccucagcuuuacuaggguuuaccccaaaucauacucuguguaaagcauaugaagacuauagcaugaugacaagaaaguaacuuguguuuuaguauuuacauauuuauucaacaaauaaucuaucuucuuuuuauuccaaaguauuagaaaaauauuacagugucucugucuauguucagaaagcaguggauaaagcaauaaauaugacauauuuucaguggcacuguaaucaaaaggcuauaagaaaauugaaaacuaaacauguagaugaguuuugggauaauauggggacuuuaugccgaagcaugagucaggugaagguauucuggaagcuccuauuaucugcaaauuccuuaaaaauaucucaucaaaugguaaaaaguuccauaggagaguaaacuggaacaagggaagaauaaaccaagggguuuaaggcaggaggagaaagauguguguguauaaauaagcucugugacagagauaggauuagcauccacaaauauuucaaaaauacaucaggcuaaagauguauuauuuaaaauacuauauauagaacaaaaugaugcacuuagagaaauugcaggaaguaaauaaaaugccaaugcauaauuauagcuaugagaaaaagauugguuauuugcagauguguguaugaugugggccuaaaauuccuaccaccacuuucagcuaaggcauaaaaagcccuuauaauacaaacauuaaauguaagggaaaauauauggggccacuauuaaucauuaaugucuugguauagauuaaaucaucaguuuuauuccugccacuuagaaaggucuugaaaaaacaauggaauugaagucaguaggagagggaaggggagcagggcccaguguacaagcugcugcccuauagggcugacccaaguaggggccucaacaggggaaccgggcucccaggauugcucucuucagggccguucuguagagaugacauuuguaugugucugagucggugugaacaucauauaagaucucagggaauuuacagcaaaccuucagacauuugccauucuaaauuauucuuuaagcaaccaucuuuaauuuccauauaaggacaaggugaacuuauuuuuucucuacuuuagacauuuauauuuuaauuuuaaaaauaauaugcuguccuuaaagagauacauggggauuuaugugucccaaaugugauaauuuuuagacuugaagaagguaaauuuugucuucuccuccuccauaaauucccaagaguacagaacagaaaucuguauuugggguugaaaugcuauauuauaacauauaccaacaacuuaagcauagucaucauaaagcaauacuuauggauaguacagaauuauucuuaaccuaaaaauuuuaaaauuaaggaaucaauauaaaaugcaaaaguccuugucuuuuuuugagacauguacuuuauucaaguaugacuuuucaaaagagaaaaagaauaaaauauacuacaaaaauaaaaaugaauacuauaagcauuaauaaaaagagaaaacagauaaaagugugaaaaauaaaacaucauuaggaaggacucauuaaagaaagaaacaaaugacuaaagaagaaaccaccaagaaaaaaagguaaaaaucucauugcuuagauguuauuaaaaggaaaagguguuauuuaaggauaaguauguucuaccugcucuuagaaucaaaaaaaauuuucaagcuuuuaguaucuuauuaucucuuuaauguaagguagcaauauuuauuuaaauaagcaauaauuugaaauaucauccuugaaaauauuucuucuaaugguuuucuuucuccuuuuauauagcauucaugaauaucucagcagcuaaguaaaaauugagggucucagagacuguagcugacuuuuuaagacagccaaggcauuaauccacgugugugcaugggcagccaccaggaauagaauuuaucucagugcagaguuucucauugaaaaacaggccaagacuuaggcaaauugugcauuuacaguuucuuuuccuuuuuccucuucauucauuuuuuuucuuuuuccuuuuacauucauuuuagucauccagggccuuucuaccuuuacccucuuccccuuuacaaggcaugaaaaaaaaaaaaaaaacccagccauugcacuugcuuguaacauauucguuauaauaaauaauccaguucuuuguauucauagaagggcagaaucuuuguguuguaauagccuuuugagaucaacuguuuuaaaucacuuccuaaacaggauuuccucuguauauucuggauugauggcugguacauuucuaguacuuuucaacacauuuuauuacuuuuacuagggaacaguuccagggauaacaacucuaauuggucuuauauugagugaaaaacuacuucucugcaguguuugugcacagagcuugauuuugcacaugaaacaauacaaaacaaauccauucccucauuauuucagcccuucaaaguucugaaaacagcuucuuauuccccuaagucaucacuucccaaacuauucccuauuccuuuaacauuacccaugaaugccagucaguaacaccuuaaagauaggauccaggaauagacaacagauagauauaauaacaugcacauguucuaauagugccaaguccagagggacugagaucucugugauuugcacacuuaucuucuauugauucagccuaggcucauaauagcuuuugagcagcugugucaugcuguuacaucagugccuuucaaacaaguccaggaagcagggcucugaaaagucaagggacucuuuuugacuuuucugauccccacaauaaaauucugaguagcauuaauucugucauuugaauuaggaucaauuguaccagcagaaaauuuacccauauuuaauguauccauccuacuacaucuccaaaggacagaauuacuuuuagagaauuaugguucagaauuucuucagauauauauauauaaauauauauauaaauauauauauuuauaaauauauauaaauauauauauauuuauaaauauauauaaauauauauauuuauaaauauauauaaauauauauauauuuauaaauauauauaaauauauauauuuauaaauauauauauaaauauauuuauaaauauauauauaaauauauauauauauuucuuuuguauuuauaggaaaagaaaaauuuauuggcaaaaaacacaaaacuguagugaaaacuguagugaaaaaaaucaguuaaauacccccauaagauauugugaaaagaccaucacccuuaacuuuuaauagcaaaaugccugcuacagccuuuggaagaacagaguuccaugagaauaagguuuaagaaugucugccuuauguuaaucauauacuacauagagugguauaagagucagcauaguaaguagagaaagcacugaacugccacgugguuaauggguuuaguucugguauauacugacuuugugaccuuuagaaagccacuuaacuucucuggcuucaguuuucuuauccuuuaaguaagagacuuagguuagauuaguuuuaagguacauuucuaucuuaguccccuucaggugcuguaacaagauaccacaaccugggugucuuaacggaaauuuauuucuucuaguucuggagacuggaaaguccaacaucaaggugccauccaaucugguuccuggugagggcucucucccuuaugugcagauggccaccuucuugcuguguccucacauggcagggagccagugagcucuccggcauuucugcuuaugaggacuaauccuagcagaucaggucccuacccuuaugaccucauuuaaccuuaauuaccuccauaaaggccuuaucuccaaauacagagcuaggcuuuaaugcaugaauuuggagguggggugggacaaacauucaguccauaacaauuuccaucaagaaauucuauuguuuuaacccucucaguuuuuaaacauuuuaaaccauguugucauaucugucucauucuaugucauguagugaaccaaaaagcaaauucuucuccauggaauuucuuauuugcucauuauugacuucauaaucaauucccugcuauuccuuaaguucuguccuagguuucaggaaaucauuaauaaacaaaaaugacaaaaauucauuuccacauggagcuuacucuccauuggugaggcagacaaugcauaagaguaaaaucuauacccugccagauagcauuaagugccaagagaccaaaauaaagcagaaaagggcauuauuaacuacuguggcaggaggagucgaaauuuuagauggcaaaaggaaguaaggaagugguuguguguauaucugagaagagaacguaccaagcagagaaaacaacaaaaaucaaagaggcugagguagggaagugggugauuuuucagggaacagcaaagaggucaauaugauuggaacacaguaaaugaaaguuaagguaguaggagaugaaguuuaagagguagugagaaucaagucauuuagguucugguugauuauuaaaaaaaauuuuuuguuuauuacucugaguguaaugggaagcuauuaggaaguuuagacuggaagagaguggggcaagaucuggcuaauguuuuaacaggaucacucugacuggggcacugaaaauauuuuggagaguacaaagaagaaggaaggggaucaguuaagagguaguauacugccacaguccagguaagagauuagggcuugaauuuaugugggauuggaaguuucuagaagguaguccaguuucuuuauaguuugaaaauugagagagcagaauuaguuguuguuuuggacuauauguugaugacuaguucuagcacauuuaucuuuaauuucaagguuuguuuuguuuuguuuuguuuuuguuuuuguuuuacuagagacaggguuucaccauguuggcugggcuggucucaaacuccugaccucaggugaucgaccgccuuggccucccaaagugcuagggcuauagguguaagucaccaccucuaguuauaacuaacuaguuuguguuaucaguuucuguaaugaacaagacuucuauccuuuucuaaguguuccuacaaaaucucagaugggcucuugucauaaagagaccucugcaccagcauaaauuacuuccauuaaaaaaauacugaacauucaauaucuuuugaguaaggauuguucauccgucaauccaguugaguucaauucaguccuuuaguuauagcuaaaaagauccuaugcaugcuaggccuucugcuaggcaugggguggugaagaugaggguauucauauaugauuaagauauaacuuucuuaaagaaagucugaaaaucugguagagacugugcacagucucauaaguggugggauaugguuuguaauuaagucauuuuaggggaauggcuaauucacuugugugaucacaggucaaagaggguguggauaugacucugaugagguggcugaaucaaguguggaaguucugacaugcuaaggacuggcucuauuuugugugagaaccguuggaguuuuuaggguguggaaugacaugguuaugacuguaugugggagaugucucuaaaggcaaugugaaguagucugaggcuagaagaaggauucagugcaaggcuagaguccaguuagguuacugcugccucuguucacuggggaggaaggugacaauggagaagaaagaaggcaauggugucagagauguuugaaaguaaagguuacagaaucacuuacugaaucagguaugauaaauuaaaguagaagucaauucacguacuggaacugugcagcugugcaacucugugaguugagaaacaaggcaaaaggaaaaaaaucaccucuuuugugguuuuuuuuuuguguguguauauauauauauauauauauauauauauauauauauagcgagagagagaauaauauauauauuauauauauauauuuuuuuuuuuagacaaagugucacucugcuguggcacgaucucggcucacugcaaccuccaacucccggguuuaagugauucuccugccucagccucccgaguagcugggauuacaggcgccaugccaggcugguuuuuguauuuuuaguagagacgcaauuucacuauguuggucaggcuggucuugaauuccugaccucgugauccacccgccuuggccucccaaagugcugggauuacaggugugagccaccaugccuggccaauuacaagauauuuuaaaagcauacaauuacuuauacacauugaccuaguuaucuuacuccagagaacuuaucuaaaauauaauuuuauggcuuguaaguuuuauucaagaagucucucacugaaauuuuuuuugucuuuaugaaaaagggaaucuaaaaugccccaggauaagggaaugguaaauuaguuagcuuacaaccugaacaaagaaauuguaauuauucaauuagaaauauuauauaggacuaucuuucaauacagaagaauauugugauauaauuuucagagaauauaggaaaacacaaaauauaucaaauucauaaauuuaugucaacauuaagaauucuacaguaaagauuacaaaaagauuuuaggaacagaaaaaaaaaggguuaagaccgcaucugacuugaaguuugagccagacaacuucaaauccugccuaaaacacauaugaagacacaaagaaaaaaugaaaaccacagcacugcaaaggagaaaugaaacccuauauaaugucagaaugugaacgaaauuucaacuauguacaaugccccuguggccucuauguggaaggccaacaagaagcaaagcaaauccacuggccuaacaaaauagaaaggcacuuuguucuugcagcuguagccucccugccuuagaaaugucacccacgaaucaaccacaaaggcucauucagcccccuuagggaugagaguucuuugucagaguuauauguugcuaauaucuuuaauucuauagcuuuccucucuacuuuauuuguagcaucuuuucaugcacaguucuucaguucuuuuccuuaugaugugugcuuuuuuguguguaaaaguauguucuaaccugagguuauuaagauuuuuccuauauuaucuucuaaaagcuuuaugguuucacuuuucacaucaaucugucaucaaccaagaauugcuuuuuguauauggugugaugcaacaggccaauuucauuuuuucaaauguacaccgauucaucucagccucauuuauuaaaacauaguuauuuuuacuguagcuacucuuugucacuaccuugguuauaaaucuagcauuuauaaaugcauauaucaauuuuugaguccucuauucuauuccauuaauuuauguguuuauucuuacgccaaauuacacuuucauuaugauucuuucuuuacaauaagcuuuuauguaugguagaaagauuucuuccauguucuucuucuagaauguuuuggcuagucuuggcccuaggcuuuuccaucuacaguuuagaaccagcuuauuuauuuucaccaaagaaaagccuguuagaauuuagacugcuauuucauuuacucuacagaucaauuuuggaagaguaacaucauuaaaauguucaguuuuccaauccaugaucacacuucaucuauuuauuucgaucuuuuauaucucucauuaaguuuuauacuuuuuccccuagagaacuaacacauccauuagauuaugcagaauuacuugauauuuuuauaucauugugaagauauuuuaaaaaaaucucauuuucuuuuuguuacuuuuauuaucuaagucuauucugagauaguaaaucaaaacauuuggaaaauauagaaagccacaaagcaaauacacaaacaguuccauucuacucuuuaucgccauuagcgcauauuuuaauucuauaaugacuuuuuuaguuucuuuggaaacuaaaaauccuuguuuaucuuauccauuuccccacuccucccucuuuuguuuuuucucaucuuguuacacagaaaguagagggaaaccuauggugcaguauugcaacuuugaaauagaacuuuuaggcaaggaaauaauuuuaaaaaaacaacaacacuauaguaguguagacuauagauuguagauuaucauagaucacguguaaucaaccuguaacccaagcacauaauggagacagcaagacguuuaccuugguguggcagagccacauucaaugguuacgaauaaggaauugaacuacaaauuacaccuugaccucaaugagaauuugacucuugcucaaaaggacagguguauaucgugucucucacacacacacacauaaggacaaugaacaaaucuuuaaagauguccucuuuguugaggaaaaauaaacgaaaaaagucaguagagucaaaauauuaagagcuaacauuuccugagucuauacuaagugauuuacguguacuagcuuauuuaaucucaacacuccuagaaauugguuacgaucaucaucucuaauuugcagcugaggacacuaugccacagcaugccguguaacccagaggacuccaucacccauacucucccaguguuagucuauuguuuuauagcuaagcauuucuuauacauaucuugcccaagucagauuaugcaaacaaaaauguuaauacaagccaaacaauggucuuuauagauaucuuguggagaaaaauauacuagucauccacagcuucuucaccuagaaauauaguuauaauuacuguaugcuuugccuuuaaaugcaagcauagucucugugcucuuccuucaucccuaccacuuauuccaucaaaauuuuacccuguuucuauuuuggcucuauugugaauaacaccuuuucaaauauuggcuuuuucuuuggauaaucagacacuucacuauaguucacaugaaguaugcauguuuuucaaaauaaucaaacagaagaaaaaugauauuuacaccguguucuugugagaaaguuauuccagacaccuugcugguguuuaagugccagauaauucugacacacucuuucagcucccagcgaacauaguaugugcuguucagaaggggcgaauucuuuaaaaaugaccuuuuggaaaguauacuugaaaaauguuauuguaauguuuauuccucuuuauucugaugauacauaauuugauucuauuguauuacuugccaauuagcauaaauugaccaaaucuacuaacugaaucauauaaaaucuuucaccacaugugcuaauuaaauuuuugcuaauauaauuucauuuucauuuccaaaaguacucauuuaagaaauuuaagaaagauuaacauguugcuuuucuucuaugaauaauugcauuuugauuuguuaaaaugaugcaagaaucucuuauuucuccuauuaaacuagaaggaaaaggaaaauaaaguaccuucuuugaaguggaauuuuacaucuguguuuuucaguaaugaccuauauuauaauuuagcaaagcuauuugcuaauuuuaagaguaucugccuuucuaaaguauuguuuucaguucauaauuuuuuguagcucauacugaagaauaaauugaaauaaacaacugacucugguuuauaguaguaaucacaccuucaaaagguaucauuaaugccauuaaagaugaauugccugaagccucaguuguuuucugugacacccgaggccauuaauaagcacaucagucaucaauugcuuauuuuguccuauuacaaguggccucaaaugaaucaucuuuaaagaaaugcuauuuuaaagacagugggaacauaagaaauaaauacacauuuuaaugacaaaaguucagaaagagaauaaaaaaguauucuucuauuuuucccauuuaucuuuucagucacucaaucaaucuauaugcauuaagcccaaauuaugcucuaagcacuaauauaguaaagaguuuacauauaggacaugaauagauuacuauuaaaaaguuuggccucaugauacauuuuaauaugaauuguucagccauacacuuccucccgauuuacaaauuuucauuuuaggaucugaacucuuugccuucccacucagcuucucugaguuuugcaaagcagcagaacauaaccccuuuagccucuauagauauguuuucugaugaguaauauuguaaacauauuucuguacucaaauuuuucugugaucuucaaccuuuucagaugagacauuagauaaaaaaccuuuugauaccaaaacuuugaggauaucauggucaauuucugaaaggaaguuuuugcuacuguuuagggaagacugucaagagugaaagcauuguuuccucacuggaauaguucagguucuucugcugccugggagcaggugauaagcugccuggaacuaggauccagacccuagauauuccauucuguuuauggacuguucauuucaguucaauuuacaggcucccauagaaaaaacauaaucuccuuucuuucucuuucucucauuuccuaucuugaaagauucuuuagaaaucucuugacaaaugaugcaacuauaacuguggcuuauuuuuccuguaagaaagccuuuguuucucugaaaaguacaccaauucuuucucacaugaagacacuucaccucuuacuucaccuaucuggauacugcaaacacuauggauucagccucaccuuucauucucucgguacucccaaucuccuccaucugucuuacauguauguuuggaaaauuaaguauaauaaugcauuuaaagcauagaacacagcccuauaaacaauaauauuauuuaguggcaguaauaauaagcaguaaaauaaaaagggcuuuucuugaaaguaaauauauuugcaaaugauuacacaucugaagauaauggacaagagaaaaaagaaauaagugaccaacuuacauuuguggcauccauuauuuacuucaaaauuuguaccuuaggaaauuauauguauuacggaaauuucuuucuaauuguccuggagucaacucagagcugucagugauacaccaaaauaaagaagguuuauuuagcucaaacugcaagucugagaagcguuugagguuuuuuguuuuguuuuguuuuguuuguuuguuugcuuuuagguaguacagugaaaauauucuuaauuuauucaaaauucuguuuacauauuguacuuuacaaauguaaacaauuuaaagguaucccuuauuuauauggagaaaauacuuuuguaucaagcaacuguuuuaaaauguaguaaugauuucaaauaaauguuuaggguagaaauggauuaaguauaguuaauuuaguuaaacuucaacaagucaauagggaguaaauaaugguaucugguacaauauauugaugauuuaacaacagauaaauugucaguacuuuuuucauagaaggaacaucuaugcuuauuuuagaaauuuuuugucacauuuucaguaaucugaaaucuuucaauaaaaaguagaaacauuuaauucuuauucauaaaaaacuauuaguugauuaccuagaacagaugagggauacaggagaaagaacaagauauaguauuuugggggaaaauaucuaccaaacuuuauguguaguuuaaugcauuaaauuuuccguuccuucgaaauuuuguacaaaagaauuaaugaacagagaccuaauacgaauuagcuuaagcaaaaauagaauuuauugcuucaaguacuugaaaaguucaggauuaaggcuaggauuaagacugaccauaggcacacuaaacaauccagaaaguuccaaugaugucaauaaaugaaucagacucaauaucuacccccuucucucccucucccucacggauaccagaggaggacuauaaaucaugauacugaucaaccuggacacaucuuguuaacauauaaccuuucuucuacuucaccuacaccguuauuacucaauaggucuaaaggaaugauuuuacaagcaauaucaaaaaauuauguaaugaguuuuuaugaagaauugauuccauaggcuaaaagcauuauucauaauagaauauauuuuaaaagucuauaauuauaaacauagguaccaacuuuccaaauuugucuuaguuuuauuuaguguauaaucagcuuuauugaaguguaauuuacauaccauaagagauacucauuuaaaguguacaguucaauuaguuuugauaaaugcauacaucugugucaccuccucaaucaagacauuuaauauugccaucaaccccaaaaacuuccugugccucuuuguggucaauucugucuacccuuggccccagccuaccaccgaucucauuuccaucgcuauagaugagguucacuuguucuagaauuucauauaaauaaaaucguagugucaacuacauugaguuugcuucuuucauucaugguguuguagagauucauccauauuguaaccaaugucagcaguuuguucuuuccucccuuuuuuggcuggguaguauuccauuguacgaguauaucaucccuuguuuauucauuuccauguugauuuagaauaaacugcugaauuaguuauaauuaggagauauuucaaauuaagcaaguucuuauguggcuauaugucuucauuucuuuuggguaaacaccugaaaauaaaauagauguaucauaaugauaaccacauguuuuuuuuacuuuauacgcaaucauaaaugguuucucaaaguguucauaacauuuuacaucccaaacggcgauguauaacucgcuauuucucacccuggccagcacuugcugcuguugauauguuuaauuuuaggcauucugggaugcaucaugguauaucacugugguuuucaaaaacauuccucugcugacucaugacacugagugcuuuucugggucucaucuuaauuguuaccuuuaaauuucucauaguagauuuaacaauggacaaagcagccagaaaacauucucuugcccaaugauuaauugauaugaaacuuuauuuccauguauuuauucaccaugugauuacugaaugucuucuagaugggcacugguagggguacagagagaauauaucuugaagcacucucuccacucucucauggagcuuauacucugcaagcucuucagaaaugaauggcacuuuugaacugcugaguaugauaaaauaucauagguguugaauguuuuguuucauggaaacucagaauaugugcaccaaaauaacaguacuuuagccagagguuugacaugacugacuacauauuuuagaaaacuauucuuacucuguuuaaaaccagaauguuugacuuacccauguacaaaugaguagacuuuacaagcauaauuaaauucgaccagcuucagcagcauuaugaaguuaucagaaauaaguuguuuagaaaagccacaaaagagggcucuauguuuauauuuauuauuucuaaguuucugguguugugauuuauuuugaacaaccaaaaccuuaguguuugugaacuacauuuguucugaccaaaacuucuggcuuuuuaguuagcaccaagcagagauaugaugacuucugauuuuuaaaaaaauuaacuuagucauaaaacaucuuguagguguugugauuuacucuugggcuauuucagcagaacucagcagcuuuuguuuccagaauuuacaauauguuuaacuagugaucuuucucagugaguuuuaaugguauauuacagagauaaaccaagauuauauugacucaccauuuuuuuuccuacauucaaccuuuugaauuuauguagacaauucuauguucaauuuuaagguuaacauaacuuugugauucaggcacccuuugccuuccacuaggaaauaggagggagccauaucauagcuuucuccaugucaaucugggaauccaggugauaacagagaagauaaaaucagggaggauugaaaaugccucaagagugaaauuagguauuuggagugugcuuucagcuuauagcugaaaauuagguauuuggaguggaagcaaaauuagacaugagguguagcugagcaggagaguuuuaguuggaguaauagaauagccaaauaaaagggccacugaggagcaguugacccuccuagauggagggacucuacacuguagaggcugggcucugguggcugagauggcaggugccaagaaccaccugugagcuaugguguagggcaagacaccaaguaccuaagaaaauaacccauagcaaacaggguuggaauacacgagauagagauuugagaacaagggaaaaagcuauggacacagcaaagguaaaguauaagguacggccacagaauaaaggcuggaacccagaaaucacagugucagggugcaaccaagaguaaauuugagcuccuucuguuuugacucagcacuggacugaucccaggaacuggaauggcacgcaccuuaucagcaagaugagccugcagguuagaaggcagggaugccagauacuugcuaacauccucugaacucuguuuugaggcuugugcucucaguccagcaagcaagaauauucuucucaacuugacuuagcuccccacacugcugcucuguguuggguagugagagugaagacugaaguguucagcugucucaaaacagucaugccccaggaaacuacugaagcaagaagggcuuggcuugcccuuauagucaaugccuuucugacccccuuuccaguucguagaacuugccauauguaauaagucuucagagaaacacaaacacagugcuagccuuagaagugacugacaacuuuuaacggcucuuugccuccccagagaggagagcuguucuaccuuuagucuucuuuuagcugcuucucuucuuugcaacugucagaaggcaugcccugcuaagaugcucuucuaauuccuacugccacuuccgucuccaaaaaaaaaaaaagaaaaauuuguaaaguaucguauucucccucucauuucucccaacaccacagcuuucaccaccaaacagccugcaucucauaacuaaagugauucaaucacagcugcaaucauuggcugcucauggaucuuuauucuuuuuuuuuuucuuuuuuuuuuuuugacugaguuucugcucuuguugcccaggcuggagugcaauggcaugaucuuggcucaccacaaccuccgccucccggguucaagugauucuccugucucagccucccgaguagcugggauuacaggcaugcgccuccaugcuuggcuaauuuuguauuuuuaguagagacgggggcuucuccauguuagucaggcuggucucgaacucccgacuucaggugaucugcucacauuggccucccaaaaugcuaggauuacaggcaugagccaucgcacccagccggaucuuuacucuugauugcacauacaacaaacuuuugagaugccuaaaguugcccagaaucugaccucauguuuacaaauaacugucgaacaacacaauagauauuuaguagaaagguucagacuagaaaaauucaagaggcaaacuuccuucuuccuuuccuucccuuccuucccuuccuccucuuccccuuccccuuccuuccuuccuuuucuuccuuccuccuuccuuccucccucccucccuccccccacuuauacauccaucuauucuuccauucaguguuuaguuauguaugcaucauauccuuaauaucauaaauacuauuaauucaguaguuaauuacugagcacaguuaauuaacaguuaauuccaguuaauuaauugccuggaacuguucuaggcacugaagagauugaaaaaaaaaagcaucuggaaauggcucaucagccuucaucucuaguuaggacuucccaguagcuagauaugagugcaucuaauugccuccgcagcagcucagauucaguaggcuuacaacugaacucauccuguuugccuuucagcaaacucauaaugucacuaucuguuucaaaaaucuucaguggcuuuacauaaacuacugaauauaguccaaauuuugcuuaauauucauggucuucuauaugaauuuucagcuauacuuuguuacuauuuucuauuacuaauugcauauauuccuugcuccauugaugucacuuaauuuaugcuuucugaaacuuuucuuauguuguuucuguugacccgaauggugugugugugugugugugugugugugugugugagacagagagagagagagagagaaacauauuagagaaaaauaaauguguucaugaucuacucagugaguauauacacuucaaauauuagugagacuaugauggaaauucuaaguuuacuuuugucuucaucguagcucccugugucucucauggaguuaguauaugaauauacuaauacuguauuaauauacuaagacugacuuuugcauuaacaugcauguauuuuuuuucauaugccauagcccauaaacauagccacccacucuauuuggugcuugacugaagaaucuguucuuuguuccagcgacagaggaaaaucuagccuuaauggauucauuagaucaucauuaaucugugaguagaacuguauauucugugcuuuguggauuaauuaaaagaucuucagguguuacuuugaauauacacaauuauuaccauccucuccaaucuuacagcucaaugccugauaagauauaacuuauggugcuauuauuauuuauauauuccccaugaaguuauauccuccucgaguacagcaucugugacaauaaucccccaaccaccuaguuugagccuucuacagcacuggggcuugauaccuaaggguuggaugaauuaauggcagguacuuaaaauggugauuguugaagcacaggaggauguacaggaggaauauacagaaacaggcacuucggggcuuucuguuuugaaggaaaccucuaaagccuuacucuauucaaaacagaacuugaaugucauuuuuuauaagcacaggcaugugcuuggaguugggaagagaaaagcaggaaagaggaaagugauuaggcuuaaagauguaccuggaacagaaaaucuugauuggaaucuacuaucuaaagauuaaauuaugcaaaggaaaaaauucacgucaguuucagcagcauucaggaaguuuccaauguguauucuaagagacaaaacauuugucauuaauaccauuucagauaacuuuacaauuaagguauuaaccuucuuauguuaguauuuucaaagcagcuugaaguuuauugauuuucucugguacuggaugauuaauuucauucuuugggaaucucaugaaaauuaaucuaagccauauacuauaaugccagcagccggaauccauaaugcaaucuucuucugugugcuaguuaucuuuguugaauaaccucauaagaauauaacugcuauaaaaagcccaguucaaagauccuuuggcuuaucacaauuuguaauuacuuuaguugaauuuguuuucuugauuucuucuauaggucuuuauaaagaggucagaaucaugaggaccagaaccaugauugccuugcuuccuacaguauucccaaaaucuaagauaauacuguccacagagcacaagguuuaauggcaacuuguugaauuaauggauugaugaacaagaacuaccuaagucagcugguuugacuucaaccaagaaauuucuccauuugccuugagauucagccucaaaggacuuggucauucuaaggagcagaaggccaggaaaaauuaucuacauggcuugacaugaaacugaaacaguuguaaaacucagccacaaugauuuauuaauguucuaaacuguaauguauaacucugguaaaaauguuuaaucuuccuaaaucuaaauauuuuguuuacaauuaauucucacuccugaaugauguaucuucguuuacucaaaguggcugagaguaugugagaauguugaagacuaaucauugaguaagaaugcugagagcagaagagggagcaauacucccaaaucugacguuuaaagggaaaaaucacauuuaauuccuaggguaguaaaagcaaccagucacaaagacgaggggaaaacucuuuggaaguucuucaauucuuuuuuuuuuuucccgugaagcucaaauuuuaccauaguagauaaggauuucugaugguuugugcacucugaguguguuacaaaugauaaaucaucauauggagaggggcacacacauuuuuaaaaaaggucauaauguaauaacauuugcuauagaaaugguucuugagaaggaaaggguuugggcuuauuuaguaacccaucgugucuucucugaggacguccaagaagagaagggagaggaagagagagagagaaaugacccaguaaagaauccuuggaaacauacuaaucaggccuccugaagguauuuacuagcagaaagguaaugagacccuuuucuguggcauccuuuuuacgggguguaucuagucugucuagguugcuuacagcaaaugaaugaagaacuccugggguugugggauauggcccaguggaaaauguuaggucaaagauauaauuauggagcaaacaaauggagcuguuucguaaccacaauggcuuccuuguggaaacgauggccuacaugcaucacuuagaaaccucaaacauuaaaucuggaccagcccacauccucguguggcacaggaugugaggagcugcacuagugaucgcagacauuuuugugaauugccuuuaucaucaucugcauccuuugaauuauuaggaaagcuggauacuuuguaagagcucugauuuuugugagucugauauggcagucugguuccuuguguuaucugaggucuggaaaugauuuucaaugaauaguaggcauucuuccagauaagacauggauuuugguagaaagucaaugcaauauuuccuccacaaugguaaaccggagguacucauugcaaagagcauugggacaucaguaauucccuuguuuuauucagaaugucuaaaguuucucucauuaaacaauaugcucagagaaacugucuuaugggauucagacaauuuugaguugucuggagaaacaggcugcagaaaugaagggaauuuaaaauggauuacuauuuuuacauugaacauaauuucuuuuuauaaaauaauuuuaugucuaucaguaacaaccuggaucuaaucagauagaaagguuuacgcaugggaggagggacugaauuguccuuaggaacaguaaguggauguaaaugucaaagaaaaacaauaauaauuuguacuuucucuuuaagccuucaugaaaagcuuauuauauagaaaacaauaaauaagguaauaaaauauaccuuauuaccuugagagauugaacgggaaacuaagaagaauuccuuucuggaaggaaaucuaaagaaaaagaauagcauuguucuucagaauaaccugaagcaaaugcccauggcugcuagaaguaaaauuuuauuuauuuauuuacuuacuuacuuauuuuuugagacagugucucacucuguuacccaggcuggaguacaguggagcaaucugggcucacugcaaucucugccuccugggcucaagugauccucucaccucagccccgcaaguagcugggcccacagucauacaccaccaugcccagcuaauuuuuguauuuuuuuguagagaugggguuucaccauguugcccaggcuggucuagaacuccugagcucaagcuaucugccugccucagccucccaaagugcugguauuacaggccugagccaccauguccagucauaagauauuuaauuaacuuacugaaaaccaaggucaaggauccuuacuacgucaccucucccuaccccaacugucacagcugaacuagcuuuggccaggauauuuggcucuuccuugauguucagggcaucagaaacuaaaccagagcuuaggggagagaaagcaguaggaauguccucucauugccuggcaugauggcugccaugaacuucuuggaacuaaagaaaagagagugugacauuaucaguaaucuuuuaagagauacauuuucggugagauaaguaaaacaguuaacaggugucccaauuuuucgagaaacagacuuuuagcugauguuaggagaauuaaauuuccucaccacaacuaaauugugccuuugugccaguuuuguaauuaaauugcugaaucuuagcagcuagguauuuccugaaaucuuacagcgaagaauuuugcuucuuuuccguguuugauucguuuucaauuuuacuugacauauucuaagagacuuugaagguguaaauaaauucccuauuuuucuuucaucacaguuuuucuauuuccuaauuauuugaagcaaaucuaucuuuccagaguugcauguuuguuuuucagugggccuuccugauaaagugcuacguauguacuucaagaacagauagcuaaagacaauaauccuauuacaucuauguaaucaagacggcaacuugcugucuuguuucuuaucaaagaauuacauuugccauauguucauaaguuagcuuuugauuguuuacaauaugugacugaacccagcucuugguccaucagguauaauuauuaagauccaggcuaagauuuuuaccugaagcucuaaggaaaccaacuauggaguaugucuagaaacacaagagccaacugagagaaauaagaguagaaaauuuaaauuugcuuacguuaaaaaaaaagaacaaaaacaacaauucaugauuauccagugcuaauguaggcauuaguuuuuuauuuuauuuacauggaaggagguggaaauuaagguacaagucaagccuauaagacuucaagucuuacagguuuaggacaggccaugaagcaccuguagaucugaaaugacuuggaggagcuacagagaaggcagccauccaucaggcuuuggaacucuaaacaacaucagaaugcaaauuuccuucugccuggaauuuuguuucuuugaauacuuuaaggaaacagcuuauucagaaaaaagcguucuuuaaaaugagugaaaaacauaagaaaagaaaaauagugcaaucucucagaaaaugucaggcaagcaaagaguuaggaguggaagaacaaaugacuauuugggcagaggauuggugccugacugucccaaagcagcugccaucauuacaagucccuuggcagccaguuugcagggggcaagaggaagguacccuuauguccccuugcuuguguccauucucaaauauuaaaaacagguagggugacauuauuccaucggucucaaaguuaacauuugcauuuuuucagagguuauucaaccagagguuuaauaacuuguuuucaugcuacaacuaucugacuauuuaaauaaucaucuuccucccuccaagucuaacagacagacugacuuaaguauucuggaacuuuaauguucuguagcuaacucugauaaagacacuaaagggaggaugccaaagagacuuggauccagaauccuauucugaugaaggguuuauuucuuuggagcaauaaaaacucaugauuugauggaauugcccugaaagguuaauuucuagaaaaugauuuccugccuacaguuauaauacugaugucuuagaggaaggagucccuucuagaagcaucuuucauuuuuuuaauauugaaagaacuuuguauuauucaaaguaguauuuuuuucuuaaaaguuccccuucaggauuacuuuuuaaaucuguuuuuaaugaugauuaauucacucacuucucagcuuuuuuucaauguccuuagaccaugauuaacuuuggcacugugacaaaacaucggcuauccuaauccuuauuaugcaagagugccagcugcacagugacaagugacuuucugcuacugucugugugacuuuggucaagaugucuacacaaaugcaaucauugauacauugcuguuagcugguuauuaccuugcaaauaccaaagaguaacuacaagacuugcuaucauuuccuuauugaaaauauuccuuuaucaguggggaaaaaaaagcuguagucagaaaacauauuuguuagcauggcuaagacuaccaaaagaauuccauauguuuagacagguuugccuuuauaucaagcucaauauuuuagaacuaucagcaagcacaccuauaucugaaaauuauauuucagaacaaaauucuugaucuagagaacaaucacguuuugaaauuggauguugcuuuugugugucauuguuaugaagcuaauauugucccaaguaauaccauacugcuagaggcuguguuuacuuagcuguccccaaaagaguugggaaguuaaaaagaaaaauaaauacugugaagcgacucuucagugacuaacaagucuccuucgggagaaugaacuauaaaacuucaucaaguucacuaaaucuacucccuacaaacuuuguauauaagccacucuaaccaggacuuuugacauaauuugaagggucgaguggaaaaugaaaacgugaggcuccuuguuuaaaauuucuagaaaucccaagauggcaacagcacagcacuaaaccagaugugggaucuuucuaagcauaggaaccagugcgaacuggauggcuacgaagcuggcccuggcuuuaaccguaauacuacuguuugcuaucaauauuauuaugauuaauuauuauuuugagacagggucucucucugucgcccaggcuggggugcaguggcaugauuuuggcucucugcaaccuccaccucucggguucagcaauucuccugccucugccuuccaaguagcugagacuacagacuugugccaucaugccuggcuaauuuuuguauuuucaguagacauggguuuuccauauugagcagguuggucucaaacuccuggcuucaagugauccgccugccuuggcaucccaaagugcugggauuacaggcaugagccacugcgccuggcugcuauuaacgcugguggaucuuuugagaacagaaccgaacaguaaacauuugaaaugugacaaauuaucuaggaauaugcuuuuuuguuuuuguucuucaaaucuaccucaugucugacaccccuacagaggugaugcccaggaagaucagugccccaagucacuaugcuaaagucucccugacacuucuuaucacucauacacuuaagcugucaccauccaaguuagcaggguuaauuuuucugccugaggucacaacucccugcuacuucucauuuuucacccgauuuacuacauguguaggcaucuauuuagaguuuacaaccuugaauuuuauguaaagaucucagggaacauaaaaaucaauagauaauggcaauugacguuaauuuauuaccuucuauugucugucucucuguguuuaugccuaaacaguguuuugauuuuuaaaaaacuuuuuauuacgaaaauuucuaagcaugcaaaagaguugaaaauauaguccacauggauccgucacuaagccucauaaacauuauuuguuuugccauuuuuuuucauuuauuccugucuauucucccugcucccauuuuauuuuggcugggauaccuucaauaaaacuucaaauaucaaguuauuuacucaaauucuucaauaugaauuaaaauuuuuuuucuuauguaauacaaugcauuauuucuuuuacuaaaauuaguuuuaaaaacccauauucucaucuaauacaugauucauauucaaacauccccuaaugucuaaacaauauuuuuaauaguuuguuugaaucaggauccaaaaauguuucccucauugcauuaguuuuuacauaucccuuguuucuugaaagcaguaacagaacuacaccuuuaccuuuuaauuuguuuuuaaaaauuuguuucacugcaaguuacaaaaugaugcuuuccuauuucuaccauuucuccuguuugaaaacuucacugauaucuuaaguucuuuugguuaguccaaagaacaauuucuacuaaaaggacagaauacaagcuuacucuucccuguaacuaucaaguuuaagaugaugaugaauuggugccuuagcagcuuccaaaagugucuaguacauuuugcuucauugcuccaaauuuuuaaaaccuuuuuugaguguuauuaugaaaugauggagcgauaauuuguuuuaaucaguugcagccauuauucuuuuugauuuucaauuugucucauccugugucugcaggagccucuuuaaucuggcuucuaggucuuuuauuuuuauuuuuuuuagaugacaccauuugccucaguauuguauuuagagcugaaacgagggcugcagugguacuuagggcugcaggguugccaaugcuuucagacaacggacacagcuuaaaagugagggacaaaagccugaguucacacugauguuauguuuccuauucuuuuaaaaguuuguuuuuugaauauauauuaauccacguuaaccauuacuuucugaccuuagauuucccucaaaguucuaauuauugagcaguaaagccacuucugucuccuaauucauccuuuaguuuguacgaagccucuuugucacucagccuucagguugucaagucccuaaauuccauguagugaauugugcgaccuucaucucuuuugcaaaguccugagugaaugucaagaagagacuucucuuguccccauuaccgaauuauuuuucaugcuuuuugaucuguuuuaucuuuaagauaaucuaaauuuuuuccaaauuucuucgauuucugugucauaaguacauagacauggcaauuaacucaucaacauuucuaguucuaauuauucuuauaguacauuuacauaauuuauuuuaauugcauccaucauaaucgaguuguggugauuuagucugcguauaauuuuuaguacaggggaaugccuccacaauuauucagguuauuaacagucauugcuucagagcugagauaaauucuaagugacuagggccucagaaagagaguauuucacacaaacuaauucagcugcaugggaauuaggcgcugugcauagugacagguagagucucagaauuaguuucagucuauuagaaaagcuauccaagaaaaauuccaaggagccugcccuugucuuacuugauuaugccagucuucuucucugauggguaaucagcuuuacauucaguucaaaauagaaauaaauuaaagacuagguucaaaucacagaagagaaagaaccucuauguauaauggauuauguuuccagauaacaggagcauucugacgcuucaagauagguauauaagagaguagaaaauaggaucagcuuuuuucaguaaacacuacauuuaucauaguagcuaaaagagaaauugguccaguugaaucaaaacuggacagcaggauacgaaugcagugaauucugcucuacagaaauuggaaggagguuuuccuuuuuuugcuauuccaugccaugcccucugacuguuuuccaugacacaaaaacaccaguauagcaaaauacuauucaaaauaauguggcauuuaaacucuuuaaauuaggaaguaaauucuggcaaauaauuugaucccaggaaauguaacauuuauaaaggcauggcucaugacgcuaugaucacaucuggaauuggacugcuaugaaaacugaccucagcgaccaguuuaauuacaaagcagccugccacaacuucaaauaucuaccuuuucaaaacccagguggacauugagagcucauuuuuccaccucuuauuuucuagagcuuccagaugaauugucugccuuaugcaauuaucaaaggccccuuccuguacacacacaggagcucaccguauugaccaggcuccugguugaaugaacgacgguuccauuuucaugaaagaaauaggaaaaggacccaacacugccugucacuauucaacucguucgucugucaucacagcuucuaaugggagugcuuuaucuuagucuuucagauccucuauaaucuguagagaaaaaaaaugguucagggaaaauaccuugaagguuacccuucagaaaaaaaguguggccccaaacagguuuucuugcacagaacaaauuacuauacauucugaaaguaucccuuguuaugugagucaauaauauguuccuucuguucaauuaaaaaggaagucaguuacguaucuguaucaaagaaaccgauuguagagaacaucgucugguguucauuagacucaucaguuagauaaguaauuuuauauuuucucacaugcuccacaguagucacugugaccuucauuacauagcaauagcucaauaugucaggaacuguggaugacauauugcuaaucagaagaaccuguguguagauuccagcucgauugcuuccaaccguggauuuguauaugcacuuaaccucucuggucuugauuuucuccuguaaguaaauaggaauaacaucaucccagcagucaaguguaaggauuaaaugagguaauacagguaaccccuaagcauaguaacuaguauaaugcagguaccuaagaggauguauuuuucuuaguauuuuuguaguaaaaugagaaaaggaaaaauaauuagagaaauauccaaguucggggcugugauuaucauaggcuguguauauuuuugaugucgucauucgaacuuauuaaagaaucaacacauacucagcuauuguguagcacaaaauggacagcucguguuugcacacauuucauccccuuuuauucuggcucuugaucuugguguuaagggacgaugauugccucucaugauucaaauuuaagaguuauagcaauaaaaucucaguaaccuauggcauacuuaucugaaacuuuaugaaaucuauuuauaucuugagcuugaacaaacuuuccagaucauaaauucucuauaauuuuaaagacuaauuuccuuuuuuuuuuuuuaacuaaauucauccuuugaagauucacgucaaccaccuaauuccuccacuuaucucugaauaaauacuuaguccaaggcuaguauuuugagauuugguuaaaaccaccuacuagcaacuaaauaaauaaauacaucaguuuucggaucauuuuauguucuuaaaaguacagaagguuucagauaauuauuuuauaauuggaaauaaaaagaaaauaaaagacaggaucugggagaucaugagguuugcccaaggucacacagcuaauuguggcagaacuucuagccuuuuucuucaaagccuggaaauuuuuuuuaauuuauuuuauuuauuauuauuauuuuuauuuuuuauuuuugagacggagucucgcugugucccccgggcuggagugcaguggugcgaucucggcucacugcaagcuccgccucucggguucacgccauucugcugccucagccuccugaguagcugggacuucaggcgcccaccaccaugcccagccaaauguuuuuguauuuuuaguagagacaggguuucaccauguuagccaggauggucuggaucuccugaccucgugaucuacccgccuuggccucccaaacugccaggauuacaggcaugagccgccgcacccagccaaagccuggaauuuucuaauuguuguagccuaagcucauugcugguuccuuuugcccaggaucauuuuagcugauagcaggcacuugaacaaaaauuaguaaaacaaaaauauaugaacaaaaauuaguagaccuuguucucaugcuauccugaagcaaucuggcaucauggcuuugggaaagucaccuaugaaguacagaccuuucuaaagaaguucuuacauaauuugacuuuuuuaaaaaguaaaugcaauuauuaacuuuuuuaugaucauacagauaauaaauacuuauagagaaaauucaagcaauagagaaaaauauaaagaggaaagcaaaaaccacccaauguucuccaaaugagaaauaauccaauucauauuuugauuaauguuauucuggaucucuaugcagacauacacauauauaauuuuauguaaaugggauauucuuagccaugcuauuugauagcuuguucacaucaacauuuuuuccauuuaauaaaaauuauaaaaauuuugacauuagaacuugguaagguuuuucuauguaaaauccaacuuaaugcucaaaauaaauuuuacggaacucagucacagacaagauauuugugcaagggcacaaggcugguauuuggugggcugggguggaacaagauuucaauacagccaacuuuaacucaaggcauuccuuuauaauggcuguauugcauccacugaaugaauaucuaggaucuauuuuaaauaaauagagauggguaaugaaauaacuuuaagauuucugauacuauaaagaucucauugauaaauaucaaauauauuuguguguauuugaucaaacaucuccuuggauauaauuccaaauaaauaauuuugggguuaagauguacaucucuucaauugccagaugaaauacuaugcuuuuauagaagagucauuucucuacauccucaacaaugaguguuacugauauuaaaauaagcagagauuuacuucauuaacacagacucucucuuuuggcuuuguaaugcagaauuaaaaacauauacuugcuauggcccauucuuuaaaauuuaauaaauguuuacuaggugauuuuaagaguagauauugugggggaaacaagaaugcuugcuucauauaucucacaauauaauagcugaaaaaucaucauuuuugggaaacaguaaggaucguuccacauauugcugguaaaaauaguaauauuauggauagaaaugcuacaacacacaccaaaaucuuuuauauguucauaucuaugacucaguaauuuaacuaguuggauucaauuuucagaaaaugacgagaugugcugucaaaauauuuauuuuaauauuaccuaugaaaguaaaaaaugggaaacuuaaauauguaaaacagacauugauuauggacuacgacacauccauuagaugagcuguuauuuagccauuaaaacuuuuguaacuuuuguagacugcuuuaaucauaugccaaaauguucucaauauuuuaaacaaaaauacaguauagauacugaauaauucugauucauaaacacauauuuguauacaaugcaagaaaaauuugccaaacacauuuauggugguuagauuacauauuuuuauuuuauucuuuugacuuuuaucauucuuuccccccaaauauuguauaaccaauugcauuuguuuuaugcaaaaacuaaaaaccuacuucauauuucaucuuuguccaaucguugacagagaucucagaaccuaaaagguuccacuuaauucucacucauugucaguccuauaaaccacguagaugacuuaugucuuguucagaucccuacaugcagaucuguaggaaauguuuccucugguccccuuccuuuuuguuucagucugccuagcaccuuucccuauucccccuaauucuaguagaacuucucaucaggugagccugccugccaucacacagaauauuccaucuuguagacacacuauuuaguccaggaaguggcaugggacccaagaugggcccaucagagcccuuuggauguagagaaauuuagguucaggagcccugaguucaagggaggcaugcugguaacauguuugcacaagaauguagcauaaagacaagaaagacagguagaccugaggugcagggagaaaaacaugcuccuaauggcaucuugugaauccuuggauauacucgugccugaaacuagugccagucuaaagacuucuuaauuuuaugaaaccuaaaauuuccuuuuucuuuaagcaaguuugaguugcgguucugucacuuaucauuaaguguaccaauaaaggguccaaucaaagggggugucuuggacuuaccuuucaacucucauaugcuaugcagcacacuuuucauucaucacaucuuaaugugcaugaucagaaaaaaaaacaauuuuaacucauguucaguaaguaucucacuccauugaccuuggagugacuuaagacucuauuuuguauaucuuuacuucaaaaaacuucuaauguacaacuuaacccaugaaucuuucuuaaacaucauugaguucaaaguucugacuaguuuuucuuagcuuguugucaaggucauuugcauuuauaucuccauccuucccacauaccuugaugcacucugcaagauaaaugagaguguucuuuucuaucuugcaaaucauuagaucugauuaugguucuuaaaaggaaaagcauucagcaugggagcaugcuaggcgggugauugacugcugacgccucacuugcuguucuuccauuuuaggaaugcacuggcaaggccagggucacacagugcaagauaagcuucaucucaaaaugggcaggauggcucaacacaguaauuaauugcucucaaggaaaucuccuuaaagccacugcagacuuuaaguugucccagacugauuagaaaagggucauaauauuguaauuaaguugucaaucacacaagaaauaaauuuguauggggacaaauacugauggggauaugggcaaggggaaacgaucaaacaguguuagugggaauggaaaguaguacagccauuauggaaaauagaauggaaguuucucaaaaaacuaaaacuagaacuaucauaggauccagcaaucucacugcuggguauacaugcaaaagaaaagaaaucaguauauugaagagauaucuguacucccauguuuauugcagcacuguucacaauagcaaagauauggaaguaaccuaaguguccaucaauggaugaauggauaacaaaaauguaguguauauaugcaagagaauauuacucagccauaaaaaaagaauagaaauacaauuugguaagaaaauuuuggaguauguauggaguagaguucaaucaacuuggaauccuaaaaacacuugugguuucaaacacaaaaagaaagaagaaagaugaagagaugccagucugaugugauugagaguggaaggaaaggacugaugagaaaaaucaucaaaaccaagacacaaaggaggacaugauugaaggaggaagacuccuagaugugcuaaucgagaugaaaaaauuaguuucagaggaacugaggaggacuuuguauuucugacauagauaagaggcggucggugaguucauguggauagaauuaacagaaugcuguauuauugaguuucaguuggaaguaaauaggauauuugcaaccaaaagccaaaugugacccuuucuuguagaacacacagcacaauuucuccacagcucuacuugcauaccuuuauaucucagcuagggccugagguggaaacuaaacugaacuagcaaaauaaaagagagaucuguggcccuaaagcccaaggcaucauuaacuagaaggaaaauaaaauagugugggcuuugaagaucuucauggcauauuauguuauucucagagagugugguaaaacugugcacauuucaugugucuggucuauaagcaguuuguagaacggaguucucucacccuuaccaaaaugcguguauuuuaaggcagcagucaggguuggggugguaaccacagcagugaugggagaaaacaauuggucccauuggugucaaugagaacuccugccuuauucuuuccuuugguggccaagaaagcuuccccagggaaguagcaugggauaacuaggaaaaccuuguaggugguacaagcagaggaacugggagcagguuuuugugucgugaugggguagaagggagaaagguagcagguagggaagauuuuauugaucacgacuuauaaauauuucguccucgucccagcggaagacgugugagacuggcuugcccaacugugcuccgucugugugauucauucguuccuucaguaaauauuuauggacugucucuacuagaaggggcacaagaaagaaaaagcugaguuuugcugcuugauucuccccuguguucaagcccagcaucaguuucagcuguugguaaaucugguaucuuucaaucaguagagcaaacagauuggggaucagagaguuuuucuaacaauuucagauccucuucugcuuuaucccaaguuuuaaucauugucacuacuauagaccugcagggaguuuguuauucucccacagaaggaagcacguaaagguaaaaugugcaagauaugcacuucaucagugcuauuuacacacagaaccugcauauuugacccugugugcuuuuauucuguuuccccagagaaugggcaugauuucuuuauugugguuuuccuuguguuaaacaauuauacagauuacaccccaugaaaaagaaguucauugaauauauuauucuuaucuacacaucucuagcuauagauuuuaaagauuccuguacuuggaaacuauaaaagugauuauguucaaaaugaaaaggaucuuaacaauuuuaguuuaguagaaaagaaugauugcgcuugugaagacuccugaauugauucauugcaugccccugaccuccuuuacguuacagauguccucuaugcagacaaguuuuaguucgacuaguagagaaagagcauuuuguuuuaaaucuuuuuaccaaguaaugcugacuucauuauagucacauuucucgauugguuauaaagaaauauauucuggcuaucugaaauuaagaacugaaugaaaaucgcauuacaguuucauguuaagacaucguguaauuggaauaaagcaacacacacuauggaauuucaagaaaaggagaauucagucuucugcuaaagauguuuaugauugggguugguugaugguugacagggauguguagguugaagcuuucucucuuaacauauucaaaauagugucuaaucaauauguugaucaugaaguccacauuuuaacaucaauauucuuugauauuaugcuacauacuugaacuggagaggaagauugccuucccugaaaugguaaaaauauaucaggcugagcuuuuagcugaaagccagugaugaaaaugacagcaucuuauccuuguagagcucuuuuaugucuuaaaacaacuuuauaagcaucauuaggcuucauuugauucagucacagagaggcagaaugacuugagaaauugauuugccuaaacugcaauuucacugcagaaggaagauuagaacacaaacaaccugauucucaguccaagaucuuugaguuagaguaccaacauaguauucuuuuuuuucucucagaaauguuuuuauguuaacuuauguagguuaugguucaccuaaaaacuugaacuaggugucccuugaucuucuauuuuucugguucuuugguuagauaguguuaugaacaggauuaugucccccaaaauucacacguuaaagcccuacuccccaauuuggaggucuguauuuggagaugggccuuuaaggaggcaauuacaguuaaaugagguuggaggguggggcaugcucccugauaggauaguauugguguccuuagaagagaaagagagcucugucuagcaggugugcacagaggaaaggccauaugaggauacaacaagaaggcagccgucagcaagccaggaagagagcccucaccagaaaacaacccugaggguacuuugaucuugggcuucuagccucuaaaacugugagaaaauaaauuucuguugcuuaugccauccaaucuuuguuauuuuauuauggaaacccuugcaaacucauacagaugauguuuucucagagcaagaacuaaacuuguccucugacguccugaacaauuaguucagucuagcauagcaugaaggagagcgcuacauauuuguuaaagaaaugaaccacuggcauauaaaguugaauaaugguacuauuucuguaaguuuaggaugugugucuuuaucaaccaacagaugguuuauggccaggucaauugaaaaguugauauuuaauaauaauaccaggaauucugcuuauugaauuaauuuuaaauguucuguaguuuguaaaaaggggcagauggcucauauaccuuguaaaaaggggcagauggcucauauaccuucuauuuuaguaauauuguuugucugccuagaaauuuacccacugaaguucuugcugcaucuccuagccucagugauaucaaaugcuaaucaucaaauuucuucaaugguaauugugaauacuucacuguauaacacgcccugugcuaaacucuuuaugggcauuaucucauuuaauauucaaaauaaucuuuugaguuaggcauuaauuaguauaauuuuucaaauaaggagaaugacaguuggagagauuacauaacuugcccaaggucacacagguaauaaggcagagguggguuucgaaacuagaaggguggggcuccagggccccuaaccaacacuccacuccacaguagccaucaccauggcaaagacaggaggagacaguggggagaagccacggagcugggggaggagauagggauggagauaaaccugggacugaagagauggcuggcaguggaagagaggacugacguuaaaacacacgagaggucagucuagcugcucagauggaaaaaaaaagucacaaaaaauaugagaggucaggaaggagaaaauggcacucaacuaagugggagaagaugaaauccuaaaucaaggcaaccggaauaaagcagaaacgcaauuaccagagcgugacuggacaagcaggguaagaguuaggcguccaaacaacccauaggucuuaagcuuugguaccaggggagaacagugauagcauuaauugggaagauaaggaaugagucugugaggagaaagaaagacaaagcaaauuugcuuuggggcauccgguuuuacagccucaccuaaucccugccuuccagcaccagauuuuuuaugacccugaucaaagaugagcuucucuacaauucacuuacuuagggaucuuaauuccacucagugauagccaccuauuucccuauuccagcuaccauuugcuauuugggagauuucggauacagguguguuuucccaggaguguaacuacgaugcaaucauaguggacaucgcauaugaccagguaauggaggagcuacuaggggcuggcccauucucguguuacuccuaaauuaaagcagcugacuauccuauuggcuuugaccuuaguguauguuuaaaacuauagaagacugugaauguguuggguuugcaacauuuuguuaguauuuuugaugauaaauuuuauuauaaaaaauuaugacagccagcauagacuuuuacugugugaugaaacugaaauucucauaggagcacacacuguccacauuguccucccaauuuucaguuucucgaggcuucugacuguauugggaccacaucgaggaugauuugcucugaaauaaauccaugaaauucauucuuguauuaaagccuauuagagaagucucuuuuuucucuugcucuaucuuugaaaacgcuguguuuguuuugcauaaacacacugugucuauuccugagaaggggcaaagucauagccaaggacuaguuuaagauauauuuuccaagcuaguaggaaaagauacguagaauucuuagcuucacuauugaagcugaauauccagaauccuacucuacaugagcgaaaccuuauucaaagccugauucuuggcucaaaauaggagguauguucugggaauuuauaguugcauuaaagagaagaauauugcagagaaaaggaaagaaagauaugccuucuuugguacauaugcagacaacauaugcucugacacuugugcacauccugucgaaacacugauaacagauuccaaaggaacaagggagagaaaguuaagaauuaacaagcagcuaggagaguguauggugaaucauuauucaaagagcaaauguacuuggcuauuauaauaaaagacaagauguuucaaagaagggaaauuguaggccaauucaugcauucaaauguuuucaaacaucuaucaugagcuggaacagugacaaauguuuuggaugaucuaaagaugaaccuuauacgguuuugccauugauaugguuuggcugugucccuaaccaaaucucaccuugaauucccauguguugugagagggacccaguggaagguaauugaaucaggggggcaggccuuuccugggcuauuuuugugauagugaauaagucucacgagaucugauggguuuauaaaggggaguuucccugcauaagcucuccucucuuugccugcaccauccauguaagaugugacuugcuccuccuugccuuccaccaugauugugaggccuccccagccacgugaaauuguaaguccaauaaauaucuuuccuuuguaaauugcccagucucugguacgucuuuaucagcagcaugagaauggacuaauacagccaucaagauaauaauaacauaaaauaggauggaaucaguacuguagagacauuuaaacaacauguuaugaggagcacaaaggaauggagagauuaacuuagauuaauaucaugaauucuaauaacaaaaaacuuuuuugaggggguagcuuuacuguuauacuccaggguuauuucaaaauaacugaacaucuggcuaucucaggaaugacacuccagugguaguauacuacugcuauacuuuuauuuuuaugcuacacaacuuaauacaaaaguauguauaaaccaugagucaaagguuuccugaagaaagaguuguuuauuaacuucugguuaaacucuuguuucaagaaacuuaacauuuuucacauauuuuauuuccauauuauggaaaauuauuugcuucuuaugccagcauagaagauaacucuuaauuuaauauucuuucaagaucucauguaagcaaaagaggucauggauuaaacugcaacccagcagcaaauugucuuuuacaggacccauuuuauuugacuuuauauuccuggugacauugcccuuuguggucaggcaaguacaugaagccaguguuuaaaaugacacauagaucccuuaucuggaccugaagaauagcucaagguccaucuagucaugcacuuacauagcagacagugcugcggccagugcuguaaugacccaaaucucuucccaucucuucuaaacaguucugaaaaccugaacccuuggaaagcuuccaauggccaucaucugugauauucuuuggcagacuucucuuugccuuccagagccuccaggagccagaagugccugaggacugccaucuuccacacaugcugguaaccaaugaccauugggggugggaaaauggcagucuagcuuuuucuccuccaguugggaaaacucugacacuccugaggacaccugagggacuggcugagaucuacgcccugagcuugaggacuucugccugggcccucccucuugcuccccuucgacuccuucccuguccugcuuccauuguuuccuuagcacacucccuuucauaaauuccuugcacacaaaucaaauccucaucucuagaucugcuucuagggaaguuuauuuaagaaguaugguuuccuuauuuaauaauaugguugacauuuugcuacuuccaaaaacaauuugaggaagugacugaugauauuuuccccuaaauucacaugcuuuacucaucuacaaagugaaugacaaguuucuuccuauucauaaacccuaccuuggacuaacugaaccuuaacccgaucaacuuaacaaugcauucuuuauagagaaaagcucagagaguccagucuuuguuacaucugacaauuuuuuuauaagauuauuuaaugagguaauuucucgcaccaagccucaguggguuuguugggcagugucagcgaacgagcuguagcagggugaggcauugcuacacaaauguguuucucuaccuaaacaucuauuuuuacuauuuuugggggcccaauuccaaaaugacaauauuuagaaacacuuuugaguuugaaauucaauaaaaacaauuugauaucuaaauuuaaaugcuugcugcacauaucacacucuuagaaaauguuuugaaaauccuugcauauuaccaaaguagaaucagaaugauuuuaaccugcgaagcaauaacucacauaggagcuaaccuaauuaauguauuucucugacccacaaguggacuaugggacuaaacuaaaccugaagccagccccucuguggaugccuggagaaagacagcauucccacagcccccucagcucugcagagaugccagucaaagcuacacagacaccuggaguugugggcagagaaagcuguaagacuaugugaaggauggccagccuugggcaaugugguagauugagucaacacagugcucccagcaggccucaaauccaaaaaugcugaaaucaguauucaauagauauguaauauacuuaaguuuuauauuuaauucagcauuuauauauauaugaaauauauaaauacaugaaauacauauauauauuucauugaugauauugaugauacauuuuauuauagaaauguaugagagccagcauagacuuuuacuguaugaugaaauggaaauucucauaggaacacacacuauccacauuuuccuuccaauuuucagcuucucaaggcuucugacuguauugggacuguaucuaggaugauuuucucugaaauaaaucauauaauggggguauaugugugugugccucaaaccauuagacucaccuuuccauaagaacccugaaaauuccuauuuuaguuucaaggcugauagggccaagacaagauauggaauuccuagcaguagaaacucacuguuuuuauucaacaugucaauagcuuauaucuuauuuuucuacuuagacuuugaugaggggaagguauuagaaaacugauaccugaagggaaagugagaaugaacaagguugcuuuaagggggagaaaaauaguaagaagggcauugagauuaacagugaacacacacaaacacacacauacacaauaaugauaauaaaagcaauuagauuuguaaaaguauaagguuuucucuuacaguuucuuauuucacuaucacaauaaucccaugaaaugaguugauaaauaguauucuccuauuuaagaaaaaaaaaaaaaaaacuucagagagacaaaaugacuugcaggagauuaauagcuguaauugaaugcaaaguagaacucugacagguacaggcauaucuuggagauaucguacacuugguucaagacugccagaauaaagugaauacuacaaaacagucacaggaauuuuuugguuuccuaguauauauaaaaguuuuguuuugcccgggcgcaguggcucacaccuguaauuccagcacuuugggaggccaaggcagauggaccaguugaggucaggaguucaagaccagccuggccaucauggcgaaacccugucuguacuaaaaauacaaaaauuagcugugcacgguggcacaugccuguaaucccagcuacucaggaggcuaaggcaggagaaucaccugaacccaggaggcagaaguugcagugacccaagauugcaccacugcacuccaguuugggcaacagagcaagacuccaccuaaaaaaaaaaauaaaaaaaaaaaguuauguuuacauuauacugugucuaguuagugugcaaaagcauuaugaccaagaaaauguacauaccuuaauuuaaaaaaugcuucauugcuaaaaaaaugccaaugauuauuugagccuucaaaaaguuggaaacauuuuccuagugaagggucuugccucuauuuugaugacuuccaauugaugagggcaguuguuguugaaagcugggguggccauggcagugucuuaaaauaaggcaacaaugauguuugccacaucaauugacuuccuuucaugaaauauuuuucuguaaugugugaugcuguuugaaagcauuuuacucagaguagaacuucuuucaaaauuggagucaguccucucaaaucccguuguugcuuuauuaauuaaguuuauguaauauucuuaauccguuguuaccauuucaacaauguucacagcaucuucagcaugaguaguuuccaucucaagaaaccaauuucggggggcgauuccaagauggcugaauaggaacagcuccagucuacagcucccagcguaagugacacaaaagacgggugaugucugcauuuccaacugagguacuggguucaucucacuggggauuguuggacagugggugcaggacagugggugcagggcaccgagcaugagccgaagcagggcaaggcaucgccucacccgggaagugcaaggggucagggaauucccuuucuagccaagggaaggggcgacaaauggcaccuggaaaaucgggucacucccacccuaauauuguacuuuuccaauggucuuagcaaauggcacacuaggagauuacaucccgcaccuggcucagaggguccuaugcccacagagccucgcucauugcuagcacagcgugucugagaucaaaccgcaaggcagcagcgaggcugggggaggggugcccgccauugcugaggcuugaguagguaaacaaaguggccgggaaacucaaacuggguggagcccacugcagcucaagaaggccugccugccucuguagacuccaccucugggggcagggcauagccgaacaaaaggcagcagaaaccucugcagacuuaaaugucccugucugacagcuuggaagaguagugguucucccagcacggagcuugagaucugcgaacggacagacugccucaagugggucccugacccaggaguagccaaacugggaggcaccccccaguaggggcagacugacaccucacccggccggguaccccucugagaugaaacuuccagaggaacgaucaggcagcaacauuugcuguucaccaauauucacuguucugcagccucugcugcugauacccaggcaaacagggucuggaguggaccuccagcaaacuccaacagaccugcagcugaggguccuggcuguuagaaggaaaucuaauaaacagaaaggacaucaacaccaaaaccccaccuguacgucaccaucaucaaacaccaaagguagauaaaaccacaaagauggggaaaaaacagagcagaaaaacugaaaauucuaugaaaucagagcgccucuccaccuccaaaggaaugcagcuccucaccagcaauucaacaaagcuggacagagaaugacuuugaugaguugagagaagaaggcuucagaugaucaaacuugucugagcuaaaggaagaaguucgaacccauggcaaagaaguuaaaaaucuugaacaaagauuugacaaacggcuaacuagaauaaccaaugcagagaaguccuuaaaggaccugauggagcugaaaaccauagcacgagaacuacgugacgaaugcacaagcuucaguagccgauucaaucaacuggaagaaaggguaucagugacugaagaucaaaugaaugaaaugaagcaagaagagaaguuuagagaaaaaagaauaaaaagaaacgaacaaagccuccaagaaauauggcacuaugugaaaagaccaaaucuacgucugauugguguaccugaaagugacgggaagaauggaaccaaguuggaaaacacucugcagaauauuauucaggagaacuuccccaaucuagcaaagcaggucaacauucaaauucaggaaauacagagaacaucacaaagauacuccucaagaagagcaacuccaagacacauaauugucagauucaccaaaguugaaaugaagaaaaaaauguuaagggcagccagagagaaaggucggguuacccacaaagggaagcccaucagacuaacagcugaucucuuggcagaaacucuacaagccagaagagagugggggccaauauucaacauucuuaaagaaaagaauuuucaacccagaauuucacauccagacaaacuaagcuucauaagugaaggagaaauaaaauacuuuauagacaagcaaaugcugagagauuuugucaccaccaggccugcccuaaaagagcuccugaaggaagcacuaaacauggaaaggaacaaccaguaacagccacugaaaaaacaugccaaauuguaaagaccaucaaggcuaggaagaaacugcaucaacuaacgagcaaaauaaccagcuaauaucauaaugacaggaucaaguucacacauaacaauauaaaccuuaaauguaaaugggcuaaugcuccaauuaaaagacacagacuggcaaauuggauaaagagucaagacccaucagugugcuguauucaggaaacccaucucaugugcagagacacacauaggcucaaaauaaagggaugggggaagaucuaccaggcaaauggaaaacaaaaaaaggcagggguugcaauccuagucucugauaaaacaaacuuuaaaccaacaaagaucaaaagagacaaagaaggccauuacauaaugguaaagggaucaauucaacaagaagaacuaacuaucuuaaauauauaugcacccaauacaggagcacccagauugauaaagcaagucuuucgacaccuacaaagagacuuagacucccacacaauaauaaugggagacuucaacacgccacugucaacauuagacagaucaacaagacagaaaguuaucaaggauauccaggaauugaacucggcucugcaccaaguggaccuaauagacaucuacagaacucuccaccccaaaucaacagaauauacauucuucucagcaccacacugcacuuacuccaaaauugaccacauaguuggaaguaaagcaccccucagcaaauguaaaagaacagaaauuauaauaaacugucucucagaccacagugcaaucaaacuagaacucaggauuaagaaacucacucaaaaccacucaacuacauggaaacugaacgaccugcuccugaaugacuacuaaguacauaauaaaaugaagacagaaauaaagauguucuuugaaaccaaugagaaugaagacacaacauaucagaaucucugggacacauuuaaaucaguguguagagggaaauuuauagcacuaaaugcccacaagagaaagcaggaaagaucuaaaauugacacccuaacaucacaauuaaaagaacuagagaagcaagagcaaacacauucaaaagcuagcagaaggcaaaaaauaacuaagaucagagcagaacuggaagagacaaagacacaaaaaacccuucaaaaaaaaaaaucaaugaauccaggagcugguuuuuugaaaagaucaacaauauugauagaccgcuagcaagacuaauaaagaagaaaagagagaagaaucaaauagacacaauaaaaaaugauaaaggggauaucaccacugaucccacagaaauacaaacuaccaucagagaauacuauaaacaccucuaugcaaacaaacuagaaaauccagaagacauggauaaauuccuggacacauacacccuuccaagacuaaaccaggaagaaguugaaucucugaauagaccaauaacagguucugaaagugaggcaauaauuaauagcuuaccaaccaaaaaaugugcaggaccagacagauucacagccaaauucuaccagagguacaaggaggaguugguaccauuccuucugaaacuauuccaaucaauagaaaaagagggaauccucccuaacucauuuuaugaggccagcaucauccugauaccgaagccuggcagagacacaacaaaaaaagagaauuuuagaccaauaucccugaugaacauugaugcaaaaauccccaauaaaauacuggcaaauugacuccagcagcacaucaaaaagcuuauccaccaugaucaagugggcuucaucccugggaugcaaggcugguucaacauaugcaaaucaauaaauguaauccagcauauaaacagaaccaacgacaaaaaccacaugauuaucucaauagaugcagaaaaggccuuugacaaaauucaauagcccuucaugcuaaaaacucucaauaaauuagguauugaugggauguaucucaaaauaauaaaggcuauuuaugacaaacccacagccaauaucauacugaaugggcaaaaacuggaagcauucccuucgaaaacaggcacaagaccaggaugcccucucucaccacuacuauugaacauaguguuggaaguucuggccagggcagucaggcaggagaaagaaauaaagggcauucaauuaggaaaagaggaagucaaauuguccuuguuugcagaugaaaugauuguauaucuagaaaaccccaucgucucagcccaaaaucuccuuaagcugauaagcaauuucagcaaagucucaggauacaaaaucaaugugcaaaaaucacaagcauucuuauacaccaauaacagacagagagccaaaucacaaguaaauucccauucacaauugcuucaaagagaauaaaauaccuaggaauccaacuuacaaaggaugugaaggaccucuucaaggagaacuacaaaccauuguucaaugaaauaaaagaggauacaaacaaauggaagaacauuccaugcucauggguaggaagaaucaauaucaugaaaauggccauauugcccaagguaauuuauagauucaaugccauccccaucaagcaaccaaugacuuucuucacagaauuggaaaaaacuacuuuaaaguucauauggaaccaaaaagagcccacauuggcaagucaauccuaagccaaaagaacaaagcuggaggcaucaugcuaccugacuucaaacuauacuacaaggcuacaguaaccaaaacagcaugguacugguaccaaaacagagauauagaccaagggaacaaaacagaguccucagaaauaauaccacacaucuacaacuaucugaucuuugacaaaccugacaaaaacaagaaauggggaaaggauucccuauuuaacaaaacugacuagccauauguagaaagcugaaacuggaucccuuccuuacaccuuauacaaaaaugaauucaagauggauuaaagacuuaaauguuagaccuaaaaccauaaaagccuuagaagaaaaccuaggcaauaccauucaggacauaggcaugggcaaggacuucaugucuaaaacaccaaaagcaauggcaacaaagccaaaauugacaaaugggaucuaauuaaacuaaagagcuucugcacaaaaaagaaacuaccaucagagugaacuggcaaccuacacaaugggagaaaauuuuugcaauccacucaucugacaaaggguuaauauccagaaucuacaaagaacucaaacaaauuuacaagaaaacaacaaacaaccccaucaacaagugggcgaaggauaugaacagacacuucucaaaagaagacauuuaugcagccaagaugaugaaaaaaugcucaucaucacuggccaucagagaaaugcaaaucaaaaccacaaugagauaccaucucacaccaguuagaaugguggucauuaaaaagucaggaaacagcaggugcuggagaagauguggagaaauaggaacacuuuuacacuguuggugggacuguaaacugguucaaccauuguggaagucaguguggcgauuccucagggaucuagaacuagaaauaccauuugacccagccaucccauuacuggguauauacccaaaggauuauaaaucaugcugcuauaaagacacaugcacauguauguuuauuguggcacuauucacaauagcaaagacuuggaaccaacccaaauguccaacaaugauagacuggauuaagaaaauguggcacauauacaccauggaauacuaugcagccauaaaaaggaugaguucauguccuuuguagggacauggaugaagcugcaaaccaucauucugagcaaacuaucgcaaugacagaaaaccaaacaccacauauucucauuuauaggugggaauugaacaaugagaacacuuggacacaggaaggggaacaucacacacuggggccugucauggggguggugggggggggagggauagcauuaggagauauaccuaauguaaaugaccaguuaacgggugcagcacaccaacauggcacauguauacauauguaacaaaccugcucacugugcacauguacacuagaacuuaaaguauaauaauaaaaaaaaagaaaccaauuucuuugcucaucuggaagaagcaacaucucauccauuaaaguuuuaucaugaaauuacagcaauucagucacaccuucaggcucaaaauuuaauucuacuucuccuguuauuucuaccacaucugcaguuacuuccaccacuggagucuugaaccccucgaagucauccauaaggguuggaaucaacuucuucuaaacuccuguuaauguuaaccuuuugacucccucucauuaaucacaaaugcucuuaaugacaucuaaaaugguggguccuuuccaguaguuucaaaauuuauuuugcccagaccuacuagagaaaucacucuguuuggcagcucuagcccuaugaauuguauuucuuaaauaauaagauuugaaagucaggauuacuccuugauucacaggcuucagaauagacguuguguuagcaugcaugaaaacaacauuaaucuucuuguauaucuccaucagagcucuugggugaugaggugcaaggucaaugaacacuaacaguuugaaagaaaucuuuuuuuuuucuauguaugucucaauagugggcuuaaaauauuuaguaagccaugcauaaacagaugugcugucuuccgggcuuuguuauuccauuucuaggggacaggcagaguagagauaguagaacucuuaagagucucaggauuuucagaacaguaagugaauauuggcuucaacuucaaguaaccuaacaaggucuguccuuugaaguccugaagccagacauccacuuuuucuuucuagcuauagaaguccuagauggcaucuucuuccaauagaaagauguuucaucuagauugaaacucuguuguuuaguauagcugccuucaucaauuacguuagcuagaccuucuagauaacuuguugcagcuucuacaucagcauuugcuguuucaccuugcacuuucacguuauagagaaggcuucuuuccuuaaaucucaugaaccaacucugcuagcuucaaauuuuucuucugcagcuuucucacuucucugagccuucacagaguugaagagaguuagggccuugcucuggaauaggcuguggcuuaagggaauguugugguugguucuaugcagaccaucaaaacuuucuccauaucagcaauaaagcuguuucacuuuucuaucguucauguuuucacuggaguagcacuuucaauguccuuaagaacuuuuucuuugcauucacaccuuggcuguuugguauaagagauauaguuuugggccuaucuuugcuuuugacaugccuucuucacuaagcuuaaugauuucuagcuuuugauuuaaagugacagaugugugacucuuuuuuucacuugaacacuuagaggccgcuguacugucauuaacuggccuaaguucaguauugugucuuugggaauagggggucuugaggagagggagagaugggguaauggcuggucgguggagcaguuagaacacacagaacauuuauugauuaaauucauugucuuguacgggcagaguucaugguuccccaaaacaauuauaauaguauuaucaaaggucacugaucacaaaucaccauaacagauauaauaauaaugagaaauuuugaauuguugggagaauuaucaaaaugugacacugagguaugaagugagcaaaugcugcaagaaaauggcgccaauaggguuggcuuaaaacaggguugucacaaaccuucaauuugugaaaagugcaguaucugcgaagcucaauaaagcaaaacccaauaaaacaauuaugccugugauuggauuuuaucugcccuucugaaaggaccguaauuguucaagaucuuggaacauuugacauaagcccacuucuuuggaaauccuuuaccucaaaagaucuucuguggacagauugaagauaaaugaucagaugugcuaacucauuagccuaaauacuaaaaguguguuccuguuugcucaaugaagucaacuuccaucuucauagccauagauauuaauuguuggcuauagcuauaauuccuccuuucuuauucacucccuuauuuuuuaauucauugacuacuuaaauccaguggagauccuucaaaauaaaauugaaagaggaauuccauuugcagcauacaaggaaaaucucuauauccucacuggucuuuuuucucucaucuuuuccuaguaaaagucauguucuauaauggugccagaaucaucccuucaacaccuaaaucugaccauauuguccaccauuuaaaaacauucagugguuuucuacugccugaaguacaaccugcuucacaaagagcagcaccuaugauuuucuacaauccaucuucucuauuacccucacugcuccucauguuguaagcuuccaugucucacacagcaugcucagcaauuacaaaauccugugguccacacaguuuuucuuuuucuuuuuuguacacucugauguauuuuuuuugccucaaagcaaauaccuuuuuaccuaauucuaugaauuaggagccuuuucuugugcuauaauuguucccuauccucaucuuugccauugauccaucuaguaguuucacaacucugugugugugugugugugugcgugugugugugcgugugugugcauguuuucuuauuagagcgggaggcccuuaaaguuagagauaugaugauuuauucaccuuuagacuucuaacaucuaguuaaaggccggacacauaguaggugcucaauaaaugucuggacaccugaggugagauaaggcuaaauuacuuccuuuaauacgcauucuuccucccgggugcaguggcuuacaacugucaucccagcacuuugggaggcugaggcaggaggaucacuugagcucuggaguucaagaucagccuguacaacauagugagaccucaucucuacaaaaaaugaacaaaauaagccagauaugguaguguguaucuguaguccuagcaauagggcaagacccugucucaaaaaauauauaaauauauauuuauauauuauauacauuauacauaauauauauuauacauauaauuuuccuuucauccuuguuuacuuaaauuugauuuguucuuuuucuauuuccuguuuagcauuuuuccacccauucaaugcuuugccaauuuuaugaacacuugguauaaaaaccagauuuaaguaauugauuaggauaggacaauucauuuuuccuuggcucuaggcccauaauaucaguugcaauagaaaacuaaaagaaaucacuuuguuuccugaaagguucccaagugaaugaguccaaucaauuuucuucuccagaagucuuaauguaaucaaacuugcagaaggaaauugauuagauauuauuaucgcauacauugcccacugaguuccccaguccuucaucccuuugcuuuuauuaaucaugcaauaaaggggcuaacuagaaacaugaaaaaagauguauuaucagacucacaaauuucacaaugaaagaaacuugcaagguguguuauggcaucauuuuagggcuacucugauccccauuugauauuucugggcgcuaaauggacacugguaaccaagaggagaaaauagguuucaguuuuucucuucacaacuuuaagaauucaguuuaaaaauccucuuuuuccaaaauaauauaugacacacauuuccuugcuaguuccaucagaguggucaguagccugacaacuuccgaacuucgcuucaccugagaaacagaauuagaguuauuuauuuaccauuaugacugucagaaaacuugaauguaaaaauucugcuaacacuuuuguuuuacuaagcugaaagaauugaucacacacacacacacacacacacauuguguguguauacauauauaaaguaguauucaucauuguuaucugaaaagucgucuauggcaauuuucucacuggauugaguagaauauggcucuaaugaggcaaaagacauggauggcgagcccaaaacaaucugaugcuuuacacaagaauaagauuuguggucucauuuguaccacuaggugcaccaaaauacauaacaagaugcacauugaugaccauagggguggcuagugagauggagauguucaucucacuggaucaaugcaaucuaccaccaauauuagaaaaugucauuucagacaguucucugcuuccuauccaagucccucauacucccauuaugcaaucucagaaauaauguugauuuauuugguaggggaagaaaacuccagugcagugagcgcaggaaaaaaaaaaaaaaagcaggcuuuggaaacaggcuuguuuccaguccuagcuaugaugcugcuuagugaugagaaucuggacauguuacuaaaaugcuacgagcugcuuccucaccuguaaaauaagugucauaauuucuaccucaguguuuuugagaaugcuguuaaauaaaauaugaugggauauauaaaguacuuacuacagucccuacuacauaauaaaauuauuagcaaauguuuucuccuccucacuaauggaaggcagaaacaguaagauaauuaaaugugaugaauuggaauaaucagauaaaaauuauacaacugauaguuaacucauuagauuaaaagauuaaggauuggaauuaacauggccagggugagguuagucuuacguagagaaagcagguuagaaucucuuuaccugguaccuaaacuaggucucauauucuacucucagaaagguaucagguuguugauuuaaaccgaccaguaacacacauuuauguaauaccuacuaagugcccaguguacuggacauugggaagacagagaugaaagguccaguuccuaccuacacaccaaucuacugggguucagguagguuggggaggcacucaggaugcuaucugucuucuuuugucauuuuuccagcuuuauugaggucuaauugguauacuaaaaacugcacauaauuaauguauacaauuuuguugagguuggacauauauauauauauacacacauauacauauacgcauauguaugucuacacacuagcauuacuguaacagugaaacagcaaaaaaacuaauauaauuaacuucauuuugguuuaacccauuucccauuuagaaacagaaacuacagcucaccaccagugcucauuuaauuauaauauaaacaugcucuuugaggcugaagcaagucugaccgauuuucaaugugaaaauaaaauauaaaaacuguugaaguuauuucuaaauagaacuugucucuaauccuaauguaacagaaauguaugugauguuacauuaaaucauguauuuaguuguaaaucagauuuacaacuaaaucugggauuaaagggggaaguauguaaacaacucuguuuuguuaaggauuuauaggagcauugugaccugacccaggacaaagacguucucaaccuucucggacccuugcugcugcccagaugucugcaguuauuggucagcucuugaucuagauuccccuucucuucccccugcccuuaacauaaagacagccuaacaccugugcugacuuaagauggucuuugaggcuauaguccacccucuuugcgguguacuggcucuauggauaaaccucauuuuccuccuaccaacccucgucugucaugucuggcuuuuaaguagcaaguggccaguccuggguucaguuacauuaucauccccacaaccuggguaauaaacguauccacaccgccaaaagucuucuuguguccucuuugugugugugugugacaaggauacuuaacacaagaucucucucaauaaauuuuuaaguauauaauacuuuacuguucacuauagguaucacguuguacaggagaucucuggaacuuauucaucuugaauaaauuuauauuuauugaguaacagcucucguuaucccccugauuccaugcccuuccaccauucuauucucuaucgccauacuguugauuauuuuagaugccuuuuuauacgagaaaucaugcaguauuugcugauauuaccuaucuccuguuguuuucuuguuaaaaagaaaacaucccuugugagggauaauauacaaagcuuucaccagucaggaagaauauagcuuucacacagucagaaacugaaaaagacuaaaagccaccuccuccuaguuccucacuugacagaggggagaaaagaggccuauagcagcucugugaucuuuucaagcuccuaaaacugguuugugguagaagcagagugggaauacaggaagucucguguuggguucacaacuuuaggcuacugguucaauggaaaccucggaccuuuacccgaaaagcaauuuaaaguacaugcccuguuugggguggcucuugccuugggggaaaucacguucacaguugacaccagauccagccuucuuccucccuuguucaaauuucagagccaaaguuacagcugcaguuggacuccagagaggaggagagagagugggggacacucaucuuucuugcgagcuucccacuaauaaugauauauucuccuugcucccugcccaaggcagggcuuuaauauaaaaacgcagaagcaucuuuugaucauaaacaauuucugaagcauuaagaagaaaagauuguuuuaagaacugcauuuaaaacaucuaugcuucuuaucuuuguuuccuuaaaggaaaauaacauuaauuccuccaaauaaaugaucaguucuuaauggcuucuuuggcuugaauuuuagugcaauugcuuuauuugagauccuauuaaacaauggguuuaaauucucaaaagauuucuuuuuuuuaaguacaaaauggauaauaauucuccaaaaucugaauauuuugcacuauacccaucucuagauuuuuaccauggaguagaaaaaaaggaaagguuaugaguguccuuucuuuuugcuggagugggagagucuuggaaguaccaaaucuguagggacuacaauccaacaccauguuuuucugcugcuuuucugcugaucugagaaggggaaagacaagacagaauggccgucccuuugacuucaucaacccuguuucuaagggucuaggguugcuugugaaacaagcaacuuaguguaaaaagcacuuagucauucauuccagucauccaauuauauuugcuucugacauuuaaccuuuucaacaacucacaguaguggcaucuaguuugacaguuuucuguuuauuccacuuugcuuccugcaauacuguuuugaagcucuauuauccuuaaaaggugagcaagacuauacuucugaauucuagcuuccgcaguguaauauaggaaggagaaauuaccugcagcguauuauccagaaggguuagggauuaauuuaaagcucagauuaucauauguauuaugcacaaaucauagagcauuccuacuguagcuuccagggaacaaguauuuuucaaucccacugaagcucucuggagagaggguuuaaacaacaacaccucaacaggaauugaaucuagcugucacuuaaagaggcuguuuggauugguuuucaauggccaaauaggcaaaacuaggauaugagauuauaaaacagacccugcaacugugaggcuugaggauacuuuccuuuaacaaucagcuguuugcaccaucuaccucaauuuaccagaucacaguuuaacacucauuucauuuaauuccggcucaggauucuaauaauuccucuaggacucuauggaaaccuuggagaagaaagccuguauuguacaaauagcuagaaugaguuuaugagcaucagauugguguaugcagccucugaacuagugccugauacauuuuuagguuuauuacauguuugguaggccuucuuuugggaaauuuuuugaacguaauaaacuagaugauuucuaagacugugguauggaaaauguuauagccucauuauuauuauuaugaugauuaccaguaaugcuuuuaaagauuuugaaauacaucaggagugcuaugaagaaaugaaaguguaggacaagcaguagaugaaaugagaaaaaauacacugugcagaucacagagagaaccaaaaagcauucuguggagguggcagaagccuugaaacuauacaaagaauuccuaaaagagaggauucuaaaaguguuuaccacaaagaaauaauaaauauuugaggucacggguuugcuaaauacccugacuugaucguuaggcaaugcauauguguacugaaacaucacauuguaccccauaaauauguauaauuauugugugucaauuaaaaggaaguccugaguagcgaagacugaaugaggugaagugaguuggaccaaaaugcuugugauaugaaaagcuggcaauauuugaaagaugguuacuauuagcaacagggacagaugcagacugaucuuuuuuucacguauaagcagaguuuugcaacuagaguucuaaaaaaaaaaagacaaagucuaucauuacagggccaaaaagucuaucagucugcaaagagaucacacgccuuuccuuaccaaugucccgaugaagaugaacuuaauaguacugaaugucaaugacaaaagcauagcugugcuugucugagucuuauuuccauuuuuauuaaauuuuuucuuuuccccaaaccucugaauuucuuuaguucuguccuuauuucauugcaguucugguucuuugaaucaauauuaauuuggcugucuggguccuacuacacaugccauuuuucaucccccuuuccuguuuccugacuguaauauucugacauacguguucacaguugaauuucauugaucagguuuacuuugaaauaucuucaacuuaaauaaaaaugcaagaauuuuuuuuuucauggaguagaggagagagaacuuuaucaguagcaggagaguuggcauuuagugccagccacuugcugacuguggaaaguuugagaagucacuucauuucucaagcccuaaguuuccuuuaucugcaaaauggagguguuagagcugacaaucuugaaggucucucuagagcuagaaaucuuacuuuuugagauaagaaucaacaucaaucagucagugugauaugaggaaagugaaagucaacuaucuauagcauuguucagagaauaccagaauuuuagacuugcagaagaucuuacagugauucuagcuucccuuuauuuugacauuugaggaaacugauacccagagagaugaaaugaccugugacacaacuacacaguagcagguguugcaguuuaauuuacuacauauuugcaaauagugcuccgagcuuugggagacuuuaaagguuuaagcaauaacauuacuugagaaagcucauaauugugucauuaggggucuggagguacuaaaaggcagaguuggaauaggucucucauaacagugccauauaaacuucauaaaucuggaagagaagucauugaaacugacaaaacacaaaauggauaaucacagaagaaaauauauuucccuucauaugcuuguuggcaaaauuaggugaagggcugugcaaacugccggauacacuaugaccuuccuguaacuguggucgaaccccagaaauaucauacuuugauaagaguuuuaaaaaauccaugugccuuuuaaggaauuaucaucuacauaaaucuccucacaaguaaaccacgcucaacaaugauuuaugcaaugucuugcugaugacauuuuaagugcugcugaaagagcauauugugguuaauuuaaaauguaauuaauguaagauuaauugugaucucagaaacuggaacauguuacugacaaauaaaauuagaagagugggacugcaugaaauccacaaagagaagggauuggucuguauuucucccacacuguccaugaggaaagggcacgcugaugguuuggggcuagccccaguucuuuagauagaaacagcuaaaaguggaaaagacaauuccucaaaagguuugguaccucuguuuucauucuccuuaaacuguauggcguuuuggguuauaacugaacagacuugcugaucagaagggcaugccccauccaggacuaagaugucugguauaauuuccaguguuuaguaauaaacugaaacgcugguaaacaauugccuaugaaguuagaaguccguguuucagaacuugacugaugcuuggaaaugauggagguauauagauuacagcaguugagaguagguaacucuugaaccaguguuccugucaaaaugcagccaauuuaauagggcacuaugagcauuuauuuuaauuaauaccugaauuucauacuuaauuuccuguuuuccuccaggauucaauggggcaaaggagccaggaagguuuaauuuaaagagaaacugauuuauuuuuuagaugacagaaauauguaaagggaacuccuggaagaaauggcacaacguuaagguaaauuuuaauggaaugaaaaagaguaaugcuccuuauaagucuuguuuccaugggacuaaaugucagccuggaggacacaggaaagccugagauacuagagcaaaggggagugaaaaggcauacaccacaaaugccacccuuuuucugaaccugacauugcuuagauuuauagaagucucaguaauuuuuuguuuacuugagacuaaaguuaacaggguuaaaaagugauugaaaacugcaaacccauaacauauauauucugauuuugucaaccaaguccaaaaccaaaaacaaacaagacaaauaaacaaacauacuguaacauuacuacucaaguggaaauauacaggaaaacccaaaacccaagcccaaaccccaaacaauaacaacaacaacaacaacauagaaaccagcacugauuuuaguaccaacucaauuacagauuagguaugccugcccaccuaauucccuaggauucuauuucagguaagacacuaugucuuagguguauuuuguuuaccagacaguaucucacagaaugcugagcauagacaaggcacugcauaaauacuuguugaauuaauguguuaauuaauuaauucaacauauuugggaauugaugggguuugucaucaugaccaagccaccaagccacccuauaacucacaggcugugggcuagaacuugguauccugaugaaaaccauaaagaccuugauacccaggguauuagucuuuuuuucauacugcuauaaauaacugccugacacugauaauuuauaaaggaaagagguuuaacuaacucacaguucagcauggcuggggaggccucaucauggcagaaggugaaagggaagcgagguacuuucuucgcaaggcggcaggaaggagaagugccuagugaaguggggagggccccuuauaaaaccaucggaucuccugagaacuuacuaucgugagaacagcaugggggaaacuguccccaugauucaauuaccuccaccuggucucuuccuucacacguggggauuacgggguuacaauucaagaugagauuuguguggggacacaaagccuaaccauaucacucagcauuaaacuuuugaaaggauaaacuuuguaacuuggcacauccaugaaucaaaauguccuguuuuuguuuaacgugaucccacacuugagggcuauuagcuuguuuggugauccucaacacaacagaaagaaaggaaaugggaaugcuguacauauuacauuaaccuucagagucugcuauuugcuuuugaggaauuauuuuuagaacagcuuaucucccacagacauaacaguaugucuagugggcaugcuuauacaguuuguauaccauaaaugcucuuuuuccucucuuuucuucuuuucuuagaaugaaauuaagagucauuagcauacaggucaguuuagacaaaaggaacaugugugucacuucgcuuugggaaaauuggaauuuauaaaacgugaaucuuggggaagagugaaaauagucauugaguauaagaaaaaaacagaaagagaagaauaugagugaagaucaggugaugaacacacagaauacaggagugccugucuuaauuaaaauguacaagguggguguguuacaaggcgggaacauauuaacuuugaugugaaugaugggaauagagaaaguaggaaaucuucaaucacaguagugguaaaggacauggaaaauaaaaccuugucuguugaaggaaauauaaagagguggaugcuucaauuacagaggagguaauggaagugaaaaaagagagaaaggcaaaagucacagugcggguggcuacaagaggaaugcugggaaauuacagcaugguuaaguauuuuacucuuguuuuuaauauuauucaaauauuaaauagcuuagacuuaguucccuaguuguguugaaauuucauaccccuaccuagugagauaauuuaagauuuuaagugacaguuucagccaaacaguuacgcuguuuaccaguguaaaacauuuuaauuugcuccggugguugcuguuguuauuauuguauuuaugaccacuggcaguuaggugaaucauuuagagacaaugaggucuguguacagaagcuggcagauucacucaaauucugccagauuguuauguaagaauauaauuaauaaaaauaccagccagauuagaauaauuuuuauucuaguggcaggauucccuuuaauuuguucaaucagucauugguuuuuggagcuaugucuaccagagagaaguagauugagcaguuguaucgaaugugagagagagagaaaaaacauuccuuccugggcuuguuugcaguuggaguagagaucuguggguggggcauuuggcagugcuuagguacccagcuucugcaacaaacugaccacugcaauuccuuuggagagcuaaaaguucaaugaaggaggcaagagcacccauuaguauuugcaaaggugaaauaauaaccucuuuaacuaucccuuuuaauaacauuuugcugcaagacaaucacaaaauauuagcaucucuuuaugcccauuauuccuuauuuucuuccuaagaacucccuguuaacagaguuuuucauagauuguuuuuucuuugaaaauccuuaaaggacaguuauuaaaaaguguuuaugucucagugcaauaguaauacuaaagcucuugagauauagagcacuauuauuguguacuggaaacuuacauguguuaacaagcauauguguauguaauuagauuaagccauuauuacauugggcucaggaagugcugcucugcaauauaaacuuagcagucauauuuguaaauggcuaugugguauguuuuuuaguaauuacuuuuuauaggaaccaacagugagcaacccucaucauucucuauccauuuacaugguacccaggauacaaaacugagaaaaugccauuugcauaacaagaagagucagcaaaacaggucuuaccaaaaaugaucucaaauccugcuuuuugaacuugcuaugucuaaugacuuaacucucuaaagacugaaauauauuuuguuuuguaagagguucacuuuaaaaaguacuagugauucuuaugcaaaaacuggaaauauuaauaaauuaauaauauuauagagucaguuaaaaccaggcagaauacauauuuuccaacaacaucaugcauuucaucacaaguuaauuaagaaacugaucauuucccuuaagaguguuuccauguauaaaaauagcuacaguuacauuaauugccuguguaguacgugcucauacaaaugacuaugaaagcuggaguuuaguaauguucuguguagcuuuuuacccuaccuauaccuauauaugaaagguauuugaggcagcauuccauggcuaauacaacugugcuuccacggucaaaguaaaauaaauaaauuaacuuggcuaggcacauuuaauuacaauuaaucaugcugacguuaacauucauacaucagauacuauaucaagcaauaugauuacaaagaugacuaugaauuuauccuugauuucaaggaguuauuuaguuacaagggacaugaguacaauuagauauaauaaaguauauaauugguacuauuauaguaauaugagugaauucagaaaaaaaaaacagaggaaauuaggcuauuugcgcuaccuuuacauugcuauguauuuauguauuugagacggguuuucacucuguugcccaggcuggagugcaguggcaccaucauaacucacuaugaacuccuggacucaagcaccccucccaccuccgccucuugagcagcuaaaacuauaagcaugugccccgcccugcccaugucuggcuguuugcuuuuuuaaauucuccucaaaauuuuuuucaucaauaguaugaaaguauauuuuaacauuaagacucuccagugagacccuggaguuacuuccaggauaaauauucugugauuugauauuaacuuaaguugcaguguaaguucuauaacucaccguaaauucuaaauuggaagaaauaaaaccccaagguggagcauuagcuauggagucagauacagaucugccauuuuacucugcuauuucccuccucugaaucugguucccauuuccaugaaaugggauacugccuaacucaaagucaaauuagaaaauauauaugaaauuaggugaggauacugcugguaaauugagcauuucucugccacuuuucaaccaggccuaauuauuaguguuggccguguuaagucuuacaaugcugcgccucgggaauuagugugugccuucugcagaucugaugggcagcaaaucagagugaaccuccccaggccuguagucacugcagcuuucaguguuuuaaaaauacgacauuucauuuaaaucauaguuacucagccuuuuaaauaccagccauaggaccuaaaggaaaggugauugacucuccuuuuuuuuucuuuagaaauagaaaggccuacuucacccagauuuuggugauaagcuccaagaauuccacugauauuguugucaaaauauuuuggaaacauaccaagaagauuguuauguauuugccaagcauguagcucccaaucuacuugcuuuauuagagaagggaaagguaucaauguaaaguucaccucaagcugagcaccggguuaguuuugcugugguaauaaagcauauaaauacuacuuugauaucuaaaaaauuguguaacacacuguccaacucaugauccuagcaauacugauacagaauguagaaagaaauuauuucggcagauagugagggcaacagaguccucggcagaacuucccuucuaacaaaaagcagcccaagaaauuauucuuuuccugacaaacagcagccugaaaaaucgagcugcaaacauagauaaggaagcuggaagcuugcacgggggaugccgguagcugcgucaauagaaaagggcuaccugggggccaggcauguccaccauggaagcuccaucuucccuuuuugguuagcacauguacagaaagaaagaaauuggcaacauggcucagcucaggcagagaacucgccugcauaauaaaagcuuagggugggagcugccagaaauuugcgcccuaugccaauggcacacuuaguccuaaccaguuuuuuugugcccuauguagaucagacucugccucaccaccagcucaccuauaaagccccuggcauuucacuguggacuggcaacccauuuuuccagaaccguucucuguagcagagaccuauuaucuuucuuucgcuuauuaaacguucacuguuaaccucacucugugugucugcauccucgauaucugugacauaagacaacaaaccuuggguauuaccccagaaaacaagguaacuucaacauggcauuuacaaacuuuguaaaaaggacagccaaguaguagguggauacaugcuauauuauguuacuuaaacugaguuucaguuuccugauccauauuuaaccagaguaagaacuggcucucuugugaccaguguugguacaaguugcaucucacagaaauaaaaaccuaauuauacccaauuaguuuucuuaaauagagcaaaagcaaucugauggaggaagaaaagucuucaauaaaugacgaugcaaugauuuauaggcaaauagcuaacuagcuaaauaaaaaugaaccuugaucuaaaccuugcaccuuauacaaaaaucaacuaaaaauggaccauagauguaagugcgcagcuuacaaaacuauaaaaugucuagaaaaagaaauaggagaaaaucuucaagauacaggacaaggaaagaguucuuagacuuaacaccaaaaaucauagaugauuaaaagaaaaguugauaaauuggaccucaucaaaauaaaaaaaaaguauucuguaaaagagccuguuaagggugaaaagacaaauugcagacugggagaaaauauuugcaaaucaucuaucucacacaguacuaguaucuagaacauauaaauaauucucaauuucaauacuaaaaaaaccccauaaaauuagaaaaugggcaaaagacaugaaauuagaaaauggacaaaagacguguauacaaagagacuauacagauggcagauuagcccaugacaacucucuuggcaucauuagucaucagagaaauuaaaauggaaaccacaacaaaauauuacuacacaccuaucagaaugacuaggauaaaaauagugauaacaucaaaugcuggcaaggauguggauaagcggaaucacucauacauuccugaugggaaucuaaaauaguacagucacucuguaaaauaguuugauaguuucuuuuaaaauaaaaauaaaaauggacuuacuaugugauccaggaauuauacauguggacauuuguccuagauaaaggaagacuuaauuucaugcagaaauugauaaaccaagguuuauagcaguuuuauuaauaguccaaaacauaaacuacucaaaucuucuuuaaugugugaacaauuaaucaaacugugguauaugcauaucagggaauacuacucaggaagaaaaaggaagaacuugauacacacaacaucuugcgugaaccucaaaaaaauuugcugggugaaaaaaaucuuaaaagaauacauacuucauacuuuuauaaauauagcauuugugaaauaacaucauuauagauauggagaaaacaauuaaugguuuccagggguaagggaugaggguguagauuccgcuguaaauaaguagcacaaugaagaaugaagucuucugguaaugguacaguuaaauaucuugauuagugguuacacauaucuacacauuuaauaaacugcauaaaacuacauauacauacacaugaguacacacacacgugcacaaguaaggguguguauaacuguugaaauauuaauaagcucuauggcuuauacuaguaucaauauaaaaaaauccaauuccuuuucccuaaaaaccuuguuuuaaucuuauucacucaaaaaaacuccaaaaagagaauauuucauaauuagcauacuaaacacucucuucaucccucuaaccccucagucuucuucacaauucuugcucccucuugucuuuuuuuuuugaacaaaaacugaaacaaaaacaaacacacaaacaaagaaccucuuucucucucuucuaccuccacaacuauacuucccuugccucucccaaguacuuuucccuuucuuccucauggccccacuaaccucuaaauuaucucuuuaucauguggaucauuucagccuguuuuggauuauuuaaauuuaccucuucacucauccuuagcaguaguauaaaaaccuuccagaaccugaacaagcaaacccaaaauuccuggggaaagagaaggauuuggagagucacaagucagcacuguuugucccuuuuccuuaucaaaugggaacaauaccacccagcacauucauaggguucuuauguguauuaauaagaugccauauauaaagcacuuacuacagcgcuuggcauacaguagguacucaauaaaugguaacagcuaguaaugggaugcaaauggcaugcaaaagagaguaguauuaaugaucugcaauuuaacaaucugcaaauauucguuaagcaucuaauacauuguuaguacuuugcuaguacuaugaaauaaccaaaaaauauagaacauaaaggagcacuuaaaagaugcucaauaucauuagucauuagggaaaugcuaauuaaaaccauuaugugauaccacuauacaccuauuagaaugacuaagaugcugagcaacuggaucugucauucauugcuggucuaaaaacaaaacgcuacaccaccauagaaaacaguuuagcaguuucucaucaauuuaaacauucacuuaccauacaauccagcaaucccacucccaggcauuuuuccaagugaaaugaaaacguauguucaaacaaaaaucugugugagaauguuuauaguggcuuuauggucccacauuggaaauuacccaaacguucuccaaccgguaaauguauaaacaugcuagguguauccauacaaugaauuauuacccaaaauacaaaggaauguacuacugauacauaaaacaugaaugaucacaaaugcauuaugcuaaguaaaaggaucuagacacacaggccuauauacugcaugguuucauagauggaaaacuauagaggcaggaaauggaucagguuaucaguggcugcaggugggagagguuugacuacaaagucacaaggaaaauauuuaggguguucgaacuguucuaucccuuaauuguaguggugauuauacaacugcaugcauuucuuagaacucauagaaauguacacugaaaagggugaauuuuauuacaugcaaauuucacuucaauuaaaaaaacacaaaagaaaaaaaugggaugcagccucaaaguaaauaacacagaucuugccaccguguucuuaggagaugagauuaaaauacacagauuagagaaucacguguacuagcauguaauugguugcggaauuaugagguuuagggaucguuauaaaugaaauuuaaagaaaucacugacuaaugugggcagaggaaagauugggcuuuaccaucaaaugucaaaagggugggcagagaggacugacaggggauuuuuaaaaauuuuuuuauuauuauacuuuaaguuuuaggguacaugugcacaacgugcagguugguuacauauguauacaugugccauguuggugugcugcacccguuaacuggucauuuacauuagguauaucuccuaaugcuaucccucccuccucccaccaccccaugacaggccccggugugugauguuccccuuccuguguccaaguguucuuauuguucaauucccaccuaugagugagaacaugcgguguuugguuuuuuguccuugcgauaguuugcucagaaugaugguuuccagcuucauccauguucuacaaaggacaugaacucauccuuuuuauggcugcgugguauuccacgguguauaugugccacguuugcuuaauccagucuaucauugaugggcauuuggauugguuccaagucuuugcuauugugaauagugccgcaauaaacauacaugugcaugugucuuuacagcaguaugauuuauaauccuuucgguauauguccagucaugggauggcugggucaaaugguauuucuaguucuaccuccuugaggaauugccacacugucuuccacaaugguugaaccaguuuacagucccaccaacaguguaaaaguguuccuauuucuccacauccucuccagcaccuguuguuuccugacuuuuuaaugaccgccauucuaacuggugugagaugguaucucauugugguuuugauuugcauuucucugauggccagcgaugaugagcauuuuuuucaugugucugacagggcauuuuugccugaaggaacgugaguaagaaacguggagcaagaaugaagagucuuaccuaccugaaggauagcauuuguauugagaguaaugagaaauugauuugagaaagaggauagagccagauuguggaggaucuuaauuuucaaauacagccuaugauaagauuacagucuuuuuauaacacuauuauaauaaguucuugaauggagaguuaccauaaaaaagcaguauuuucacuugauuauucugaaguaguguccccagcauacagggaaagaagccauggucccacacaacagaagagagaagucaguacaguauuuauguugcagaacuuuguggcuuuugaauugacaucuuagcugauugucuuaauaauagacauccuguguuaaaaauggaaucuuugaguguuuagcaagagggaagcacagcugccucuagccguuuauuuccauagcuucuggucaugagacauuuuguauagaaauggcugcucuggcagcuguuuucuuuuaggucuguggggacugcagcugucuggauugccacaugcucccaucguuccugaccuccuaaauaaugaacacuuggaaauccuauagagcagugcuuuucugcuccagaguucaaauacauuuugacccuugcauaaagccauugaaggaaggucaucccuucguacauugggagcuucgaugugaguacagcagaguccaauuuuagauccuuacuuugguaaccaucuguacucauguaugcaugagcucucucuucuauggucuuagcuuauggucuuuauguagaaagauguuguaguuaagugacuaaagcucaggaauuuggguuucuuuucaaauucaguauaagacuccggagaauauauucauuauccauugcuaaauuccacucagaauccuuacagggacuaagcagucuuaauuguaaguuagguuacuauuuaaauacccuauagcuauucaaaguaaggcuaccaagaucaacauucacagcacauugaugucaaaguagguguauuccugagacuuccggaaaucucuuaauuaauccugggaugugcuguauuacgagaaugucaaaugucuugcugaguagcaaauagaugaacccuacaacagcuucgaguaacaaugaggcuaauaucaaaugcccuucaucugagaguccuagaggccuuuacaaauggcauaacauuaaucugaacaucacucuagagaagcaucaaauuaauuuccacuucagaaauggaaccccugagaaagaagcauguccacaaccacaguuaaaccuacuuuuuagcauaccaguucuuauaagccaucuguucugauggcuaauuugaggcccugggguaaaagacagcaugaagauaucaaaguggaaaacucaccauauucauucaacauuuuuagagcacauuuauauaugaagucaaauaauauaggauuauaguucuaaaagagcaacauuuagggaacgguauagucaauguuaugauaaaaguauaaaagagauccaauggaaauaaaugcauuagggaaaaagagucaaauuaggagaucacaaaagaguuuacauaggaaguaaugcuuaagcugagguuugaaggcuuguagaaguugucuuuaagcagaaggcaaaaaagaaaggauucuugaaaagauaaauagcauauaugaagcaugaagcauuauaacugguuauagcuagaguaaauagucugugaggcuguguuucaggaguggugauggugggaaacagaggauaaauuaugaugggauuuaugugcuaagcuaagaagcuuaaaaugcauccaaaauguuagcuauggggauaguugaauggucagugcacauauuccuaggagaucuauuucuccaucaacauuaugauaccaauaaagaguuguaaauguaauuuacaggaacuccaacaugcagaaacaauaccuccucacaaauucuauuuaaaauucauguguguuuuguaggaugccagcugguuaucuugcacaggagaaaaagaaaacaaaguugguguacaauuuuguacacuguacaaacugguguacaacuguagccuaucucugccauggaguuuggccaaaagacagaucuuuugggcaucuuaugacaagcaaaaggcaaaagauuucaaagacacauaaacauaauuuaguaacuaguuggacauaaaggagcaaaagaaaaaaauaagcaacuaaaauuuugauuguacacugggcuuucugggcauuacacugauuuguaaagauaauaagaaaauaagaaagauuacuuaugugcuaaagaugaauaauucaucccaaaauauaaucuguuggagauggcaaucagacaucaaguagaaagaguucucaguaccuagacagguuugucucugaacaucaucuauuuucuagggacucuaaccuugaaaacaaggcugcucgguauguaucaaacgcccaguccagaggaacaguguuuauagaggacuacuagaaaguuagaugagguguccuuucuucuagaauaaacccaaucuaagugcuauuucucauauuuucuucccaagcuguugccuuccuuaugucacguccaugaaauuugagacuucauguaucagcaucuuuacaaaaagagcucugugaaauucauuuuugcauuacuguaaggacauugugcaaguuggguugucugggaaacagaugcugagauggaguuaggauugcaagaguuuuauuggaaguaaaaccaauuaaagaaaaaaguaagaugcgggauugggcauaggaagcugacagaucucagugcagaucuaaaauucuuuaccagcucaaaggggaguucuggaguaaagauaaccugauggagaaguccuguaggggauguugaugaccuggcccuuguaccaucauucugcucggccauugccuggagaucacugagagaagagcguaaccuugguuugaaaacugagacagauccugaaggaucuaacagcuggaggcaucagcugaccacaucccucucagcuaugcggugggucguuuuuugaacgaggaucugaacagugcaucucugugucuggaucauauuacaaaaugggcuguauggaguucuuagcuugggccuuaucuaauuccauccaaaaguagaaaaaaucauguauuaacugcauggcagagggguugcaagguggcugacuagaggcaucugcuacgugucucuuacacagagaagaacaaaaacagugaauagaugaucacacuuugaauagaucauuuaugaaagaacauuagaauucaacagauaagugacaggacacaaccaaaacaaaaaaggaaggggaagugaggcugccugcuuggcuagcauuggcugagaaccuggagaggcuggcuccccaguggaggaaaaggguaagugagugacccccaacaguccagguucccaccaugaacucaugcaauccuagacacaggagagucccuaggaccuagugggccccaagacuaacauaggaagcugcaaggagaccaagugaaggcauugcuccagagagagcucaagcugagucacacccucugcccccaagcccuaggcagcuacagcaagucaccauauugaaagccuagccccuaccauccugccugggagguccaacgguaccugcaucaccacaucccugguguccuauugacauuccucaccugcagccaaugcaugucauggcuggcagcuaguugcagccaauauucaagugcaagccauugacugugaccccaauauccccaggaacaaagcugccaugcauuuucaugugccccaugaacaaacucuccugcccacagcugcugucacugcaagugacugcuguucccagggucaagcuugaagaaaauguguguucccuaaacacauguauacagcugcugccacugaaagcaaccuugccuuccccaguagcaggguugcagcugcugccuucucucaaacauuucuuuggggacauguggaucacuccaccccugucuaccacaacuggcaccugcucauaccacugggaggucugaggacagguccaccaguccuggcucucucccccacucuauguccagacaugacauccaagggccuggaaaccaccuacccaaguugaccaccaucagcaccaggguacuccuucugugguccugaguucacgccugcccagcucauucuagccaaugcccacaacaaugcaaucaccauacuggguacccacguacacauaccacaggugggacuggagacuggccuucccagcccauuguagccaaugccaacaaacaaugcaaaucacuucagagcuagaugauugucucacuauugcuacugccaucacccauuccaugcugcugcccagaggucugauaaccuacccacccaccuggcccaccauugccacuaccagcaccugggcaagccaccuagaggcccaagaauggccugccugagccugcuaacacagguauauuagcauauguugcccuggggcccaaggaaaggcauguuuggccugugacuggccaccagugggguuugaggacaggcccaccuguugucccuguccccagaaaaucuucaucacagccuccacuguaucauaaaucacugaggaaaucacagacacugcagucacugaggaaaucacugacaccacugauacuauuuacagccaaauaaaucacacagugauuacacuacugcaagcauccagaaucaaagccaaaguguccuacccaaccuaaaccacagauucaucuuuaacagaguccuuccuuaggaaagcaaauucaaaaacccggaagaagaaauguuuacaccagauacauagaugucaauguaaggacaaaagaaacauggaaaaacaaggauacuuucaaagaaacacaagaauuuucuggcaauauauucuaaucaaaaguaaguuuaugaaauccuugaaaaaagaauucaaaauauugauauuaaggaaacucagugaaaugcaagagaauacaaagaaaucagaaaaaaaauucagaauaugaaugagaaauuuaccaaagagauagauaucacagaaaaggaccaaacagaaauugugaaacugaauaauuccuuaaaugaaauaaaaaauacauuugaaagcuucaacaauauauuagaugaaagagaagaaagaauuuccgaacuuuaagagcggucuuuugaaauaacccagccagacaaaaauaauuuuaaaaaauuaaaaagaaugaacaaagccuuguggcauauggaacacaaucaggugaucaaauguuugaauucugggugcuguagaaggugaagagaaaacaaaagggauagaaaaccuauuuaacaaaauaauagcugaaaacuuucaaagucuaggaagagguuuagacauccagauacaggaagcuuagaaguucccauacaaauacaauuccuaaaggccuucuccacagcacauuauagucaaacugucaaaagucaaagacaaagagagaauucuaaaaccagcaagagaaaagcaucuagucacuuauaagggaaccccuaucagacuaacagugaaucucucagcagaaaccuuucaagccaggaagaaugagaugauauauugaaagugcugaaagaaaaaaaaaaugccacccaaggauuacauacccagaaaaguugucauucauaaaugaaggagaaauaaacucccagacaagugaaaguggaaggaauucauuaccauuagccugguccuauaagaaaugcuaaagggaguccuauaccuggaagugauaggaugauaucuaccaucauaaaaaccacaugaaaggauaaaacccacugguagagcaaacacacaaauaaggaaaaaaaaaaaaaaaaccucaaauguuaccacuacagaagguuuucuauaauaaacaauaggagagaaagagaaucaaaagacauuacaaaauaacuagaaaccaauuaacaagaugacaggaauaagcuuuuauauauuaacaauaacuuugaauguaaauagguuaaaccuuccacuuaaaagauauggacuggcugaaaagacaaaaaaaaaaugagccaacucucuuccacccacaagaaauuuaucucaccuauaaagacacagacugaaagcagaggugaaaaaagagauuccauguaaauggaaaucacaaacaaacggaauagcuaaacuuguaugagaaaacacagacuuuaagucaaaaacaguaaacagaagcaagaaagaucauuauaugaugaaaaaggaucaacucagcaaguggauauaaaaauucuaaacacauaugcaccuaacacuggaacaccuggauauagaaaguaaauauuauuagauuuaaagggagagauagacuccaauacgauaauaguugggaacuucaacaccuuacacucagcaugagacaaaucaucuagacagauaauuaucaaaaaaauuaaaaggauuuaaacugcacacuugaccaaauggaccuaacagacaucuagagaacacuucauucagcagcuacagaaugcaccuucuucccaucaguacauggaacauuucccaggauagaccauauguuaggaaacagaacaagucugaagaaacuuuuaaaaaucaaaauuauaucaaguaucuucucagaucacaauggaauaaaacuagaaaucaguaacaagggacacuuuaaaaacugcagaaauacaugaaaauuaaccaacaugcucuugaaugaucauugauucaaggaagaaauuaaggaagaaaucaagaaauaucuugaaacaaaugcaagucaaaacguaguauaccaaaacuauggaagcaaaacuaaggggaaaauuuauagccauaaacaccuaugucaaaaaaaaguagaaagauuucaauaaacaaucuaaugcaccucaagaaacuagagaaacaagaacaauccaaagccccaauuaauagaaggaaauacauaauaaaaauuagaguagaacuaaacgaaacagagacuuaaaaaaauacaaaggaucaacaaaaugaaaaguugguuuuuuaaaagaugaaaucaauaaacuguuagcuagacaagccaagaaauaaagaagacccaaauaaaaaaaugagaaauagaaaagagacauuacaacugacacuacaaaaauaaaaacauaauuaaagaccauuaugaaaaacuauacacuaacaaaccaaaaaccuagagaacaugucuaaaauucuggacacaaccuaucaagauugaaucagcaagaaauaaaaagccugaacgaaccaauaaugagcagugagauugaaucaguaaaaaaagucucccaacagagcaaaguccaaaacugaaugguuucaauguugaauucuaacaaacuuucaaagaacggacaagagcucuccucgaaaauaccguccaaagacugaagaagagggaauuaucccuaacucauucuaugaggccaguguuacucugauaaugguuugggaccagugacaucuggaaaugcugcaucuccagcuaucagcuguccuccccucacacuagacuggggagcucaggauggguggucuucucuuccacuacccaguggcuuuggcuguccaaccacccuuucuucagaaggaauugcuugguuugcuggucagauauuuggauuaaacagccauuugguauggggcaaacugauagcaaguauuuugcacacauggauuuucuugaagcaggcugacaagaaaaucagagaauauaauuuauaagaaagaacuuuauuguauuuuuuuagggagaaaacgacaaauuuccgauuuagcugcaugaaaaucaagcgagaugaaaagaugacauuaaguuagagaacacaaagaaaauguauuagcgaauaaauguuucucuagagucauugagaaaaacagcaaaaaaguuguguauguacacaauggaauacuauuaucauugcaaaaaccgcaauuacugcugugccaaccuaauauuuggcaauaaaaaagaaugaaauuaugucauuuacagcaacauggauggaacuggaguuauuaucuuaaaagaaauaugccaggcauggaaagacaaauauugcauguucucacucauaugugggagcugaaaaaucgaccucauggagguagagaguagaauaaugguuaccagaggcugggaagggugugugcaugggggagcgagacgaagagaaguuggguaaagagugcaaacauacauuuagguagaaggaauaaaugcuaauauucaguagcacaguagggugacuacaguuaacaaaaauguauauuucaaaacagcaagaagagagaacuugaaauguucccaacacauagaaaugauguauacuccagaugacagacacccuaaauacucugacuugaucauuauacccucuaugcauguaacaaaauaucacguguaucucauaaauacauacagcuauuauguauccaaaaaucauggaucaacugcuuugaauacacagagugaaaaaguauuuuuuguccuuacucuguaaauaccuaaauuauagaccuaauaauuuauuuuauugaucuguuguccuaaacagcaauuuacuaacauaacugaaauugccuuucaguaaaugcccagggcccuauaguuggcuauuaaaugcuugaagaagaaauaaaauucugguggcuccucacuugaccacuuuuccagcuaguauuuuauuaguagcaaggaaauaaucacagaaauucauuacuguuagagaguccagugugugagaacuaguagguggccacuugcuuuaguugucaguuuuugcaguguucuaauuagagugaucugggaauuaagaagcaaaucgucuucucucgaugggaaggggagguugguaaugugguugguguauggagaaggguucaggaaacaggcgcagugguuagaaugggcaggucaucagaacugaagaggacaggcuugcuaugcgccucaagugugggaggcagccagggaaagugacacuucuuaccauugcuugaacaauguaaauaacaagugauccuuaaaggcaaaaguaaagaagcagaaaaaugauaggaacugcuugguuuuaccggggcaggggguguuaguuucauugcuacaagcaggacuaacuaccuaauuugcaaagcccaguacaaaaugaaaaugcaggacccuuguuuaaaaacauuaaggauuucaagaccaucacagcagagcauuacaacagcacgaggccuuucugaacuuggggcccucuguggcuacacaggccacauguucaugaagucagccuuuccugcagacccaaacauuaacgacaagagagaugaagcacuuuuuuucagaucaccaauuaacacuccaucugcaagccuccggaaguucugcuucuauuacuuuuucuggucugaacuguuggucuucuggcucucaggugggguuacuaaaggaagcagagguuacagaacucgcauucuguacaauuuucccaccgagaagaagucuagugaggaccacuauacuuuuaaauauucuuuauucuuacugaaacauaugugggaccauaucuuacauuacauuacacaucaagauuuuugguccagaaauagguuuguugucauaacagauugggaaacagcuaacccauuuauuuuaaucagaaaguuguauuuuuuucugauuuuaaucagaaagucuguucaagacuuucauugcuagaacuagauauaaacacuuuuuauaagaauauugaugccauugauacaauugcugcugcaaauucugcaaccccagcucuugugauuucagagucauaucuuguagagguggauccgacgagagaugucaucucuccaagacaaacuuaacuggaaauuaaccaccccagcuucauuacaucagaaugggguugaaggaugccagagagauauggacaaguauauuucggaaaaaaaaaaaaaaaaaaaaaaccaaccaaagugauuugauggucuccugguuaagaacuacuguucuacuucaaauccuuuuucccucaguuaaggaaacagguucaauaacaagcuuauauucaugcaggcaguuagagagagcuggacccaaaacuuagguauacugugucucuaacaggguuccuuccgcaccguaaugaaagcauagcauagcugguagucucaaaagauuuuaguuugaggaucaaaugauauugagguuuaagggaaguucggccuuauaacuagaaugaaguuuucugauaugugcucuguguuaaacugaauauaccacgucuguuuaguugggagaacuuacaacuccuguuaacgaauauucuaaaugcucauaacuaaaagguaggauuaguauaaaaucucugauucugauaaaagacuacuuaaaauagccuccaguaagaaaccaaauacaauauggauuaauggaaauuaugaaaaaagccguuagaagacaaauuucucgccugaucuucacaguauacucuguuuggauauguaauuuaauaaaauguaucaaugacaagucacccagcgaauuucuaaaaaaauugaaauaucucuuagcaguugacuuauuuuuauggcuuuuauuggcuguauucuuacacuuacaugauacaagucacaugauaaauuaauguuacaguaaagcaaacugaccuacugcaguuaucaguaaugacaggcagcacuuugacagacuccuucacccagaaacaugaaacugaagagugcauuuuccuugcaaacaaaccagguuuauacuuuacacuagggucauuuuacaugaaggcaagggaagagaaauauucagcuacaaugguccaacaucuaaaaugucuaagcuuaaaugaaaagagccugacauauugaaagaccucacuagcaaaaugcaucucuaaggaguuauguguguaacugaagagaacuacaaaaaauccaggaagaaccgucccagcaguucagagacauuuuuaaaaauuaaaugagcauccguggaggaaugcacucaacuaaaugccauccauccucuuagcuucagauuucacagcacagagacccccugcccagcgguguuccacucuccagaauuaguccacgacagggagucccuuggcagggcuguuccaguacaaaaggagacccagcgggccaaaugaugaguaauaguuauaaguaaacauacuaaaugauacuaaggaguuuagggacugcucucauucuaagcaauuucuuccaggcaaaauacuuaacacugguuucacaccacucuuauaucagcuuuucauuuggaggcuggcacuuucuucaguauagcacugugggagcaauugugucuccucauaaaacaccaauaaguuuccaaguuucaaucacuuuacuugugauuucauuucuuccuucugauauuucuucaauuuagcacucauacugugacuccauucuuucaucuuuuaggcauacguuuuguggcuuuuaaacuucuuaccuucugagaauaaaaguggcaaauggugaguacaauuucugggaaugaauuugaaguggauagguauaaaauuuaguugaauaaaguaaaauaguuguaaucaugaggggaauggacuggugcaguuacacgcaccugggucaccuucuaugacugugggccuccaugugaacagcccuccuggaacagugcacugguggccccaagcuguauuucacuaaauguuaauaauucauacuuaacccuggguaauuuuucugaaucauuuuaauccaugguaaauuauagcaucauauccuuacugauaucaguaccuacucuacauaucuacguuuacuuuuuuaauacaacuagggaacugaaagaaaaagccuucgaagggaaaaauuucagccccacuuaggacuagguaugauucuggucauuaccaacagagagugaaaagcaaagaaaggcuaugaauaaagcaggaaaauaauacauuuuccacauugucagugugagaacuugaaaagccauuaagaagaguggguggaugaaccucaaaaacauuaugcuaaguacaagaagccagauauaaaaagccacauauugugugauuccauuuauauaaaauauucagaauagguaaauucagagagaggaagacagacugacaguugcugggaacugaaggagcugggaguggggaguaacugcuugcugggucuagaaauuuuggggggagugaugaaauguuuaggacuagacaguuuugguuauugcacaacaugauacgugcacuaauugccccagaauuguucauuuuaaaaugguuaauguuauauuuugugacuuucacaucaauacaaaauuaaaaauaaaaugaaaaacuaccuucgugauuuuucuguaauauuaaagccaucuuuuuauuuauuuauuuauuauauuuuaaguucugggguacaugugcagaacgugcagguuuguuacauagguauacacaugccaugaugguuugcugcacccaucaacccgucaucuacauuagguauuucuccuaaugcuaucucuccccuugccccccaccccacgacaggccccgguguguaauguucccuucccuguguccauguguucucauuguccaacucccacuuaugagugagagcaugugguguuugguuuucugcuccuguguuaguuugcugagaaugaugguuuccagcuucauccaugucccugcaaaggacaugaacucauuccuuuuuaugaaagccaucuuuuaaaaagcguuuuuuuuuuuuuuuaauagaauuuuaguggggaugaggcaugaacuccaacccguucagcuugcuuaagucaccuagauaacccuuuauauauauuuauucuuuuuuuaaaucguuauaaucuaaacauuaaguuauaagcauguauuaagggcacuacuaccccuuuuccucucauaugaauuaguguuuacauguagucaaauuuaucaaguucuucuuuaguucuauuggucaaucuuugcuuuauaaugucugauuucuguuuccuucuuagaaagaucugucccacuccuucacuugaaagguuguuguugauuuuuuccucuaagguauuuauuuauuuauuuacuuuuucuaauuauuuugguuaguauuucugauauuauucaauaaugugcucacaccagcaaucccagcauuuuaggaggcugaggcaggguacugcuugagcccaggagcucacgaccagccuggguaacauggcaaaaccccauaucugcaaaauaagauacaaaaauuagcugagugugguggugcacaccucuagccccagauaacugggaggcugagguggggaaaucacuugagccugggguucaggacagcagugagcaugacugugcuacugcacucuagacuugacaauagagcaagaccaugucuuaaaaaaaaguccugucauuuggacuuaaauaauaaaauguagcagugaaaugaaaagcuuaaguguggaugggggaagaagaaagaagaaaugauuuuuuuucauauuuaauagacaguugguaacugacauuauuuuaaaacaaaucuaucaauaauagauguuuaaauaugugauguaaugguauaaagguagugguguguuggagccccuucucuuucccaccccaaacucacaagaggcaacuguuaaauuuucaggaaauuugcaaaccaguuguuaaauaaagccauaacugaaaaauaaaguauaaacuccugauuucugaucuggcauguaaggagauuagguaucuucagucuggccuaacaauaaguaaaaaucugagcaaaaugaaaaauuacaacucuucuugaaucuaucagagaaggguacucauagagcaaaccacagggcaacauuggagagauagacagguggacacggaaaauuacaacuuaauaaccaaacagaaauccaugagcagaaaacucauuaugagccaguaccaggguaggaaacccuaaacuguaauuaacgaacuucuggagguugaguguggacaagcuugaaagaugaaaacuccagggcacucagucauaggggguccucacacuucuacaaguuuccucuccaggagucugccagcuucucacaguaaauauuggaaaagagucccuuuugcuucuaguagggagaaaggaaauguuaccauuuugaaauacaucacagccuuccguucuucuuaacaaggccuacccagaggagaaacuauuuuaccagagcugaaucuucugagguuguaucagagccucacuuaccuaggggaggggaaaugcacagcuguggucuccuccagucacccugugccacguaaagggguuggcggaaacuugugaaguccauagcccagaggcacaagcucaccaaaagacugagaccuaaucauagaaugcuuccccgcucccccacaacguaucacuauauuaauaaaggcaaaaaaacaaaaaccauaguuggagacugaauuagcaucagaaccagagucagauaugguagggauguugaaauuaucagaaaaucauccucaugacuuaucgcugcauuaauaaaggcaacaaacaaaaaaccacaguuggcgagaucgaucgaauuagcaucagaaccagagucagauaugguagggacguuggaauuaucagaaaaggaauuuuuuuaaaguauaauuaauaugcuagaaggcuuuaauaggaaaaaaaagacaugucagagcgaauaaacaaugucagcugagagauggcuauucuaagaaagaacaaaaaagaaaugcuaaggaauaaaaacgcuguuaacagaaaugaagaauggcuuuggugacugacauuuaauuaguagacugaaugugguugaagagagaaucucugagugugaggacgugauaacagaaacuuccaaaccacacauuaauuuggaaaaauucucagucacuauugcagacaucaaacuacagaaauaggaagcucaaaggaaaccaagcaggauaaaugccaaaaaaugaaaauuuaaaaacuaugcuuaggcacaucauauucaaaccucauuaaaucagauaaagaaaaaauuuugaaauaagccagagggagggaaaaacacuucacuuauaaaauuacgucugacaucuccucagagaccaugcaagcaagaagagaguagaguuaaauauucaagguguugggagaaaaaaaaaaucagccaaccuggaauucugcacucugcaaaacuauccuucaaaagugaaggaaaaauaaggacuuucucagacaaauaaagauagaggaaauuuguugccaguagaucugacuugcaaaaaaaauguuaaaugaaguuauucagaggaaacaaaaaugauauaggucagaaacuagaucuacauaaagggagagcgcuaaagaaugauuaagggaagacacaacaaaaacuuuuauuuuucuuauucuuaauuuaucuaacagacaacagguuguucaugauaauaauaauaauguacucuauguauauggaggagggauucaaaauauuuuguuauuauaaaguauuugcacuaccugugacaguuauuugaaagcagauuugaauuaguugcaaauauuuauugcaaacccuagggcaaccacuuaagaaguaaaaacaaagaaguauaauugagacacuaagaaaagagagaggauagagucauauaaaauccucagaaccacaaaaagcagcaaaugugugaaagaugaaaacaggaacaaagaacaagggcaaaaaaucaaaaccaaacccaaguauuauagauauuaauugaacuacaucgauauuuaccuuaaaugucaauggucuaaauuccccaauuaaaagacagagauugucagacugaauaaaaaaccaaaaccuaacaauauguguuguacaugaaauucacuuuaaauguaaagacaaauauggauuaaaaauaaauggauagagaaacauagaucaugcuaacaugaaucaaaagaaaguggaaguagcuguauuaauuucagacagagcagauuucacagcaagaaaauuugucaggaaaguggagcauuacauaaugauaaaggggucaauccucccugccaaaagucauaacaauucuuaauauauaugucuguuuucuaacaacagaauguaaauauacuuuuuaaaaauuuuuuaguuuuuuauuuuuuuugagauggagucucacucuguggcccaggcuggagugcaguggcacaaucucagcucacugcaaccuucgccucccggguucaagagauucuccugccucagucuccagaguagcugggauuacaggcaugcaccaccaagccuagcuauuuuuuguauuuucaguacagacaguguuucauucaccauguuggucaggcuggucuugaacuccugaccucgugauccacccaccuuggccucccaaagugcugggauuacaggcaugagccacggugccggccagaauguaaaaauacuuaaagcaaaaauugauagaacugcccagagaauuagauuaagucccacuguuauaguuggcaacuucgauacccuucauccauaaauuaacagauccagcaggcagaaaaucaguaaggccauagcugaacucaaaaacacuagaucaucuagguacagucgacaccuauaaacuacuucauccaacagccacaaaaggcacauugcucucagacucacauaaaauauucaacaagauagaucacguucuggguaauaacacauacaaauuuaaaagaauacaaaucauacagugucugcucucagaccaaaauagaauuaagugagaaaucaauaaaagaaagauaguuggaaauuuucaaaauauuuggggaucacauaacacacuucuaaagaagauauguguuauuuagaaaaaauaaauuacaagaaaaauuuaaaaaucuuuugcacuaaauuaaaaugaaaaccaaacuuaucaaaaugugugggaugcagugaaaggagugcuuagagggaaauuguaacacuaaaugcauauauuagaaaaaaagaucuaaaaucagccauauaaacuucugccuuaguuuuuuaaaaagcuaaagaaagaagaguaaauuaauuccaaaguaggcaaagaaaaaaaaguaaugaaaauuagagcacaaaguaauaaaauuggaaacaggaaauugauggagaaaaucaacaaaacugaaaacagguucuucaaaaagaucaguaacauugauaagccucuugccaggauaacugacaaaaaaggagagagaaggcaucaacuacuacuagcagaaaugaaagaggugccaucacuacagauucuguggacauuaaaggaauaacaaaugaauucugugaaaaauucuaaauccacuauuuugaugaccuagaugaaaugggccaauucuuugaaaaacucacaugagaauaaauugacaaucugaauaggccuguaucuauuaaagaaacugaaucaauaauuaauaaccuucuaaaucaggaaacagcaggcccagaucaacuuauugguaaauuuuaccacguaauuaaagaagaaauuuauaucaauucucuagaaucuuaucuagaagguagaagcagagagaauauguccuaacucauacuuugaggaauaccaaaaccagacaaagacauuauaagaaaagaaaacuacagaucauuaucucucaugaauauagauguaaaaauccucaacaaaauauuagcauauccaauccagcaauguauagaaagaacuguauacuaugaacaacugugauuuauuaaagauaugcaagacugguacaacauuuaaaaaucaauuaauguaauccaucauaucaauggguuaaggaagagaaaucacaugaucauaucaagagauaaagaaaaagcauuugacaaaauccaguacccacucaugauuaaaaaacaaagcauaacaaaaugcucaauaaaguaguaauaaaggggagcuuccuacuugauaaaauauauucacaaaaaaucuacggcuaauguauuuaauaguuagaaaccugaaguucuccugcuaagaucaggaacaagguaaggauguccccucucaccacugcuuuucaauacuguacugaaaguccuagcuaaugcaauaagacaagaaaauaaaagaaaagguauacauauuggagaggaagaaauaaaacugugugcuuguucacagaugacaucauugucuauguagaaaaucugaaagaaucaacaacaacaacaaaaaaacuaucugaguuaauaagaaauuguaguaagguugcaagauacaaggucaaaguacaagagucaaucacuuuaccauauaccagcaauaaauaaguaagauuugaaauucaaagcacaauacuauuuauaucagcgccccccgaaaaugauauaccuagaaauaaacuaacaaaauaugcacaagagcuauaacaggaaaacuauaaaacucugaugagagaaaucaaagaacgaaaugaacagcugauauguauuguuugaaagacucaauauuaucacaauaucuacucuuccuacuuugaucuacagauucagugcaaucccaauuaaaaucugagcaagcuauuuugugaauguugacaaagugaucuuuaaagauuauguaaaggggcaacauacccaaaauagccaagaauauuaaagaagacuaaaguuggaggacugacacuauccaaguuuaaacuuacuauaaaacuaaaguaauaagacagugugguguuggcaaaagauuagacaaauagauuagcugaacagaacaaagaacccaggaauacaucuguguaaauauagccaagugaucuugacgaaggaacuaaaaugaagaaaagauaguuuucuucaacaaaggaggcuggaacaacuggauauccacaagcaaaauaacuaacuaacuaaauaaauaaucuagacauacaccuugaaccccucacaacaaugaacucaaaaugaauuauagaccuaaauguaaaaugcuaaacuauaaaacuccuagaaaugacaagggagaaaaucuagacgaccuauggugucagaauggcuuuuuagauacaacaucuaaggcacacuuuagggaaaaaauggcaagcuagacuucauuaaaauuaaauuuucugcucugugaaggagcaugucaagagaauaaaaagacaagucaaagacuagaggaaaagguacgcaaaagacaucugauagaggagugucauccaaacuauaccgaaaaaagcccucuuaaaacacaauaauaagaaaacaacucaauuaaaaaugguccguaucuuaacagcuacuucauuaaagaagauauacagauggcagauaagcauaagaaaaaaugcucaugucaucagagaaaugcaaauuaaaaugacaauuagauacuacugcacaccuauuagaauggccaaaaucugcaacacugacaacacgaaaugcugccaagaaugugaagcaaugacagcucuuauuauuguuggugaaaaugcaaaaugguauggccacuuuggaagauaguuuuugguaguguguuacaaaccuguacuuccucuugccauaggauacagcaauaguguuguuugguauuuacccaaaggaggugaaaacuuauguucacacaaaagucugugcaaggauguuuauaguaacuucauucauaauugccaguggaagcaaucaagauguccuucaguagguaaguggauaaauaaacugugguacauugcaaugacaaauuacucaaugcuaaaaugaaaugagauauugagccuugaaaagacacaaaggaagcuuaaaugcauauuauuacaugaaagaagccaauuugaaaaggcaauacuguaugauucagacuauaugacauucuggaaaaggcaaaaccauggaaacaguaaaaagaucaauaguugucagaaucuggagaaguggaaugaugaauaaccagagcagaggacuuuuagggcaguggaacauucugugugauacuacaguaguagacacaugucauuauacauuugucaaaacccacgcauguacaacagcaagggugaacccuaauguaaacuguggaguuggauugauaaugaugugucuguguagguuuauugauuguaacaaaucaagccacucuggugugggauguugauaguaggggagucugaguaugugugaagaugagggaauauggaaacuccauauuuucugcuuaauuuugcuguaaaccuaaaacuucucugauaauaaaauaaagcuuauugaaaauauuaagcauauacauuugcaaguaaauaaguuaacggauuuuacuacacuuuacuaguaucuaugcucuugacaccgcaaaugugugggggaaauccuacauugugguaugcugcuggugaucacuuugucaacauucauaaaauagcuuacucagauuuugauucggauugcauugaaucuguagaucaaguuaggaagaguagauauugugauaauauugagucuuucaaauaacauguauuaucucucugugcucuucucugcauuccaugaggguaggcuggaagcuuuaaauaagccacacagggaauauuuauaccauggaaauugacaaaugcugcaaaucaggguuugacuuacugcuuuuuugacugucaaacugaagagagaacggaaaaaauguuaauaauacagaugaaacuuaaaaguguguugugccuacagucauuacauauagaauaguacaaaaaauugagaaaaucuuuuuucagaacuuaaaaccuaaucuaugaucaagcaaucauaauugaauuaauuaaucaaauuaauccaauugaauuaaugugaucuaugauuaagucauuuauaucuuugaugaaugagugaaguucugacauucaucuucaauguuuucccuuuguuuuacucauuaacagacacaaauuaucaaccaaaauuuauuuuggauuuggacuuaaaagccagucacaaguucaccgcuauauaaagauaacugcuagaaaagcugaaauaauaauauaacuaaccaaaauuuugaggcagaguagggggaaguauaauaagcaauaauuacauugcaaauacaauauaauuuuuucaucuguacaguggagaaucaaaauacacaauuuaaggucaauacaacucaaaguggaugauuaauuguauuauucaaauauacaaugauaauugaaagaaaaacuuuaaaaguuuuauaaaugauucuaauuuaucaaaagaaaagcauauauacauaaaaacugugacuccuaauauugccucccaccccaacaguccagaaucuauuugcucuccuugaucuguuuucauauugcuguguaauuuuccuuuaugauauauuaagauuaauuauuuguguaauuauuuguggauaccuuuuuuguuacucgauaaacuucaugaagcaagagucuauguaugauuguggucaccaucaucguaaaugccugguacaaugucugagauauagucauuggucgguaaugauguauugauguaaugcugagugaagagccccugacuucaaaaaucucagaggaaagcuacacagaaaugcaauaaaaugaaagaaaccuguuugguuuuaaagaaguagagaaaagauuagacauuuugccuaagggaagacuuuguauagaaggugguaucagaguuacgucuugaaauauuaggcaguuugccugguggacagggaaaaaagucauuuuggagaaaugaaacugccagccgagcaagguaacguuagugaaacagggccacaacacagagaaaagugugggccaugcuaaggaucuggaauuuauccuguaaaucauuggaaaaggaggcaauaagauucuuuucugggcacccucuguagacaaugaggaagaaaggaaggaagggagacuggaggcggaauuuggggagggaggcuuggcacugauugguuccuacaccguaguuccucaagccacacaaucuacagagagaaaaaacugguauaauuugcauuggugcuuuaguugaaaggaaaauauugcugaaauaaaagggauggggacaagucaucggggucaaauccagcuuuucugcauacugucuccugcaauuugaaauuuuuuuuuuauucuuucugugaauaaccccuacuucaaauccugacucuaggaaaaccuacuuucuucaauaaucucacuuaucuuuaaucacacaaaauuuucacagugguauuuaucuguaucauaccuucagagcugaagcuguguuuuuacuugauuuuguaaucauccauagugcacaaugaaauguuuagcacaaaguauauuuugguguuuugaucaguauauaauaacgcaauaacaaaugaagauuuuaaaacugucacuacagaggagcagaaagaaaucggacaaauguguaaagagaauaacgugauagaaaagaugauagaaugauuucuuuaauuauaugagagggagaucaaaguaauuaugagaccgggcauaguggcucacgccuguaaucccagcacuuugggaggcugaggugggaggaucacuugaggucaggaguucaaacaagccuggccaacuuggugaaacccugucuccacuaaaaaucaaaaaauuaacugggcuugguggugcguaacuguaaucccagcuacucaggggacuggcacaggaaaaucacuugaaccagggagguggagcuugcagugagcugagauugugccacugaacuucagccugggcaacagggcaagacgcugucucaaaaaaaaaaaaaaaaguaguaauuaugaauacuccgcuuucaagaaauaaaaaaaaaauccuguaauacuucaggaauaauguuauauuuaauuuuaauucaaggacugguuuuuccccaaggguuaaauaagauccagaaacuuggaauuaugcagcuugugacagaaaauuugguuaaauaaggggaauaacuguuucuuacaacauucccagcacugcauuuugagugaccccuugguaguauucugguguuuaagaaaaucacuaaaaccucagaaugcugacauguguacaguagggaauucacgagugaguuucaugugguuaaguuaggugaugcagguauucauaacaguuauaacauucagcuguucacaaaauucuuguaagguggaccuccaguuuaauuugcccucuucucugcagcauaguauaaccacagaggcuuguguggucucuaacuuuucccuaugauacaugcucaaccuggugccaggcucgcugguauggaaccucucagucuuagacuugaauuuuuauucuccucucuuccauuuccaucuguaggagaaaaauaauguuaaaagaaaagcugcuuccaggcaaacagaaucuaagaagcacacaaaaaugaucaguuaugguuugugaccugauaggcuguucugggaguugagcugucauacucaggagaaaggcggcuaugugagcugugaggcucaagugugggagagauaaguagggguggaaaugugaaguuagcaugcaugcuugcauuugaaaaguacucuuucacgcauuucagaguuuuagagguuuuguuguuuguguuuuuucuauuuuugcuauuuuuagcuuugcuuuuuaaaauuaaaccucucuuuggggcuaucgacauuuuguucuuuaauaacuggucuuccuucuacaauuucucucuuuauuuccagcaaugucugcugauaagaacagccuucccaggaaugcgucaaaugguaagaagauauauuuuuuaaaggcaaaauauuuaaagagagagagagaggaauagaaaaaguagcuguugguggaagguaccauguagcccucuuccgcaucaugauugaguacauucauccaucaaugaagcauagauuccgucagcagggauuauaugcagagcauuuauaaucauuaaaauuucccaacauaagaagguccuccuugcaaaaugggaauagcacaaauggaugagaaucauucucaauggaaaauggaagaugcuauacuguaucagaauguuuguguacagauuuuauguaaauauggauguuaucauagagaaggugagaguucacucuuaguacccuaacuucagcauuagaacuuacaguguacugauucugccccuugccuucucucucuuccucaugcucuuaauuugcuccucccccauaauuggucauuacauuuauuuacuuguguuugcuacucuguugcugccuuauauacaguuggagaaucucuauacaaugguuaaauuacuccuccuacccauggucaaauauggcucuagaaaaacauuaacaauaugaagcauggucuucaugacccuuaaacccaugugagccucuguugccaucugcccuucuacuacugacaucuauuucauucacucuccuucuuuuccuugauuacuauugccuaacauuuccuucuuaagcuucuacacuuucucauucucagcuucuuacuucauuaagaaaauaaaagaaucagaaaaaauaucccaaagccuucaucacaauauucacagacugaccugugaaugagcccauagaccucuccuaucacucuggauaaacuauccuuacuuguauacaaggcaaugcacccauuuguauacuauauuccaucauuacuugcagaaauuuaauucuccagaaauucuucauucacauacauuaucauuuauuuuucuaugaauucauuccaacaaaaguacugcuauuuuagccaacuuuuuaaauugauagauaauaguuguucauauuuuugggauacaagugauaauuugauacauguauauaaucucuaaaggucaaaucagguuaaucagaauauccauugccuuaaauauuuaucuuuuauuuauacuaguaacauuugauuuauucucuccuaccuauuuugaaauauacaauagauaaauguuaacuguagucacccuucugagcuauugaaugggucuuauuuacaguucuagcuaauuguaaauuuguacccauuaauaacccucucuuuaaaaauuauacagcuuuuuuuuuuuacacuaucccucucuaucuacuguccuuuucccuugcuuuuuuguuaagcaaaaauguacugccuccaauaccucuccucuuggugucuuucaaguauauuacauuugcaauaucauugcaucacuuuagcagaaacaucaguccuccuuccaggacagccuaaacucuucugauuuuacucuuacuuaacuggcuguuccuucucagucuucuuuugugguuuuucucaucucuacaaacuaugagucuuggauaucccaaggcucagucuucaaacaucucccauucucuaucuacauuacucucuuggugauuuuaauuggaccccuggauuuaaauaccaauuccacacugacaaaauccacauauauauuuauaguauacaccucuucucugaaauucaaacuuagauaugcaaucaucuacucaauagauugaguaguacucacuuggauauuuauuuugaauuuaaaacuucaagagucuagagcuaacuucugacauuucccccaagccuucuuuuucugcauucuuuuguaucuuaauaaaugcaacuucuuccuugcucaaaucaaauaccuucaacucauccuuucugucauauuucauauugaauacaaaagccaaaugucucaaacuucagacuauauccagaaucugucugauucucaucaccuauaucacuaucacccaggucugagacacucucaucucuuccuaaaauacucaauaaucuccuaaguggcaccucugcuuccuuguguauagcagcuaaaguuagcuuauuauuuuuuuuaaguagaauauuucauugcucugcucaaaugccacuaauggcccucccucucacuuaaagucaacauccccuuuaauugcacacagccucaauaagucugccccucacuccugguuacuuaacuucucuuucuggacacaugguccuccgugcucuuccccagcaaauuccuuuuauaccugcuaguccuagaaccuggagcaaucuuccccacagauagcaugauaucuguacucucaucuccuucaaauuucuguucaaauuuuaacccuccaaaccucauccuaaacucacuauuccuuuuucuugcuuuauuuuuuccauagcaguauuaccaucugucaugcuauuaaauuuauguguguguauaugcaugcguguauguauacguuucuguuuuuuuauucccccuguagaauauaagcuuuagaaggugacgauuugucaucuguuuuuuuuucacuguguuaucugaugugccaagaauaucugugaaggaaacacagugaaaacauaauacacucauuuuuugaaugaaugaaugaaugaagucaccauuguuuggaucugaaacauauuuuacuuauaauuaaaagugaauaucuagaaaguaacagaagaauaacuucuaaaucucucaaacacucugaguuauauuuccaagagaagucaaguccaucuuguuucucuuggaaacccuuccaaucauaagaagguagcaagagucaucacucugcaguauaaaaaugauuuuucagcaagguuuuagaauucaaaggauauucugcaagccugaauucuuuacccuuaugcaggugggaaaagaaaacaaacgucucuauacgcaaguucaggaaugcugauuuugguguucaaauaguucuguuuuaaagcauauggcaaauagacccaggggaaaauuuccucacugcuguguuugcuuuuauagcuuuaaacacugagguuuuaugcaagagaaaauagauuuuugagaugacaaugacaggugaaauaggaugugaagaaaugauacuucagauucucuuaugucaacaauauuaaaaaaagcuacaugaaaaggaagugaucuacccaucuguaaaacccagaauucucagugagucacagccaaggugaauuaacaucaaauucaaaugcuuugugcucaaaugcuuugugauaaaucauaagauaugaguuuuaauuucuucuaguaggucucaucaauagcuaacuaagcuauauuuuuucuuuuguuaaaaaaguaugguaaacucucauucaauguaguugucacaaaugaucaaauauuuagguagaaugcuagauuauauagaauauuuguauuaccaauuucuugaagcuuagacuagagcaugaugcaguuaacauuauuauuuuccugaauauauguaacaauuaaguaauucaggaucaugugacaccucagggccaucaacgauuauucuauuggaacuugcuaaaguaauaaauagcguaauuuuacauaacagagggucuccuauauuaucguucauguaauauuuuuugccaguacaaagaauucccauugaaucaaauuugucuuauuggcuuuuauagggaucuaaaagucaagauauaaagagguguuuauauuugaaaauaauuauuuuuuugaaaguguaaaguuccuuguaggggcuuuaauaauuuuggggguagaaauuauuuucuucaguguguuuaaaauccauggugauaaagcauaccaacaagcuauaggugaagcuggaaugaauguuaaaccuuaaccacauuaaaaacacacacgcugauaagggcacauuagggccagaagcagcucuuguaacauuuuauucugaaaaggcaaacuuuguuaguauuucagaaaacagccuaauuuguugaaaaauuguaucugucauguucucuuuaaagucacgguaguugaaauaggaugaucucauuacuacuuuucucacaguuagaauaaaauaauaguauaccagacaggguaaaagcaguuuuaaguuuuugucaggaauuucaaaccggcaucaucucuucuuauccuccauugguagagaaauuaucaaagaaugaaaaaguagguuuuaaauucacuugugugccuuuacaauuugaaucugacuuacucuguugaaacauuaguaauuagucaugcaucaacaccaagugcccuagauuuuggcagucauuaaaaaaaaaagaagaggaauuuucuauucuguucacagugaagacaggauauugacggauucuguaggguuauucugcuaauugaauacucaaaaaaaaaaaaaaaagcuugaguguguacauaacaaguugagaauucuucccuuuuaauauuauaaugcaugugccauauguauuaguuaggcaucuuuuauguuucucaaguuuuuauucauuuguucaaacugcucugaaaaagcuggaagagauaauaauauggacaagguaauuguuguucauaccaguaucuuuacacauaaaguuaagucaaauuuaaugaaauauugauuaaaguaagaaaaauaagguaaaaguggucuaauauggcgggcuuggugauauuauauauuuucacuaagugugcuauaaaugcccacaaaacuuaucuuaucagguauuucuuuguugaauuuuauuuacacacauagaucuggcaauacacagguauaaagaacacagaacuggauugcaaaggcugcaguuuccauuuucucacuauugauuacaaauugcaguuugcauauaucaaaguuucauuuuuuaccuguuuaaauugggauuaauuacauuuguccuucaugggaauguuggacaaauacacagaguacaggugaacuguauaaagguaacuuuuguuacuugaacauauuaguaaauguuauauauuauaugaaagaaaaugccccgaauacuucauagcauucuguccacucaguugaauuaauuuucaauagaauuuuaauucuuauuccauuugguaucuugccaaaguaguaaauaguaggaucauuagagcccuuccuaauuccuucaucguguuuguguguguguaaacccuuuagauguuuuuuacccauaauagcuuucaaauugcuuuauguccuccagccucaugaagaugcuuucuuuaugaaaaagucgaagccaaacccaaaaaaccuuaacugggcacaaaaauaauucuaauauucuuuuaucuguugcuugcugucaaacaggcaucucuauguguauaauguagaacagaagauguaagaaauacgaauaucuuuccccacuuugcauaaugaggcaauuaguuguuaucuaggucccuggaugaucagcaauauuccagaaacgugugcuugggugugaugugugugagcuguaaauguaagagucccaauaauugcuguaauugcugaugggcucagucucacccgacaauuaugcaccagauguguaguaagaguacuugguguggcugauagcuuauauggcacaaaguacuuucaaacuaaguuaaauuuuguaauuaauaacuauaaugaauguuacaacuacuuuccacuacuuuaacauuaguucauguccuuuauuauaaaauaccauacacauguaaauuucacauaauuagauuggcucaucaaucuguuauuccccaauuauauaacaaaauaguuacugaauaagauuuauggguaagaugcuagggaauauauuuuaggcuucagaaacccuuauuugcauauucuaauuagcaguuuauuaaucuuaaaugcauaaggaaauuaacugcagcuuaaucucauaaaauucaucacgguaauccuuuauuacauugcuuugauauacauuauuuuuaagccguuuauguacuggaguauggcuagaagauagggaauuucauccccuuguugcacuuacaggucuuuccccacucacacugucaccuacauuauaucaaaaauuuaauaccuucuaauaaccuuuacuuuuaauaaauuaauacaauauuuucuauuucucuucaguaacauuuccuaucuccuuuuuucagaagaucucuccacuagucugccuuuuuaccaaaucuagcagaguaauucccccuuuauccaugggugacacauuccaagaccccaguggaugcugaaaccacagauagcacuaagucccauauaugccauguuuucuguaauaaaauuuacaugaauguagucucucucucucucucucuugcaaaauacugugauaguuucagaccacaguuggcugcaguuaacugaaaguacagaaagcuaaaccauggguaagggagacuacuguaucuauagaagcagauauaugaguaacuuucuguugagcagauaguuuuuucagaucauaaggugguaauuuucaggaggugaauuucacgaauucagaaaaccuuuauuaagucauuucugcaugucagagacuagguacaauaaacaagauggaagauaaaccagagaagcucauugcuuuagagaguucuaaaacaagacccacugggaagagaagcaaaacuuuucuccuagaccaaaccccaucuagcaugggggaaaaaguuucagaaaguucuggugugcuuuuagguuccucagguuaauauuuggggucuuacaccccaaagcacaaaagugacccacugaguuuaacuguaguguuucaggaagaaugauauuuauuuaaguacuaaaggacggcaccauuuugucauacuaggacgcucucagcaguuuagagauuuaagaaaagcuucuuaagucuucaccauuucacaguguuuacaguaagcuuccaaauccguucuauuucuauaaaaacuaaaugaaacagacaaaaacaaccaaugaugguuacaaauaugcucuuuggucuaugaucucauacacaugaaacuuccccuuucaaauauguggguuacgacuaugaaaaccugaaaugaauuucuuuauguggaacagaaauggacuuugaaagcaaugccaaacaagaauaacaaaauauucuaauguuaaauauucugucuuuauacaugaguuauauaacguauauauuaauuuugcauuaauugcacuccagccuuaugucuauucuauuaauaaaaauuuaauuggguauaagaauaugucuaauaugacuaauauguuauuauauauuuuguagguauuaguuuaugcuauuuauuauacauacuauuuauuauaauguauuguauaauaaauuauauauagagagggagacagagagagagagagcaugugcaauggcaagaacaucagaaugacuguaugacuuauuuuuaugucugcuugcuuaaauuugcaaaguccauggcugauauuuagugaacaugcccugguauagccacagcaguucagguauugaaauacuuuuguauaacugguaaacaucaacggcuuagguuuccugaaucuacuccggguguacacuaggguagaccucacaaaaguccccacaucucagaaacagccggggccccaauauauugcuuuagcacuucggccaguguucauucugguccaugcccaggacauauuguuggcugaauauuuuaaauaccaucuucucauaugucuugauaugcuugaugaaaacuaccaccuccaagaaaaacagaugauauucucauugcuauuguaguggcccuuuagaaguaccguaguuauuacaaaggugaaaaguagucgcuauacuuuaaaggaauuauagugggacaagugcaguaccauaguguccaggaacuugaugaugggaaaguuuucucucuauaccucacacccacuauuuccuuacagaaaugcugcacauaguccccugaaccugugugcacauuuuuuguuucugaucugugcaagucuaauaaaauauccauauugcccuuugcuauuugauguuuguaaaagagcugaaaugguaauuugagugaaggcacagguuacagaucacaguuuaaggcaagaaggaauggaugaaauuuggaaucuguaaccaguggaauuaaaaaaaaaaagaaacgaagauauucagaguugaccaauuugaauaagcacagcuaagaaugcauauuuuaaacauuuacuuugguugauuucacuucuguccuuuuuucaauccugauuuuagauuugggguuuauuuuuaaggaguucuguaucuauauauuaugauccugacgugauacuagacuucuuaaaucaacuaaggcaaagagaaaauaacuauuacaaauaaacaauauaauuccaaagcaagguucaggagaauuuguugaagccaugagauucuuuagcuccuggaauggggucaagugggaguuacuuauguggcacaucaagagauuuuuauugguucauuagacucagaccaaaaaucaggagccaaaaaccaagucaaguccaacuauccaggcaauaaacaacauauugccuauuuuuauuggugagaaaauaaacacacauuuacaacguggccauauuuuuagaaaacagucucuuuucucugagucuccuuuuaaucuacuuccucaauccauuucuaaaaaaacuuuagacacuuuuuuguucuuaauccuuguuaaugauuuguuaguuucuuuguggagaagccaaaccaauaaaaaucaaaauacaaguguuauuuagaugauuggcagacuauuuccuuaguguaucauauuauagaaauggauguuccugaaccaaaaccauaaaagaucuuuauuauauuucuaaaaacauuuauuuucuuaauuauguuuuuucagagagcuuuuuccuuaaaucuuucagauaauggauugcacuauaagaugucaucuuaaguuaucacacucauauaucacucugcucuucacagugaaacugauaaagacggauaagucaccagagaaagaaugacaugcuuucauuaacaauaaacauaccacagauuucuuuugaagauuucucuaagguaaguacaguaguugaaaagagguuugaaauauaauuuucaaguauuuugauuuaauuauggugaggcucaauguguagcauuguguggcccuaugguuuucugaagaaaaguuucaaauuucuuuuaguuucuuccaaaagaucauucaacacaucucuaauuuagcuuuuuccucagauucacuuacacuuuucagauuaaagucauucccacucccaccuauaaguaguaaauauauguguuuuuaauugcucuuuaaauuucauaaaccaaaauaacauaugguuguuuacaaagaucuaauuagcacuuuuaccuaaauaugcuuucgugguugugaagacaguaaaauuaaaaugcaaauuauaauguguauaugagaacuaagggagaauuuuaaccaaacugccugcaggcaaaugaauccccuugcuguuaucuugccauuuuuuggaccuguccugaauaaaaaacgcggaauccuuaccugaaaguuagaagucuucauucuguagucaguuaagacaguauuaacaaagccaagaccuugaaagacauaugauuaauauagcaaauaaucaacugggaaaucaagcacuuuaaaaauuaaugccacaaaagaaaucaauaacaaagagaaaagcauuagaagguucaauuauuaguaaaauaauccuagcaccauucauauuuggggagaucagucucaaaagauuucuggagaagaugccucuucaaaacauuuuucaaagccagcuaagaacauggcccugguauugggaaaaacugcugcaaggcaaugaggaauuuuggauagcugaguauugaugagcuaaacugaaggcucauguaacauccuggaaauguaugucuauaaaauaagauucagggcaagauagaaaggaacugccaguuaguauguaaaacuaugauugguuaucaaguuuagguuaucaauuauuugaaaagacauauaauuauauaugcauuuauuaauuguauuauauacccuaaacgaugaugagguuuagaaaggagugugugauauugagcaaaaagaacaaaacuggaagcaucacacucccugauuucaaaauauacuacauagcuauaguaaccaaaacaucacaacacuggcauaaaaacagacguguagaacaaugagacaagauaggaacuccagaaauaaauuuaugcacuuauaacuaauaauauucaacaaagguacuaugaacacaccauggagaaaggagagucucuuuaauauauggugcugggaaaacuggauacccacauauagaauaauaaaauuagauccuuaucucacaccauauauaaaaaucugcuuaaaauggauuaaaaacugaaauauaagaccccaaacugugaaacucguugaaaaaccauagaaaaaaaagcuacaugacauuuuucugagcaacgauuuuuggauauaacuucaaaagcacaggcgacaaaagcaaagauagacaaauaggacugcaucaaaauagaaagcuguucuacagcaaaggaaacaaucaacagaguaaagagaaaaccuacagaaugggggaaagaaaauauuugcaaacuacacaucugauaagggguuuauauccaaaauaaacaaggaacucaaacaacucaauggcagaacaaacaaagaauaacaaauagcucaauuuaaaaaugagccaugacucuaaauuucucuaaacaagauauacaaaauggucaauagcuauaugaaaaaaugcucaacaucacuaaucauuagggaaagacaaauuaaaacuacaaugugacaugaccucauacuucucagaacgucaaaaagacaaaagagaacaaguguuggugaggauguaaagaaaggagaacuugccugauguuggugauaauguaaacuagccaguauuuaaaacaguauggagguuccucaaaaaaaaaaaaauuaaugaaacagaacuccuaagugauccagcaaucucacuacugaguauauauccaaaggaaaugaaaucuguaugucaaagagauaucuacauucucacguucgcugcagcauuauucacaacagcugagauggaaucaaucuaaguauccauugaugggugaauggauaaagaaaaugcuguauguauacacaguggaauacuauauucagccaugaaaaaggaggaaaucuuguuauuugugacaacauggaugaaccuggaggaccuuauguuaagugaaacaaaccaaccaaaggaacaaagacaaauauugcaugauugcccucauaaauggaaucuuaaaaaguugaucucauauaaguagagaauagaaugguaguuaccaggggcugggguaguugguggauggugguugggaagauauuggucaaagaauacgaaauuucaauuagauaggaggaaguuaaagacgucuaucauacaacacagagacuauaguuagccauauauuguauucuuaaacaaugcuaagagaaugaaugcaaaauauccacaaaaaugauaacuauacgaggcagugcauauguuaguuaccuagaccuagucauuccauaauguauauagacuucaaaacaauauauuauauauagugaacaaauacaauuuuguuugucaauuagcaaauaaauauauuacuaaauaaaauagaguuuguguugccaugguuacuguaacccuagcagguuuuagggaauuguugauaauaguagcuaacacuaaaugcuaacugcuaaguacuucacauacauuuuuuuccauuuaauucuuacaauaauuccauaagaaaacauucuucauuuagaacaaaauuagucaucguaugucuauuuucaauacagauaugauucaugucacauucucuuuuguaacuucugcugcauaaaaggaaagaagaacucuauagaaauugaagucaauggaauuacucuaauuagaaaaauaaaauccauauaaucaauaaauuaacaauggccauuuauuggcaaagcagggagcuaauugcuuuauacauauuaucuuacaaugcacgcuauuaucuaauacaacaugugugaagcuaguaucaucacaauuauuaaaauaucguuauuuuuaaaagggggaaacuugugcucuaaagaauuaugggcaugaucauaauuccucaaugugaguggcagauccauguuuuucacucaguuuugccuaacuccaaagucuauuuuucacaucuuguaauacauucaccugaaucccucuaaaauacaugcccaaacgcuaaccccugugugaugguuaauuuuaugugucaacuugauggugcuaaaggaugccuagauagcuaguaaaacaucauuucugggugugucugugaaguguuucuagaagagauuggcauuugaaucaguacagugaguaaagaagaccaccucaccaaugugcgaaucauccaauccauggagggauugaauuuaaaacaagguggagaaagaauaaauuucuucuuucugaguaccugcccucagauaucagcacucaugauuuucaggccuuuagaguugaaccaggaucgacacuaguggucucccauaagggucauuuagauauccccuugguucuguuucucuggggaacccugacuaauauaccuuagcaccuggaaaugugaucuuauucggaaauugaaaaguuggauuuuugcagauauguuuaaguuaaggaucucaaaauuaaucauccuggauuugggugggcccuaagucaagugacugguguucuuauaagagaaaagagauuugauuugagacacugaauggaaggccuugugaagacggaggcagagauuggagugauaccaccaaaagccaauaaaagccuggagccaccagaauauggaagaggcagggaaggauuuuucccuggagccuuugaaggagguuuggccuuaugaauaccuugauaucaaacuucuggcuucuagaacugcugagagaauaaaugucuguuguuuuaagacacaaaguuuguggugauuuguuuuggcaauccugggaaacuaacacauccaugaaugaagaucuaagauaaacagcugauaggaaaauggaaaaaaaaaagagcugaucaugcauaauuuuuagaaagauaugcugaaauaaaaaauaauucaagaacaaauugaaugcuaaaagaaaacuuucaguuaucaacuaaagagucucaaccuaaauagugaaaaaucuaaccuuaccucccuuaaggaaaaaaauguaacaaccuauagucuauauuguaauaaggaauaaauucuauggacaagcuccaauuaccaguguaaauuucuuugaaucuuaucaugaugaagauaaucucuugaucucuauugcauuuaaacaacgaagugaaauauguuuucucagauauucugcuuucuaauaucuccaagccucaggaaggcacaucaaaaugcugcuuauauaaauaacucuauaaauaauauuguauuuuuauacgcucauuuuuuacaauagaaugagagcuuucuuuauaaggaaaagcucuaauaauaugucuuuucauugccugcagcuuuaaacauuuucagaggcagaaacuauaguaauagcaguuugcaaaugaagugguuuguaaaucuuaaacugcaauuuucucccaaacaaaacaacaacuaaaaaauaugcucucuaaggagagaugaaacuguaaagacuuuuauuuggcauucagauguugcuggauauguuuucaauaaagaauauccuccccuuaaauagcaccuacaucuuuccaccaaaaucuuuucuuguauauugucuguccacaacgggagugaggcuuacuaucgcaugcuaguuagaugcauuauucauuuccuuucugcuuauauauuccacaguuugaaauuuccuccagaauuaaaaaaaguaaaucgucacggucauagcuacaaugugucucuuguuuauuacaccucucccaaacagccagugcauuuaaugauacaccauuuacauuuaauaguauucagacauauuuggcacauguuuuauuauuuuuucuuauaaagcuugaauuuuuaaaaaagccccacugauuuuuguaccauuuaacauguauugaaaauuauuuuuuaauuugaaagauauaaagaaguauagguagcauuugcuuccuauauuucagaaaacuuucucugauuuuucaaugauucauuuaaauuccuauuauuaacagaaaacacagucucauuucaguuggucugugucucaaaaucuaauguccccaucuccagucuuggccauucuucccauucacuccccagaacuaugguuaguaccaccagaguguuaccaacaucaucagcagcagagcauuuaauuuagauuucaucggagcuaaguaaagcagacagcugaacaagagagaacaguacuuucucaaugggguaauagaauaaugagguuuuuuucuuauauagcuagaaagcagcaugcuauagugaaagaggaugagcuuuagauuuauuccaacuuaaucuauacugcugaucuucccucuccguggauaauuacuucacuauucugagccucauuuuuuacuuagcugaaaaauaggaauaaggauguugcaaggaugaaauaaaauaauguauguaauagcacagcgcucagaacaugaaugauaaucaguuacaugguaauuaccuccaacuaacucacacacuuccacaacuucguuuuuuccuuccagacaauaccaacaacugaacugcagcaguguggcagaggagccaguuggcuccauauaucauaccucauguagaauuuacagaaugaaagaaauuuaaagacaggucaaaugcuucauuugauaccauugcucuuuauuggcaaauguguaguagaaucaaauccauugauuuguagucuggaauaggaaucuucuaauuauguuuccaaaucauaaaaaugacuguuaaugaaaaaaaaaucaaaagcaugcuccaguaaugguugcuguucauuauuauggccagguauagaacauacaucugaaaugaaauacuuuugauuuggggaauucaggaucaaacuuggcuuuggguauccuugaauccagcugcaaucaaaucaaagcuuugagacguuuuugaaacggaagcagcaacauugugaaagaucaaauaaaaaaaaaaucagugcaacuaagaaucgucuugugaauuuuuagccauggugguaccuugcauaacagcagggucugcagugaauacacaguacaaaagcugaugaaauggcucccugaaagcaggaagguaauguuuugaagucugaagagcaucuaaaaugggacgugcuugacaccuauauuucaacagagaaauauccagagaaacaaaguggaggccccccggaucacuuuugcaaaaggucuuuuaccggcuuuaagucucucugaaggguuuguugagaauccaguccaaaguuucccaaggaauuuucuuccuggauuccacuuuugaaagaauucccugccaugcuuugccacaugcccuccuaaaauagauaaauaaaggcuagaauuuauaagaaagaaaagaguuuagcacaaaagccucuaauauucuaauauuggaucuaaagcuucugauaaugggucauaaaugucauuuucuauaacuuugcuuuuuuaaacaauucaaauuuagaaaguuuaacaugguauuugugggcuacuuauauuugaaugaguagaucauuugugguaauucugauuaacuuuuggguauuaagaacauggcuagaacuauaccucccuaaaguacaauuuuuuccuauagaaaaaucagauuugacauaucaucucaacuuacaccaucuuguccaggaguacagcacaucauaaagcuaaggauugccuucagugauuucauucugauguuuuaaaguacuuuuuuuuagucucuugaccaucugaaucagcauuuuucucagaccaguaucugauuuucuaacaaacucuguacaaaaaggagauacggaaucccuuagggcuucccuaauuugggggaacauaaccuuuuuuugauaguaucuucacaauaucuacuagaguuaaugaacuggagauugcauaaaggguacuguaagcagguauagcccauauccugguuuaaaugcacacuauuccucuuauuuuggggccaucccauuugaauuagccuccuucccuuuuggagcucgaucacagccagaggagccaauuagugaguggagggcaugcaccuugagguuagaguacuugggagccccacaagacaucucuggccuugagcuuuaucaugucacagcaaauacgcaugcucuaugugcuauuagcuguuccauggaaacaauuuggggaacauucuguauuccaucccacuuucaggaaauucauaauucucauuauaaagucuaacaaaaaucuaucuaguuauuuuggccaaaaaaaaauuucuuuuucucagauaaacgucacuggacaccagcuuuucaugagauauaauuugaaaaauggaguucuugacucugugucuauagcugaaggaccaguuuucucagcguuguucugagagcugcagccuuuucaagaagcucaguucagccuguguccgguccuccucuacacuuuguuauugucagugcacuuuacaaagcacuagcuccauauggaagugaagcaggauauuuccccgagccuuucauggaacuugcaaccgggugccucauuugcccagcucacagccgucaacuccuugcaggaaagagcaugaaaugaacgaggugagaacuggagugcgcaaacacuggaaccaacuggcugcuucagcgcaggcaggagccagcuccacucacucggauccgcugugcuccaccacucaugggaaggagcacacggguaaguggaggcaggagccgagagccagugcuuuugggcaccagcaggagcaaacuucaugcaggccccguggcagagucuggcgugaugcccaugaccccugaagcuccagagggaguguuacagugcucuuuuagcucugccauccguggacggcuugaguguuaacagcugagucgucccucugccuacucacaugagguggcugcccuccagcaggggcacagggcaagugugacagccuuuuuuauccacacuagugguauccaggcucuugccuggaauucaggagaaaugaggucauaugaacaaccugaaggauggcaacugucggggauuuuaccgccaauggaaguggcuuucaguuggaaggggagcugaaaagcaaauggaaugggaagguaaucuuccccugacgucuggccaucucuggccagauucuucuccaaaguuaugcugucaagcucucccucugaagucaagccacuucucuccaacauccagccacagucucugauguccagcugcuucaccucucucugcugguugaguaugagguuuuuauaggcacaggauggggcagggccacacaugguuuuggaaaaggaaauauuugagccagaaacagagauguaaguucucacuuuggacuguguucccaggcuugagggugggguuuuguuggggauccacccuuuucugccuagaauuucucugccuccugucccuaucagaaggagaacguccagggcauucacaucccuggcgaauuggaacacggaccucaggucuucccuuuaucccugcugccauguguucaggauuaaugcaggacuuagaccacauggacucaagaacccggaaauuuaaaaaacaagaagaaaacagaaaauccagaauuacaggagacuguuucagagcuuuucucuguauauuguggaacacauuaccccacauauuuuacacauugacauuuucacuuuagucagaagcuauuaauaacaaaaguuucaauacaugaaagaaaauagaauaugagaccaguaaugccaucucuagaagaugggauccagggagaaucuaagcuccccuauuucuagaagaguacagagaaagcagaaccguggauuaccugcuccugcugcugccucacaaacagaugacggguguuagugaaauguuugugcuuaggauggaaaacauaauuuaguuuaugguagcgaauaaauauuaggggggaguccaagccugauauggucaugauaugauagcuggaauagcuggaaggauggagaagaccaagagaugaguccaggaggcggacaaugguggugccaaugggaaacaaaagaagaguggaauugagcaugcagaugagaggcuggggcuugcccgggcacccagagccccuccaggauggcuggcugggaagugaauuggagucauuguuucacuaccaguaacgacuaccaauaaacuagugucacaaugaccuaaauaagaauucccacauccagcuuggguaaaaauguaggauggugguagcauauaguuggucaggguacaauauugucuaacaguagucuucgaaagcuguaacaaaauacauaguuuuugacacaagaauuccacuuugggacuuauuuuaagaaaauuaauuagggaccuaugcaaagauauguuacaaggcuguucauuuuaacauaguaauauagauuuuugaugaaauaugauuuucacauuaacauuuauggggcauaaguguauuuauuuguuuugaaaguuuuauguugcauuuuguuauaugaaguaacaagauuuuguguaaaaucuuauuuugugucccuuaacaguggggguauguucugagaaaugcaucauuagguaauuucaucuuuguauggacaucauagaauguacuuaaacccagaugguauauccugcuacacagcuaggcuauaugguauagccuauugcuccuagguuauaaaccuguacaguguguugcuguacuggauaccuuaggcaacuguaacacaaugguaaguguuuguauaucuaaacauagaaaaaauacaguaaaaauuaauauaaaagauaaaaaaaaagcacaccuauauagggcacuuaacaaaaauggagcuugcaggacuggaaguugcucugagugagucagugaguggugacaggaugugaacaccuagggcaucaccgcacacuacuguagaugccagaagcacuggacacuuaggccacacuaaauauauagaaaacuuuucucuuugauaauuaaccuuagcuuauuauaaauuuuuacuuuauaaauuuuaauuauuuuuuacucuuuuaucacacuuagcuugaaacacaaacagccguacaaaaauauuuucuuucuuuauauccuuaccuuaagauuuuuaaauauuuuuucaaucuuuaauuuuuuauuuuuacuuuuuaaacuuuuuuguuaaaaacuaagacccaaacacacacaguagccuaggccuauaaaggguuagggucacuacugcugucuuccaccucuacaccuugucccacugggacguucucaggggcacugacacccauggagcugcugucuacugugauaacaaugccugcuucuggaauggcuccugaaggaccugcuuaaggcucuuuuuaaagaugugucacucuuuucagaaauauguuuaugaaguuuugcuggguuucuuucuuucuuuaaucauagauuuucuuaucaguagacaaugcacuaugaacauuccucuaugaacgaaccauucaguuuugggguccacguuuuuaaacuuuuuaaggaguuuguugaggucuguaaaaacuucuaaaccuuucacugugaauuuccuuggggguuuuccuuuucuucuccugcaguuuccuuuucuguugccucuucuucagcuauauguucuauuccaacaacuccucauuagucaauuucucaagaaccuccaggagcuccucgaugucauccucauccacacccacguucaaguugucugccaguucaaccaccaccuuguugauuuuuccaaccugcucauccugagcaaaucauuugaagucauugaugaaccucuugaguaucuucuuccagcugccauuuauacacuccuuagugacaccaccccaagcccaagcaagauucuuggugcagucagagaugucguaauccuuccagaauugcauugguaucuuuuauuuuuuuauuuuauuuuuuuuauuauuuuuuuuuuuugcagcagcagccuggguaaaaguccuucucagguaauaggccuuaaaaagugcuuuaaugccuugaugcaaugguugaaucaaagaggugguguuuggagggaaaaacauuacuuugauauugggauggagaucaccaauaaaaggagcaugugugggaccaucaccaacaauaagcaaauccugaaagguauguuauucuccaauaguacuucucauuuugcuggcauaguaauucagaagggcgucuuggaaaggagcugggucauccaugacuucuuauggcuccucuaguuuaccagcagugcguguuuagugauaugcuuggagacccuggggucgucacugugccauaucauuaaaaguuucuauuuguagccugcaacauuucuccaaagugagaugguuauucuguccuuaaaaaccugacauccagcauugacuuggcccccuuagggauaauagugcuuuaaggcauugguuuccagaauacagagguuuccuucauacugaagauuugcucugacaaguaauucccccucacaaucaacuuaucacuaaucaacugaaaacuagaguuuucagaaauucuucagcugucuucacaucagcacuugcagacucaccacuuacuuucacauaacguaaugaaaaacaguucuugaaucauuuaaaccacccagagcuagcaguaaauucaacauuguaguuggguccagccuuuucuuucaacauugcgaacaaacuucuugcuuggcugugaucaucauggugcugggaggaauucacuucugugacuggucuucauuccaggucauuagaaguuucuccauaucugauauaggcucuuccugaacuguuguuagucucauugccuucaaugaagaagaucuuuucagcuuccaucauuuuguucucauucuuugagaucauggcuaugguggaaugggacagaccugacuggugagcaauaaccauuacugauuuuccaucuuuguaccucuuauucacuuuuaauuuagcuuucaggucaaucacaggacagggccucuuucugacacauuagccaugaauuuugaugauuaaggaccgugaugaauaaaauaauguguaauuaaauuaagcacaaaagaacaugauacagucaagagacacaguaaacaugggauguaugaggcugcugcuggcauaacacugaauacgguuuuacagcaaaccuaaaaagaaguacaaggaauacaccuuaaaauaacaauuaaaguauagcauaguaaauacauaaaccaguaacauaguugauuuucauuaucaagcauuauauacugcuuguaauuguaugugauaugcuuuuauaugacuggaagcacaguggguuuguuuacaccagcaucaccacacacacaugaguaauguggugggcuacagcuacgacagcugggacaucacuagguguuaagaauuuuucaguuccauuguagucuccugagaccaccgucacacgugugccuuguaguugaccgaaauguuguuaugcagcacaugacuguacuugaaagcacaaacaaaggaaaggucuaaccgacuaacgcuggaaauguuauuagucuucuuuagguaguauauuucgggugauuuuugauaucucauuucugauuguuuugcuaaagguaauauuucucuuuugucugaguuuucugcuuucguccuacagcuaaaauaaauuaguuacuuuaaggaaaaauaaggucuauaaaaagagguaguguuaugacauacucaugagaauggcucaaaugauauagauacacuauuaagugcugagaagcauacagaguaaugagaacucuaauauucucauccucugcugauagugauguaaacuguuagaauacacaaagacauggaaucaaccuaaaugcccaucaauaauagacugacuaaggaaaaugugguacauauacaccauggaauacuaugcagccguacaaaagaaugaggucauguccucuguaggaacaugaauggagcuggaggccauuauucuuagcaaacuaacacaggaacagaaaaccaaauacugcauguucucacuuauaagugggagcuaaaugaugugaacacauggacagacagagggaaacacacacuggggccucucagaggguggaggaugggaggagggagaggaucaggaaaaauaacuaauggguacuaaggugaugaaauaccucggugaugaaauaaucuguacaacaaacccauggcacaaguuaccuauguagcaaaccucugcccuuguaucccuaaacuuaaaauagaaguuuaaaaauaagaggaaggaaaagaauauauauucaccacaagacauauucaagaauguuucuaguggcaguauuugaauuucuuccaaacuagaagcaacccaaauauccaucuacgguaaaauaggagacaauuuguaauauacucacauacacaguaaugagaaugaacuauacuaucuucugcauaggugaaucugucaaauuuaauauuaagcaaaacaggcuagacacaaaacaguauaucuaauacucuuaaauuaagaguuaaacuucauaaacaggaaaauacaccuauaguuucagaagucagaauagugguuacuuggugggguagguuucagaaaggguuauaagggguucauuggggcacagguaaaaauuuggucuggauuuugguuaugcaguggcaucuacuuugugaaaagcaaucaaacuuugcaucuacaacucuuacacauaccucuguaaauauuauacuuuaaucaaugugacuuugugaaaauaauugguuucagguuggagauaggagcuagaacuaugggccaccuggcacguacuguaugggagagagguaaauaacuuacaagggcauugcaguguauugauuaagagcaguggguuuagagccagauaaaacuagauuagauucccuguuuucuugcuucuagccacguagcaagaggaagagugagagaggaggccggauacaggcagggccagaccaugaaagacccuguaaagucaagauaaggauuuugguuuucacuguguggugggaagccauuucuauuuacagaguagauucaaagagauuuccuaggaauaaaagaagaaaaggaacuguacuggaccgauagagaagaacaacaacaauaacaucuccgaaugcuucguuuuggcugcugcaaaauaagcagccaaaugugcuuauuuugaaggcgaaaaaaaggcugaacugaauuccuaggauaagucucaaaauuguggcagaaaaaccaaaagaaugcaaggagagcaagacuccacaaucuugaggcagauuuuugagacagauuuuucucuuuauguaagaccuugcauaccucacagcagcuuuagaaguaggugaaauguuauuuggggcuacgaggaaacagcguucucuucuucacucuuccugucagccagagaugaaacaaacaaaccaccaccaacaaaaacucuuaauucuuaggggcgagaugaacaauuuaauccauccgucuugacuauacguucuaucacuuuuuaauacaaauacaaaaacaggauuagaauccugauagucacacugggagaacugagagaaaaccaguaucugcuguuuaagccaucuagucuaugguacuuagugauggaagccauaacaaaauaaugcacuaguugacaugaaaaauuucuauuaauuuaguacucuguuaaugucuugugguuaaacacguuuuacuacacagaaaauugaacuuuguuuuuauuuuccagagagcuuaacaaagugacuuacacaaaguacauauucagcaaauguugguacaaagaauuaaugaguuauagaauggauaaauaaguaaauaaaugaaccaauuccacauuuagaaauuaaagggcuuuaaaagcuaaauauuaggugguggauauauuaauuugcuggacuacaguaauuauuucacuauguauguauauaugaaaacaucauguucuauaccuuaaauauauacaauaaaaauucauucauuuacacaaaagcuaaacugcauuuguaguaauaauugcaaacaguaugcaaacugguaauuucaggauacuacuucgugaggaaacauaacugaaaacaauuugcuacaggcagaaauuguuuggccacguugcuuuuagcaaguaagauguccauguggaaucugaagaaaaucaagaacuaggucuuucaucauagauaaugucaucuuuuaugugaagagaagucauaaacucuguucuuugaccaauucuacuuauccaaagaggaaacaaguuuugguguucugauuuuuagauuacaucacgcucuucacagucaauuccuuaaaccaaugggaguucauuuaucuuuuucuaacaacuuugcaaggacaggguuacauacagagccacaugcaaggaucuuuaaaacagaaacauucagcugggcacgguggcuuacgccuguaaucccagcacguugggaggccaaggcggguggaucacgaggucaaggguuggagaccagccuggccaaaauggugaaacccgucccuacgaaaauuacaaaaauuagccgggcgugguugugggcaccuguaaucccagcugcucaggaggcugaggcaggagaaucacuugaacccgggaaguggagguugcagugagccgagaacgcgccacugcacuccagccugggcgacagagcgagacucggucucaaaaacaaacaaacaaacaaacaaacaaaccagaaacauccagugagacaaaaaaaaucacgcucuaaaacuaaguaacuuucuguuuucugcaaacuaaaguaugucauagaacuuuuaagaaauacaauaaaaaaauuggaguuauauucaaaucaauguagucugucggcuuucguugguuguauuaauuugcuagauaguuugagaugaucaaauggcagaggccaauagcuagccuguagagaugucacugaaauuuugcagaccaccccaccuuucuaauuuaauaaguguacuagcccaaaggaauggaagacacagaaauaaugaacuauuaagcuagcaaguuaucaccaguaggaauaauuccuacaaccaaauucuuaagguaagaaguguucaucacucacucgcacccauacaagaauaccaucugcuaccugaugguaucacuugucucuuugcaaaaagaagccuuuagggaugggaggccugauguucuagucuaauuauaaguuagauaauuauaucuugcuuagcuacauuucccaaguaguuuuaucugaauuuccugccuaaccccuacaccuuaauuuuauuuccuacucuaacucuugccaagagcugcaaugcacuguuaaucagcuccuugauuugguagcagauguagggacugugccaucccaucauagucuaaaugauuccugaauacauugggacauugcccuucaggcugugauagagauggagaaccugaaacaugguuuguaaagggcaaaggauccuugagguggagaggguacuuacugggcaaaguguguaauguugcaucuacauuaugucagaucgggaggguuuguguuuuugauuaauaugugugccaucuugguauuauaggaaauaaguuaaaaagugguauuaaauguucuaagaaaggagugauuggccuuucuugcaaaccuuaaagaaaaccaagacucagagguaucuccugagaguuuaggaugauagacuacuuaaggagagguccuugguaauuuuauuagagacaaaggaagggcaaauggcuuugaugacugcaaucuaacucaaaguuucuacuagguagggcuacgucauggugcaggcuguagaauagcuaguacuuauaucaagaagcaaugggccaggcgccguggcucacgccuauaaucccagcacuuugggaggccgaggugggcagaucacgaggucaggaguucaagaacagccugaccaacauggugaaaccccgucucuacuaaaaauacaaaaauuagccaggcguaguggcacacaccuguaaucccagcuacuuaggaggcuguggcaggagacucacuugaacccagcaggcaggggucguagugagccgaggucaugccacugcacuccagccugggugacagagcaagacuccgucuaaaaaaaaaaaaaaaagaagaagaagaagcaauuagcagagaaaagagcugaauuuggaaaucagaacagaggaauuuucuccaaagccuugucgaggcauacaacagguacuacugaaauaccacuacuaaauuguacuacccaugaguucagugaagguucguuagacagcacagacuguggcucaaagagggagcugagcuucacuggauugggcuaaacacuucauuagccaaauuugauuuucagaaauaaaaaugcaccgcuuaaaauuaaaauucaagaauuuuagaaaagaagaauuacaaaaaaaaaugacacggcauucucuaaaaaguacaccaaauauucgauggaaauauuuggauuuuugagacaaaauaaaacacugaaguuaggggcuggguuaacuggaggauuauaucuacuacaugacuggaagaggagggaagugcauauuauagguaaagggcccaggaaagauagguacaucauggagaaauagguuuucaauagccauaggcaggacagcagccccuugcaaacagaagucuggguauaaguaauuauaucuuaauguguguguuuguuggguuggugggugugcaauaggggggcaugagaauucugacagaggaagaguaugcugugauuucaucugccccauauccccauaucucccuuaacaaagaccucaacaaaauauauuuuuagggccaauauuaggcauaaugugauuucagaggcuaaccagucuccuaccaucuuacuucucuuuaagcaaaggcuguuugaaaugucuuuaguagaagauuaaaucuuuaauaggccuugucuuuaacuggccuuaagggaccaggucuuauuuuuuaaccucucauagaaguuagcuuagugccuuaaagagagcagaugaucaauaugcaccaguucagagaaugaaugagugaauggccaauuucaaaauggaauaugaaggguacuaaaugcaaaaccauacgcacgaggugaugucacuagacuuaaauguuuuuauacuaaaauuuaguuagaaaacaaauccaaugcaucuggugucagagucuuucuggccuauuauagggaagaauuuaaagcgagacaagggagcacugggucuccugugaaauugggaagggugaggaagaagggaaagauauguagaccuugggcuaagaguaaucugaaaaucagagugccaaaaucuuuuucucuauggauaaguggaguugcucagaaaacuguaggaggaaaagguuguaggaagcagcaggaagagaagguucuacauugaaaggaaaaggguacaaaggaauacauugaaaaagucagucuucucugaacaaucuuguuaagaguuagcuuuauuuaucaaaacaguuugugucuacauuaaagcuguuuuuaggaguuugucuuguguugagcaaaauggcauaacucacaucaccacugcuuugcacagcucuuaaauagauaugcauauuuuucacacgaguggcauagcuauaaagaaucuagaucccaauguaauaauuaaguaucaguuugcauucugaggacauccaggugggcuuuugagagaacuaaugaaucagaggauaggaaauuauuaugaauauuugcaaacacugagaaaauauuuaugcuuuguuauuuuguuuuccaccucauuucuguuucuuuguuauucuuucaaaacaaucucuuaggggaaaaaggcaguaugcaaauacagcaucgagugauguuuuauguuacaucaccucauuaggcaacauccgguaagguuucaggaguucuuuaaaauaaaaucuauucuguuuucuucuucuccuucccagggguaaaucuacugucaauauuaaacaaauuuaauauauguggcuauaaauuaauuguauuacucucuagucacucccauuuguauuucuucucucuuaucuuccuuuguauuauuacaugauagcuuuccaguagaacuccaugcaacacacauggcuugauuuuaguauuuuuaacaauaaugcacagauagauaauaagguuuauccaccccagugguuuccucuauguugguaguauuuauuaucacaacaguuuccagggagaaaaugguuuaauaugucguaagacguuucugcugagcauguguuucuauaucuucacagucaauuucaaauugaaaucucuaauaugaagaaaaugaucaaaauaucuauaaaagcuaccaagaaauaaaguacuccaucugcauauuccauuugaucuccauggggagcaaaaauucaaguuuccugacaaugaauuccaacaucucaaucaucaucauuuuuccccuucuuagaaaugagaaaagauugaggauuuaguuuuauagaggccacaucuucugaguccacccagauuuuccuuuccuuugucuuuucuacucuuuggaaaggaaauucaguuaucugugugccauaauauaguguuaaaaaacuuuuugccacagagauguaggauuggaaaacauuuaagcaaucaucucuguugucuuacaucgucagugcuggguugaggggggccucccugaagaguuccaaaaauaagauugugccuugugaguuaaacuaaaauaucaacacucaguggaaagaugggaacaaaauuaccacaaagagaacuaaauagcucccaggccagcaagaccccacuguagccugauugaguacauuaacagaacuauagaaaaaacaaagggucagugggaagcuggaggggaaagcacaguaaacaagaucaaguuugugcauagccaucggcagccuaggagaaagggcuccacaguccaaagaugaccuguuacccugaacuugcaauccuaucauuuacuccucuuguuccaauuccaagcccaagaagcaagcaucugauuuuaauuuggcuucccaucugguagcccugcagggggagauuuggcgggguagagaacagaaguguccaguccuuucagcaauacacuuuuucauuacaaauuaauacacuggcauccuaguuuacaauuuggcucuccauauaccuuacccacacagugugguggccagacccuccucucccuuuagcaguuagucuucuuguuuuaaguuaauuuaauggcauuuugauuauggauuucagucucacagacugugauuaugcuugugauugaacuagagucuguggauaagucaaguuuugcccaaagaaucugacuuagguuuguggaaaauucauuaagguaaggucggcuaucuuuuuuuuuuuuuuuuuuugggacggagucucgcucugucucccaggcuggagugcaguggcgggaucucggcucacugcaagcuccgccucccggguucacgccauucuccugccucagccucccaaguagcugggaccacaggcgcccgccacuacgcccggcuaauuuuuuguauuuuuuaguagagacgggguuucaccauuuuugccgggauggucucgaucuccugaccucgugauccgcccgccucggccucccaaagugcugggauuacaggcgugagccaccgcgcccggccaggucggcuaucuuaagagacagcguuggaaacuucaccucauauaauuucagcuacuagaauuugaggcagcaagucaaguuucuuuuccuuucagugaaacuucuaaacccgauacucaggcaaauauuucauuuacacuaugcuaagaaguugcuucagauaaaaucucugcuaaauccuuucuaauacaagugaaggccaaugucuucauuaaucuacuuucucauuaaaaauaacauuuucaaggcaguuaacauuauuuuuaagggcuuguuuuauauaccuuuauccuacauauauaaccccaauuauauuuuuccuccucaaauuauucauucuuuuuucuauuccucugaaucaugccugcacauauuuuauauaucuuacuggaauugcuuuguuucuauauuaaggugaaacuagaaacaggauaacagcaauguugaauugauggaaaaaaacaguucuuaaaaauauugguuacauauuuccacaacauucucaccucagaucauuuuuuaaaauuuacauuuagucuauguuaccuuagaucuuuaucucccauauuucaccgaagccaaccccucccauugaauuuguaucugcucuugguaaauuacucugguuucagcuguaugacauuacacuucauuuuuauuuuuuucugccucugucacuuuuaaucuuggauucacuuguaguuaauuuagugaugacagucaacuuuuaguuaccuacagccugauuauucuccccacauauguuauuuucaaauuuaauagcaaacaccuauagcauauaaguaaucugauuuguuugcuuuucaaauaagcucuguguauuguuauuuucaagaagucugccccacauaguauagaaguucaucagagcuaaaugucucacuucagggacauuuugaguagaagaauugugcuugaguaguuucuuuuugaaaccacgaguguguguuugugaguguguguguguuauuuauauauuuaaaccacacacacagacacaucauguuauguucccacacagagacauaggcacugauacauccuccauugggugacuucagauauacacaggcauucucauuucauugugcuucacagaucauaugcuuuauuauaaauugaaggcuuguggcaacccugcuucgaguaaaucuauuggcaucggguuuuuuuguuguuguuuguuuuuucaauggcaugcucucacuuugugucucucugucacacucugguaauucuuucaaaauuuaaaauuuuucauuauuauuacaucuguuauggugaucugugaucagugaucuuugacguuacuauugucauuguuuuggagugccauuaacugugcccauagaagaugacaaacuuaauugauaauuaugugaguucugacugcucuacugaccagcugaucccucaucuuuugccuucuccucaggccuucuuauuccuugagacaaaauaauauugaaauuagcccuguucauaaccauaagauggccucuaaguauucgagugaaagaaagucacacaucgcucaauuuaaaucaaaagcuagacaucauuaagcuuagugaggaagacaugucgaaagccaagauaggcuggaagcuaacccucuugcgccaaacagcuagcaaaguugugaaugcaaagaaaagauucucaaaggcaauugaaagugcuacuccagugaacagaugaaagauagaaaagugaaacagcuuuauugcugauauggagaaaguuuuaguggucugcauagaaccaaccacaacauucccuuaagccauagccuaauccagagcaaggcccuaacucucuucaguuauaugaaggcucagaaaggugagaagucugcagaagaaaaauuugaagcuaccagagguugguucaugagauuuaggaaagaagccuucuucguaaugugagagugcaaagugaaacagcaaaugcugauauagaagcuacagcaaguuaccuagaaguuccagcuaagguaauugaugaagguggcuacacuaaacaacagauuuucaaucuagaugaaacaucuuucuauuggaagaggaugccaucuaggacacucacagcuaaagaggaaaagugaacgcuuggcuucaaaccuucaaaggacagccccuuauuaggggcuaaugcagcagguuacuugaagaugaagccagugcucauuuacuuuugcaaaaauccuaggauccuuaagaguucuguuaacucuacacugccugugcucuagaaauggaacaacaaagcuuggaggacagcacaucuguuuacaacuuuaacagguuuacugaauacuuuaagcccauugagaguuacugcccagaaaaaauaauaaauauuccuuucaaaauauuacugcucauugacaaugcaccugguuaggcaagagcccucauggagaugaacaagauuaauguuuuuucaugccugcuaauacaacaugaauucuauugcccauggacaaaggaguaauuuugacuuucaaguuauauuauuuaaaaaauaggcugggcgcgguggcucacgccuguaaucccagcacuuugggaggccaagaugggcggaucaccugaggucaggaguucgagaccagcauggcaaacacgauaaaaccccaucucuaauaaaaauacaaacauuagcuaagcgugguggcaugugucuguaaucccagcuacucaggaggcugaggcaggagaauugcuugaauccaggaggcggaggaugcagugagccaagauugugccacugcacuccagccugggugacagagugagacucugccuugaaaaaagaaaaaagaaaaagaaauaugggccaggcaugguagcucacgucuguaaucccagcacuuugggaggcccaggcggguggaucaccugaggucagaagagaucagccuggccaacauggugaaacccugucucuacuaaaaauacaaaaauuagccgggcauggugacgggcaccuguaaucccagcuauuugggaggcugaggcaggagaauugcuugauccugggagguggagguugcagcagugagccaagaucacaccacugcacuccagccugggcgacagagugagacucagucucaaaaaaaaaaaaaaaaaaaaaaagaaauauauuuugcuaggcuauagcugccauggauagugauuucuuugauggaucugaguaaacuacauugaaaaccuccugguaaggauuugccauccuagaagccauuaaaaacauucaugggaggaaaucaacauauuagcaauaaaaggaguuugaaagaaguugauuccaaacaucaugagugaguuugagagguucaaaacuucaguggagcaagucacugcgaauguaauagaaauaacaaaagaauuagcauuagaaauggagucugaagauguaacugaauugcugcaaucucaugauaaaacuuuaauggaugaguuguuucuuauggcuaaacaaagaaagugguuuauucccagacuggaaggaaaaagaauaagaaauugcucagggauagaaggaggagacaaaucauugccauugauuaucuuauaccuucgucaucagguuuagaauauauuuuuggauauugcuaacaccuauauuuaaacaauuauuuuagaacauuccgaugccaaaaaaguauauuauaauuuuuuacuauauuaaucuaccuuuuggccaucuuuuauuaguuuggagaacauuugucuaguuauuccaaaauucaagucauuugugaaaaucuaagagaccuauguagcauaaccagcauuuaggagguacacacuuuuucucggcuuugguugauaccauuucauuaagauuucuuauauuuacauuagaaccuuauaaauuguucucccaguucucuuuaugcaaauuuauaacugugauuaauggagcagaaaccuguuuguccucguuuacauauuaagcuucuuuugguauacuucaacgucucauaauguugauccucuuaauuuugcugccuugauuaccucaccauuuugagauuuugaaauaaaaacaaaauaaaauauguuugguuucuagguaggcuuaaauaucugccuucuaaagagaaagauuaauugauuuuaacauuugagccaacuaaaguaacaugaguuuauaaaauuuaugaaauacuaaauauagccaacaggcuggcugaacagaccugcagaguggacuguuuguucuaguugcuguugcuguccaccagggccuugccuuccugcgcaggaccucccuccccucugcuuauacacccagugcccuccuuucugcuccucagcgugguuccuccccuagugccucuuccucuagucugcucucccuccuacuuacaaaaucgaacugagggugauuucauauuuuuguuuguuuguuuuugacaggaagcaagucccuacccuaauggaguaagucucaauaucucugauaguugaauuucaugucuguaucaguguccugcuguucauccccccaggugcugcccaccgggcucugccaagcuggugauuucugaucuuucucguuuuaacaggaucucggagaacucuaucaaaagcaaauuuauaagguaagaaugaaacacuggaugugucacuuguguuaggcuuagacauaagaguuucuucugaaaagaucaaaaaaagaagaagaagaagaaagaaagaaaacaucaacauuucguuuccauaucuuaugucugaaaagaaggggauaaccuuuuacagcauuuuucuauuuaaucaauauacaauucauauguucuauuugaaauaccuugauauuaaaaacaugaaagucaaaugcucuguagagagaggcauguuuuuuucguuucuuucacaucaaauguuuuucaauaucauuucaaacaaauuguuauauaaaccauauuuuuuaauauacuugucagggccaauaguggauauugaaaaaacauaaaaagguaggauuuuucagaaagaaguuugugcagcucuuauaaaugucucuuuuggccuacuacuuaacaaaacaacaaaaaaauaaaguuugggucuuuaacuaugcuggaagcccauauuaauguuucaauauaagaaauuaaaaauuccccaacugauuaacuuauuagguugccucauucucuuucuuccuuccuuucccucccuuccuuucuuucucuuuccuuucuuccccccuuccuuccuuucuaacuucuugagguagaaaauauauagagucuagagguacauaaaccuagauuuuaaucuugguuuggacucucagcacgguauuuacuguuuuuccuugggugaauuaauuaacccuucuaaaguuauguuuccucagauauaaaauagaaauuccgauauacaacucacagagauuuggggcggaaugagccaauauauauaaaaugcccaggugaaccuuuaauaaauacuacugcuauuuccucucccuucauuuauaucaugaucuaauuuggagauaauuauuaagcauuaguuaucuagauauauagaugacaauauauuuuuaagccugaauuucagguccaauaccaagagagaaaaaauaccugagcauguuuuuauagagauuuuaagauacgggaugaaggucauaauggcuguggcauuccuagucagcuaacacucugcaacauuauucauuguccuauaaaaacuauuuacccagccacugguguugguaaauuguaagcaaacaauagguaauagaauccaacuuccaucaguguuacuaguauuucagagaagucuuaucauucauuggugggaaaauacuagcucgggaaagauacagucucugaaauaaaauuuauggauuauuuuauucauaggugcuucuguaaggaugaguuucuucaaccguauuucucugagcaucuuuaacauuaccuuuaugaugcaugguaguggaacuugauucaacuguaaguuagaaaacauugcagaggaauguugauggcaagauagggcuacauugcagcuuuccgaagguuguagaaagaggauguuuguauuuggcucaauggaggugcuucccuuuagauaagagaaugaggaguuaauggacacaugccauauucauuaaaauguggaaugaagccaucuuuucugagccaacuuuucugaaacaacacagagaaaaggagucuuugucuuuugacuuaucucccugaguugaucuacuugauucucucaaauugccauuguucuaacuuuguuuggcaauuugacacucaaccaaacuguaucuucauuagaaaugaaaagauaggacaauggaagaucccuccauaccuguaauagguggaucucaccugacuaugcugaccuagagaggcauaugugauacaaaugagggaauaaaucauugcuauucuagaaauagauuuaucaguaguucauauuaaaagucaucuuuguugacugugauggucgguuuuaucugucaacuuagcuacgggguccaguuauucaaaaaaacacucuuccagguguugcugcauaggcauuuuguaaauguaauuacaguuuaaguaaaagagcauauucuagauaaucuggaugggccugauucaaucaguugaaaggccuuaagaauagagcugagacuuccuugaagaagaacuaccuccuguggacaucagcuucaguuugugucuggcaguuccagccuuuccuuccugauagugugccccagcuuccgacuugccuugccaggccccgcuguugcauaagccaauuccuugcaauaaaucucuaaauauaucuucuacuuguucuguuucuccgguugaaccugaacugauaucccagcuaauaguacucugagacccuauuuucucccauuccuaagccuuccucaucuuuccuccaaauauaaccucuucaaacaggggaggcagaauuaccuaaugcaaaauacacauaucaaaauguuuggaagucauuaugaauucuaaauuuauucagucuuuuauccaugauggacauacuaguuaagauuuuuucaguauuuauaagucuuauacaaaaugauuuuauugucaucauaaaaaaaauuucacucuauauuuuaaggcaaaugcuauuuaaaaguccaguaaacaacucagggguuggggcaccaacccccugugcaguaaaaauugaccuacaucuuugacuccccacaaacuuaacuaccaauagccuacuguugacuagaaaccuuacagauaacauaaacagccaauuaacacacauuuuauauguuauauauauuauauucuguauccuuacaauaaaguaagcuagagaaaagaaaauguuauuaagaaaauuaaaaggaagagaacauacguuuacuaaucaugaagcauaagugggucauuauaaaagucuucauccucauaucuucauguugaguaggcugaggaggaggaggaagaggagggguuggucuugcugucucagaggugguagagacagaagaaauccacauguaagcagacccucacaguuuaaacucauguuguugaagggucaacuguauuauuuuuacccucauuguauucucauagcacccagcuaaauauuuuauacucaauaaauguuugcagaaugaauaacugagcaauaucuuaguaauacuuuagguauuuccaagagaaguuuauuguaaaacucugaugcuuuuuuucaguaucuuguuuaggggagguauuuucaaaaauaauuuacgauuagguuuaucaggugaugaauuaaguuuaucuucauuuuacgauguaauuaaaguggauaauuuuaaggaaaauauaugaacuggaaaaaauuacgauuuaaugucaguagaaaagacuaucagauuaacuucauuccaguuuuguuucugugaaaguauguacagauggaagcaaaaacuagagaguaauauucauaaagauaaauaauaaaauugucaguacuuuuuaaaaauuuucuccuuaaauuuuguuacauuauuuuauccuucacaaaguuuaaaguacauuuuuuuuuaucuauccaaucuuuuuagaagacuuuuuaugauuaucccuuuuuuuauucagaauggcagaguaaguaguauggaauuuugaaaaauaguccaaaaguaguuuuuuaauuuuuugaauuggauaauagccguuucuucauuuuuacaaucuuuuauaauauaauaaacuaaaaugcaaauuuuaaaaacuuggcuuuauggucuuuuaauauauugaaguuuaguuuaaaugcaacucuauaaacucauacuucucauaaauuaggacaaauccguucauuaagaugugaucaucuucaaagaaaauucagcuuugguguaauuucuaaguugcucucauuuuaauauauaaucuuuguuuaaaaaagauuaacagcagugugguaucccgucugaaaacuuaagaaaacauauagccagauaacuacaaggagaaauaaacaugaaacccauaauucucaugcagucuuugcauuuucacuuugcuuuaugauuauucuauacuagaauaaguauuuauuugaacauggcuuuucagaaucaaaagguuagagucuaccuuaaacagaaagacaugagaaggcagauuuucaagcucuacagagugacuggauaaccucacagaguuuccauuucauccuuauauuuguuauuuuaaagacuaagcuacauacaaaaucaaagucucaccucaaagcucaagucugccacuugaaaggcacuagcaguacccuuuuaguacaacucgagcuacccuuaauaaaauuuaccuuaagauuaauuuauuaaucagaaauacuggaacugaccaaaggucacuugguaaauagcauuucuaaucaugcacacaaaaaagaaaaugacaagagggaaaacguucuuucauagugguugaagagaugaggguggguacaauuccugccgggauuaguucuauacucacuuugguggccaagcauugacuucuccauguucacaguuucuucagugugucagaaagguuuuuaauaggauagauauacauuugaaacucaguuuuuccacuuccagcaaugauggcugauaugguuuggcuguguccacacccaaaucucaucuugaacuguagcucccacaauucccacguguugugggagggaccuggugggagguaauugaaucacgggggcaggucuuuccugugcuacucucaugauagugaauaagucucacaagaucugaugguuuuauaaaggcgaguuucucugagcaagcucucuugucugccgccaugugagacaugucuuucacuuuccaucaugauugugaggccuccucagccauguggaacugugaguccauuaaaacucuuucuuuuguaaauugcccagucucagguaugucuuuaucagcagcgugaaaaugaacuaauaugguagccuucaguaaguuuauuccucugaguccuauuuugcaaaacagagauaauaaaaucuacuuugcguaacuuugagaguuaaaugagauaaaugucuagaaugguauuguucaagacauuuaaugagaacuucugcccuugucuuuagcucccuucuugaaacagguguccuuguucuuuaccaaagcaaauucuacacucuucuuucucuccugggaccuauuauuccuuuucugucuuacaucuuuaaucugaaccucuccaaugucuccuucucaguuuauaaauuuacuuacaacuccucaucccuaaaaauaucaaacauuuuuaaaccccuacucuugcuuugucaucugauuaagcagcuuuucuacauguagccauccucguaccaucaaccuuuugaaaacuuaccccugcucuuuccuuuccccaugcagucuucaguggcucaauccaccaaacuccacugacaugaaacuccagcagccucccaacagauaaugacaggggauggcuuccucucuaggaugucucaccauucaccauaccucaauuuucuugcuuuugcuuauuuuuuuacuugcuugccuguuuauuguuaaauacccaucucccuuagcuucccaauuauaggacuuuccuaaucugauucuuucuuccuacuguuuaauaacuuuucaguuccuuuagcuagcugcauccucuucuuuaguccccuuuuaaaauuaguguuuuucuaauuuauucacuaucuagguagaugucuagaagcugggcaugauggaagauacuaagauauggccccuguccucaaagaccuuguguuauuguaagaaagagcccauuaaaacaccagaaaacaaugaagagcaagaaaagccaugaauagcccauaaucaacugcuaagugauagagguuaggcccuaagugaaacagaaauucagaaaaaauggugaucaccguggguaagaauuguagaaaguuucauaaggaagcaaauaauuguaguaccaguauuuuuauuuuuuauuuuauuuuuuugcuuaccaguuaaucuguaaaagaaggguguccucuuacauugaaauuggccuuugaguggagucucucuuuaucucugacccucguuaaaaaaaaaaaagugaacuggccgggcgcgguggcucacgccuguaauccuaacacuuugggaggccaaggcgggcagauugccugagcucaggaguucuagaccagucugggcaacauggugaaacccugucucuacuaaaauacaaaaaaaaaagaaaaaaaauuagcugggcguggcagcaugcgccuguagucccagcuacucaggaggcugaggcaggagaaucacgaaucacuugaacccaggaggcugagguugcagugagccuagaucaugccacugcacuccagccuggugacagagugagauuccgucucaaaaaaaaaaaaaaagugaacauaauaacauuccauccacaaacaaauaaacaaaauuaguauuuuucuuuucuucugcguucuuuucuuucuccucccauuaccucucugagucaucuuaagaaggcauuacaacuauucaauaaguccacgugaucuuugcuccugaguacaugggaagauuguacuuuguccucuucuaaaguuaggcccagcaaaacaugugacuugcuuugguccauaaaauguacacacacacaacguguuacuuccuugcaggaguauuuaauugucugcgcuuagguuugcagccugcuccucccuugcuucagacaucaugcaggugccaugaaaccaaggcagcccaggaagcugaagcaauacaggaggcuuugcaugaggaaaaaaaaaauugguacauaauugagauaggucagucuugacuauauguuuucugaucuuucaauauaaauacaagaauggaaaacauuaggauucugaugauacucuuaguucuuccauuuuauuuuaguuguagaguauguuuaagaaaauuucaaggaagaaaaaauuuaauucauuaaucuuuugaugucaguuaaaaggauuuuacacuaugccaucagccaucacagaucacauaaaaaccuguauuccuagugccaucacuuugcauguuaaagcuaagugaccaccaauucuccaguuuuuucuuaauaaacaagguaagccuuagaacuguuggccaguuuuucaagucagaaacuugagucacccuugaauuuucuuccuccuguauauauaaguaaucacaacuccuguugauuccagcaucuaaacuuaaaaacaauaacagcaacaacaacaacaacaaacuuucucucaagucccagcuggccucccagacaugcaguccaugugcacucuggugcggacagacucuucccaccaccucugcuuccuccacuccaguauccauggaacagccagaacuucccuacuugaaaucauucuguuugccauucaaauaaaauccucaacauuagguagagacucugaauuaauuuccgguuuccauuuuucugccucucccaccuucaaguucacuacuccagccauucugacgccucucacuuccuucaaauuagugucucuugaucuccaucucugaaucauugaauaugcugacaucgcuaacccagaauccuucucucauuuuuuucuuaguuaacucauaugaaucuuucccauaucagcuuauaugucacacuuccugauacacaggcaaaacuaaaaaauauuuguugacuuauucuccuacucauuauuccaguugagguucucaucaacuccuauccauauuguugaaauaguugcuuacucuucucccugcaaucccucuguccccuucaauuacagugcccaucaugcagaugcuaguugucugaguaugaaacauuacucgauacaauuuucuaauuuuacccuuuaguuauuacuauccucguugcuugucucauuuaauuauaucacccaauuuuaauacaaugaguggguauaauaauuaaguaaauaaucuucugauuaauacacugauuagucacaauaaauuuuauuuacugaaaaaucuuuuauuggaauugauuuauccaugucgucuuaagaguuaaaugcugcagcuucuuauaaugcacagcauaacuugaaauucauuugcuugauagccgcaccaaaguuuagaauuucuugcuaaaaauagauuauauguuacaaugccagagucauguuuucuugucuuuucaaagccacuaaaucacaguuuaguaucauaaaguaugcugaauuuuacacagcuuacuuuauaggcaaaaauuguaagcauaauucaauuucaauagauacaaaaucuaauaguaaacuauccaaaaauauauauaauuuauauugcuucuuucaacaaaagaagcaguaaaaaguaucauucaugaaaacuagccaacacugaaaaauuaaaagaggaaaaacacuggaaaccaacaaaacagggcuaaauauagccagaaaaauagggaagauaacuuuuuaucucuacaauuaaauaaauauauauguaaggaaucaauacuucagcaaaaaaauucuuaacuagaaaguguaauaugauuuguaaaauaaauauaugacuacaauguauguaagauacacaaauaaacauuuuaauggcagcauaauaguucuuguccaaauacagagaaacauuuugguuaucuaaaaguauuaguauuguugacuaagacuacucaaguaggcucuaagggaacucccucagugcuugauuuaucuaauucaagauuuguuuuguuuuguuuguuuguuuugcgacagagucucgcucuaucgcccagguuggagugcaguggcaugauaccagcucacugcaaccucugccucccgaguucaagugauuuuccugugucagccucucaaguagcugggauuacaggugcaugccaccacacccagcuaauuuucuguauuuuuaguagagacggguuuucaccauguuggccaggcuggucuugaacuccugacuucaagugauccaccugccuuggccucccaaagugcugggauuacaggccugaaccaccccacccggccaaauucaaguucuuaugguacuuauuugagaaguagauuucacuguucacuaauuuagcccuucauaaguuaagguaauauuacauuuacaaauccggggauauaaauauaaaucauguagacauccauuuggaugaccauuaaugauuuuucucuguuuggguagaacuaauuuggugauucccaaauugguaugccucauucuaagcaggcuuuucuacguaaaauaaaauaacuuuuuauuuuuccauuucuguguauuuuguaaagcugaggacaacugaaguaacaguuacauugcgagaauggacaugaccauaaauacuggcaaaaucauuauuuuuaauuuguuuccauuuuuaaguuuuguaguaauaaaagagagcacauuacaaggcauguauuacuauccuuguaaaaauuggaagauacuaauaauggguaauuuuacauuuacuagcuaaugguaugguauaaaagaauauuuaucaaaauaaaaaugagguccauaugaauaucaacucuuuaucauaaguaucauuagaaacuauagagccccaaaugaacucuugagcguaaagcucuuaaaauaaaaaauaacauuuuaagcgcaaagcuauuacaaacucauuugauauucauuuuaauugcaaucacuauaaugaauauacuuuguauuugaacagaugucacaaguacuacuacagaaguucuaauauaauuucagucuuaguuaagaauaaguaaauggauauuuaaaauugaauguuaccaugaaggaggaaaaaaaaaucaauuacaguaaacauuagcuucuuuaaaacacaaauuaaagauuuuuauuaaauuguguucuuucuuguuuugacauaugcaaaauauaacaauacaaggaacuugcugucucaaccacuccuuuuccuugcgucagcuauucugcagauuaguaggccuggaaaaugaaaauugggaguguaaaaaaugacucagaaggguaagcugaaauucacuuuacgauauuuagagacugguauaucagaaggauuuaaaauuuuuauuaugccaauuuauuuuagcugaaggagguaacuauguaugccauuuuauuucaaugggucagacaagcccuaauauucccuuuaaucuucucccacaugaaggacuaacaccuuaaauuccaacaugagaaaccuucaugccauaaauuaaagacaguguuucucaaugugugauucacagaauuacccauggguguuuguuaaaagcaaauauucugaggccccaaccaagcucuaucaaagccugggaguaaggccauucaauccacauuuugacaagcaaccuaaaaauuuugaugcacacuccugcuuaaaccacugccccaagguugggugagguaacacuuaaagcuauauauuauucauuucauuugaaucagcaaacauuuguuaaguacaaauccuaugugaaccaaagauuugauauauauauagaauguccaaacaggcaagaagcuuaugagaaacugauuuuugaaguauuauuuauuauguacaauaauaaucuacaaaugaugggaaacccagugucuagaugucuagaaauacaaagaaagugauauauuuacuguucagauuaaaaguuuacucuugauuucaauuuagcaguuuuucucgugaaagggguaucuagagguuaaagaaaaaugucuucaucucauuauuaggaaaugcaacuaacagagugcuuaauaacaaguuuaucccauuuuuccugauguuuuguacauuuuauguuuuguaaaggagagugguuaugugugugaggcuucacgguggccgaggggaagagacaaggaaugucaaugagggggaaagaaagaugcugaacugcaagaccaggagcacuaaaggugaacuauuuucccaccucuagucuaauucuccugguaccucaaccguaaguugaacauauuuggaagccauacuguguuuuuuaauuaccagagcaaaauucaaaaacugaaagcugacuuuggaguuuaauacaagaaagaaagaaaauaaagaacauaaagcugagaguaccaagguucuuuugcuggucaggaauuuguccccaccuccaccccuaccccaggacugaagacuaauuaacuggaaucugugaaaagggcuucaauaaggagcagccgcucaugaaacagugaagacaagcugaugagguucauuaguggcucuuauugcccuuggucuucuacauacagucuuugacuuuuccuggcacuggaaacagaauccaguuaaaacacacacacacacacacacgcacacacacacaccuaugauaagugaaagugaacagaaaaaagaguugugcugguucucagcauggucucuagagcaggaauaucagcaucacuuggaaccccauuguauucaucugcucaggcuuccauaacaaaauaccauagauugaguggcuucaaugacagaaauuuauuuucucacaguucuggaggcugggaagugaaagaucaagguuuuggcugauucuguuucuggugagggcucucuuccuggcuuacagguggcugccuuuuugcuaugcccucacaugacagagcucuguuucuucuccugaggccaccaauccuauuggacuaggaccccaccauuaugaucuaccucauuuaaucuuaauuacuuacugaaagccaaaucuccaaauauagucacauuggguguuagggguuuaacacaggaauuugggggaacauaauucaguccauagcacucauuauaaaugcaaauucucaagcaccaccugagaccuacugaaucagaaacucaggaaauggagcccagcaaagcagguuuuauuaucucaccagguauuguaaugcccacuaaagucugagaaguacuggcccucuggaugaagucccaacuccacagcacagcauuuacuuuccuucccaguuuacucccacccuccuuuccaaccuuauuucuuagaggguacucugucuauaauucuagcacaaggcuuugcacauagaaagcacucacauuuucacaauauuguguacuaucguuauagaaguuauuaagaaauuauuaagaaauuauuuuagacacauagaggggaaaaggggucuuuuaaagcagcuccaaaauguuucuugucuagcaggaaagcccccgcucuuagagccaggccggcaagcuuugaugugcaaauaccggccauuagaaacuggguccacccaaacauggcgauuccugcccuguucuuccuugcccucacaugugccuggcaacauggccgcccccacauaucuccauguggguagagcaucauggcgcccugccuuugcauauuaaaaggcuagggugggagggccaguuuucccccugggcuacgugaauaacgugcccggucaaaccaauucccugagcccuaugcaagucagguaccaccuccuccagccuccucauauaagcagccacuuuaccaccacacacaggguuuucucucauuggaaucccuuccucucucugucucuguaugagggagcuguuuuuuuccuccuuccuucuuucuugccuguuaaacucuccucuccuuaaaaccacuccacguauguccaugucguuuuauccaguucugcgugagauuaagaaccuugguguuccuucagucaucggagccuuaucacuguuugcuuauaacucuucucuguaaacugcucccuacaacauugcuuucaauucauugcuguuuuggggcauccaacagcccauuggucucugacauagcacaaaguugcuuaacaugauuuuaaaaaaucaauauacuacuugcuacuuaucauguccuuaaguguaucaagucuuauaaguaccuaguauauuaccuuaugaaauucucccaaucacccugaaguaggcauuauaauuucuccuugacagaaaaagucgcuggaaacugaggcuuaauaucaaaaggucuauuguauaacauggugacuacgguuaauagcaauguauuuauuauaucucgaaaacugcuaagcauggauuuuaaguauuugcuucacaaaaaauaauaaauguaugaggcaaggcauauguuaguuugauuuagccauugcacuauauauauauauauaucauaucauauuguacacgaaagacauauacaauuuugucaauuaagguaaaauuuuaaaaagaggucaacucacuccaccaaagucacauacuugggaagugguaagguuggaaauuaugagcucauguuucuuugacuuauuuccacuguguuuuacuacagacacagagaugcaguuuucugacaacaucucgaauuuacugccaagacucccagagcauauggaacuuguugcaguaaaguuauuuccaguauaucuuuuggaaucucucuguucucuacacccggacacagucuugcacacauguauguguguuugcaugugcacacucacacacacacuagcacaugcuaaaaguuggccaucaugaaaacaaaaaaucaggcuagacuucuugagacaaacagguacugugaagcaacuacugggaagaaagagcucuaaauucuaucgcuauucuauauccuauuuggcuguagacaauuuuuagaaugcuuucaucuuuacaauaaagacaccugaagcucucaaagggaauugcuugaauguucacaaggagcucugauaaacuuugucccacagccacuacugacaguuaagcacuagaaacauauaugcacauacaauuuaaaaauccguaaguuuaaaacaauggacuauuuuuuccucaaaaucauucuuucuuagcuucauuccccagaaaacaagcccaaugauuuuauuuuacuuauuuacagcuuccuuccuacugaagacuagacuauaagauaaugaaccacaccuguuggauucuuuaggcaauucuaagcaccagcugagauagugauuaaaaguaacauuccauucucagccuaccugggguguucaacaaucuugacaucuugcagaaauaggagacauacugcucgcaguacucggcacugucagugauggcacuuaucugguccauggaggcgcuguaaacgagcugugucacugaguauuuuucuggguuguagccgaccacaggcgucugcaucugcaagucaugagacacuaugguccacacuuuguccucuguggggagaaaaacaaccaggacccuggaucauuaguaugcaaaugcuucuccaaaugucagaaaauaauugagccacacuuaaauggucuuuuuacugagcugguguagaacaguguuaaggagagcaauccuuaaaacccccugcucuuugcucaucccuaaguucugcuuaugaggacaaaguaggaaaguaauauuuuuauugaaaacaaaugcaagauaccuccugaaagcaaggcaaaaaaagaaaaaaaaaaaaagcuuuuguaucuuguuggugcucuaacaucugcagcauugaauaucaggcucauuaugucccaacuucuugcugacuuugucauccaucauuccucugguggaacaggauuuucucuuuccuaaaugaacuaugcucucuuucaagccucugagucuuccuacaugguguuugcucucaucagaauauguauccucaucuugucaacaaauguucucuucacacugaccuuuuaggcaaaauuagacauugcauucucugcuauugaaauguucuguacauguggaauaaagcaagugacuaauuaucuuggugauuuugacccugaaaauuucacugcgagaaaagaagcagauauaaaauagauaagguuaaauaaaagcuccauauacuuuuaaauuuuaguuagaagcaucucuaagaaccuaagauaauguuaucuaauuuuaaauguggcauaugucuugccucugugcacugaaaaagcuccuacacaaggacugaccucgugcaccagacugugaucacuaaauaccauuuccucuaagauaaaacuaggaucccuggagaaaugauggcuucuacggcuggaaaugugcaagaugaaagaugagccaggaacauaucccaguagaaaaaaagaagcaauuagagacugagggcaguucaaaaacacccagggccaaagaugggccaaucugaacaucaacaagaauauucugcaauggauugaggcauaucaaauauauuuaaauccuuaauuuuauuaaaauuguuaaaaauguuuaauuuuggaagaugcuagguaaccaacucauuauuuugaauauuggcgaauaaagagaagaaucaagccuuuggccuuucuuuguuauaggaaccuuaaugaaaccaaauauugucuuuauggagauauuucagcucauaaaagaagacuaaauggugggauuagaguaucaugauuuccuaacuucugacaaauuuaguaggaucuaagcaaugauuaucaauggcugcuaauauaaccacaagugaaaccacacaugaugcaccuuuggaugaaaauacacaaucaauguuacacguaauguacuauugauaaaaaucaagcaugaauuugaccaagucuauagaccuaaauucuggauuuccagaauuuauaagggagagaggaacauauuaaauagcacacagggaaauacuccaugaaaucccugcccgugggaaacucuauagaccaauauaguuuuaucaacugauaaauugcaaaggaaguggguagagaggaaagaaguggugagagagagacagagcgcaagagagagcgugcuguagauuaaaagagacuuauugaacuuccuccucauuuggucuuauuuugguacauggcaacuccauucuuucaggugcucaagacaaaacccaggagucaccauuaaugccucucuuucuucugcauucaucaucaagccugcccaugaauccucucugcucuaccuucaguguauuuccaaaauuugaacacgccuccugccaacccaccaccacuacuaggguuaaagccauccugauuccuaaccagucugcugcuuuccacccuugccuccucacaucuacacucaacacgggagucagggugagguuuuucaaauauaagugagauucugauacucugcucaaagccuucaauggcagcgggucuuguuccaguagaagucaaguccuuaaaacagcugaagucccuccgugaccuggcuccuccccgccucuaugcccucacaugucaauccucccuccuugcuccuuuggcaccagccauauggaccuuucauuccucaaacacaucagcagggucccuccuuagugccucugcaccugcugcuuccuuugucuuuccucggcacccucaggacccacuccuucuucucuuccagugccagccuuuccuuuccuauucuacagcugcucucugccuccucuuccugcuuuaauuuucucccuagcauucaucuccccuuuacuugcacacauuuuauuuuuuuaaagucuguccccccacauuaaaaguuaagaaagcagagauugcacaauaauuggcacauaguagggcuucagaaauauuaguugaguagaaagaggaauuaacgaaaguuaauguucucacucaugagugggaguugaaaaaugagaacacauggacacagaaaggagaauaucacacaccagggcuuguuggggggugcaggguaaaugggagggagagcauuaggacaaauaccugaugcaugcagggcuuagaaccuagaugacagguugauaggugcggcaaaccaccauggcacauguauaucuauguaacaaaccugcacguucugcacauguauccaagaacuuaaaggaaaauaaaaaaauaaaaaaguaaaaguuaaauagauccaagcuacucaaucuaggaacaguuuaaagucauuuuggucccaguucuggcuuggucaggacuauccugugagacucuagacaagugacuucaucuucuaggcucuaaaccccuuucaucuauaacaacaucccucucugcuagagcacuuuccaguuugcucuucuugaaucaaucagaaaaguucaguuacagugucccccaugguaauauauuuucuguagaauaaauauauuccaguuuuaccuuuagccucuuuguaacugccuuccuuuaguucuucugauaagcaaagaagccacaucauauuuuaguaauucugucacuuucugacaugauucugaugauaaacuguuugucauuuguguccagaccugcagauuuaccuucaccuaauuaaagauacauuaauuaaauuagauugguuuugaucuuuucuguuacagucagccucuggcauaaaacuuucuagugucugacacugcuuccauuuuuuauuuuuuuucucacaaaucucuaucaagagccuuguccugcaguaguacuccaaaucuuucuuugacucaugauggaauagccuucaaaccugaugucuucuuuaaagggucauaaacgucuuuucaauauaauggucauaaaggcaagcauuaauuuaagcaaauaaaaccaaauggucacccauuuacagucucuaucuuacacaacuucauuaacuuuaaaaauauuaccuauuugcugagauugaagagucucuacugauuuguuccuagugacuucucagcccuaaacucuacuucugccccucucaccacaaacauuucucuaucaaaccccuaugcauuaucuguuauauguuuguuuuguaacacacccaugcauucaacaaauauuauugagugcuuacgauaugacagauacagaucuagggaauguaucuaaggaaaccacagugcaauaagcauuuauacauuuuuggagcuugggcagggugugguggcucaugccuguaaucccagcacuuugggaagccgagauaggaggaucacuugaacccacgaauucaagaucagccugggcaacacagcaagacccugucucaaaguuaguuuuaaaaauucgauuaaaaaaaaaaaguuuuggagcuuauauucuuccauucuaguggcggaaaaacagaucguaagcaaaauaauuaaaauuaaacauauauauauauauauaguuugccagugauaauggcugggagaaaagcuacaucaaggaagggaaguauagacccugugaauggggauugccuuuucaaauacagcaaaagcugcaaaaggcuucacugagaaaauaacauuugaauguguaagguaguuauccagcaagccaugugaaugccuggggaaaauauuccagacagaagaaauacaaaugcaaauguucuaauucuggaauuuucccggcaucauucagguauacaaagaguccacugagugacagaaggaagaauaggaagaagcgggaguuagaaaugguugggcaugggacgagcaugaccagcagucugcugugucauaguaagagaucuggcuuguagucaaaggaaaacaagcaacuguuggcauuggaggauuuugagcagaaaaguagcaugcuguaacuuauuuauugauauacuauucuucaauaaaauuauauuuuggaaagauuugaaaagaaauacacaugcacguauguaucuauuuuauaaaauaauuaaaaauuuuuacagcgucuugucauuuuuuuucugagaaagcacaauguuuaaauuuuuauuucauuucaguauuuugggggguacaggugguuuuugguuacauaaaguucuuuaguggugauuucugagauuuuggugcacccaucaccugagcaguguacacuguacccaauacguagucuuuuaucccucaccccaucccuuccccgccaaguccccaaaguccauuauaucauuguuaugcuuuuaugucuucauagauuagcucccacuuacaagugagaacauacaauauuugguuuuccauugcugaguuauuuuacuuagaauaauagucuccaacuccauccagguugcugccaaugccauuauuucauucuuuuuaugacgaguaguauuccaugguguauauauaccacauucucuuuauccacucauugguugauggacuuuuaggcugguuccauauuguugcaauugcaaauacuguugcuguaaaaaugugugugcaaguaucuuuuucauauaaugacuucuuuuccucuggguagauacccaguagugggauugcuggaucaaaugguagcucuaccuuuaguucuuuagggaaucuccauacuguuuuccauagugcuuguacuagcuuauauucccaccagcaguguagaaguguucccuuuucaccacauccaugccaccuguuauuuuuugauuuuuuaauuauggccauucuugcaggaauaagguaauguauuaguccaugcucauguugcuaugaauaaauaccuaagacuggguaauuuaugaaggaaagaaguuuaauugacucacauuuccacauugcuggggaggccucaggaaacuuacaaucauggcagaaggcaccucuucacaggguggcgggagagagaaugagaguugagcaaaggaggaaaagcucccuauaaaaccaucagaccuuaugagaacuaacuuauuaucacaacaacaagauguggggaaacugccuccaugauucaauuaacuccaucugguccucgcauaggauuaugggaccuauaauucaggaugagauuuggguggggacauagccaaggcauaccauucuucuccuggccccucccaaaucucaugaccucacaauucaaaacacaaucaugccuuuccaauggucuucaaagucuuagcuuauuccagcauuaacccaaaggcucaaguccaaagucuugugugggggcuccaaccccacauaucucgucugcacugcccuagcagaggaucucuaugagagcuugaccccuguagcaaagcaaacuucuguuuagacauccaggcauuuccauacauccucugaaaucuagguggagguucuccaaccuugguuuuugacuucuguguacccacaggcccaacaucaugugaaagucaccauggauuggggcuugcauccucugaagcaauggcuugagcuguuccuugaccccuuuuagccaaggcuggcgcugaagcaguugggaugcugggcaccaugucccaagggccuaacacacaaaagauuuuucccuccuaggccucugggccugugaugggaugggcugcuugugcaaauuucugcagccuguuugaauuucucaccagaaaacggaguuuucuuuucuaccucauugucaggcugcaaauuuuccaaacuuuuaugcucugcuuccucuugaaugaggcagggacaaaaugccaccagucucuuugcauagcaagagucacuuuuacuccaguucccaauaaguuccucaucuucauaugagaccaccucagacuagacuucauuguccauaucacuaucagcauuuuggucaaaaccauucaacaagucuccaaacuuucccacauuuucuugucuuauucugagcccuccaaacuguuccagucucuuccuguuacccaguuccaaaguugcuuccauauuuuuggauaucuuuacagcagcaccccacuacccaguaccaauuuacuguauuagucuguucucacauugcuaugaagaaauaccugagacuggguaauuuauaaaggaaagaguuuuaauugacucuuaguuucacauggcugaggaggcaucaggaaacuuaacagccaugguggaaggcaccucuuuacagggcagcaagagagaaugagagcaacgcaaaggcagaaaagccccuuauaaaaccaucagaucucgugagaacuaacuuacuaucacaacaggauuagggaaaccacccccauuauccaauuaucucuaccuggucccucccgcaacacuggguuggggaucaugggaacuacaauucaagaugagauuuggguggggacacaaccgaaccaccauaucaggugguaucucauugugguuuugauuugccuuucccugauaauuagugacauugggcauguuuucauauguuuguuguccauuuguacaucuucuuuugagaauucucuacucaugcucuuuucccacuuuuugaugggauugguuuuuuguugcugauuuguuugaguuucuuguggauuccggauauuagugcuuugucaccuacauagugugcaaagauuuucucccacuguggguugucuguuuacucugcugacuauuucuuuugcugugcagaagcuuuuaguuuaauuaggucccauuuauuuaucuuuguuuuuggugcauuugcuuucggaugcuuugucaugaaauuuuugccuaugucaaugucuagaagaacuuuccugauguuauuuucuagaauguuuacgguuucaggacuuacauuuaagucuuugaucaaucuugaguugauuuuuuacauaaguuaagcgaugaggaugcagcuucauacuucuacaugugacuugccaauuaucccagcaccauuuguugaauaggguauccuuuccccacuuaauguuuuuguuugcuuuguugaagaucaguuggcuuuaaauauuuggcuauauuucuggauucucuauuuuguuccauuggucuacuugccuauuuuuacaccaguaccauccuguuuuggucucuauagccuuguagaauaguuuuaauuaggguaacgugaugccuccagauuuguucuuuuagcuuugucuugcuuuggcuaugcaggcuuguuuuugguuucauaugaacuuuaggauuguuuuuuauaguucugugaagaauauugaugguacuuugauggaaauugcaaucuguagauugauuuuggcaguauggucauuuucacaguauugauucuacccauccaugagcauuggguuguguuuccauuuguuugugucauuaaugauuucuuucaccaguguuuuguaguuaacuuuguagagaucuuucaccuccuugguuagguauaguccuaaguauuuuauuauuauuauuacuuugugaagcuguuguaaaagggauugaguuauugauuuguuucucagcuugguuguuguugguguauagcagugcuacugaauuguguacauugauuuuauauccugaaacuuuacuaaauuaauuuaucauaucuaggagcuuuuuggaugaaucuuuaggguuuucuagguauaugaucauaucaucugugaacagcacaacuuuaauuuccucuuuacagauucugaugcccuuuauuucuuucucuugucugauugcuacagcuaggaguuccaguacuauguuaaauagagguggugggggugggcauccuucucuuguuccaguucucaggaugaaugcuuucaacuuuuucccauucaguauaauguuggcuguggguuugucauagaugguuuuuauuacauugagguacaucccuucuaugccaauuuugcagaagguuuuauucguaaagggaugcuggacuuugucaaaugcuuuuucugcaucuauugggaugcucauaugacuucuguuguuaauuauuuuaugugaugcaucauauuuauuugguuguguauguuaaaucaucccugcaucccugguacgaaacccacuugauaaugguguauuaucuuuuugauaugcuguugaauuugguuagcuaguauuuuguugaggauuuuugcauauauguucaucagcaguauuggucuguaguuuuccuuuucuguuauguccuuuccuggcuuugguauuagggugauauugacuucacagaaugauuuagggagaauucccuccuucucugucuuuuggaauaguuucaguaagauuggugucgauucuucuuugaauguccguuagaauucagcugcgaauccgucugguucuggacuuuuuuguuggcuuuuuuuuuuuuuuuuuuuuuuuacuacuguuucaauuuugcuauuugucauuggucaguuuagaaucucuauuucuuccugauuuaaucuaggaagguuguauauuuccaggaauuuauccaucuacauuagauuucuaguuuguaaauguguucauaguagccuugaaugaucuuuuguauuucugugguauugguuguaauauuuccuguuuuguuucuaauugacauuuggaucuucucucuuuuuuucuugguuauucuugcuaauggucuaucaauuauguuuaucuuuucaaagaacccacuuuuuuucauuuaucuuuuguauuuuuuuguuuguauuucauuuaguucuguucugaucuuuguuauuucuuuuuuucugcuggguuugcauauuguuuguacuuguuuuucuauuugcuugagguauaaucuuagauuuuuuuauuugugcucuuucagacuuuuugaugagggcauuuaaugcuaugaauuuuccucucagcaccacuuuugcuguaugccagagguuuugauaaguugugucacuaucaucaaucagcucaauuuuuaaauuuuaucuuuauuucauuguugacucaaugaucauuaaggaacaggugauuuaauuuccaaguauuuguauaguuuugaggguuccuuuuggaguuaauuuccacuuuuuuuccacuguggucugagagaauaccugauauacuuuuuauuuucuuaaguuuaucaagacuuguuuuguaagcuaucauauggucuaucuuggagaauguucuguguguugaagaaaguaauguauauccugcaguuguugaguagaacguucuguaacuaucuguuaaauccauuuguucuagaguauaguuuaugucuauuauuauuauuauuauuauuauuauuauuauuauuauuauuuuugagacagaguuuugcucuuguugcccaggcuggagugcaguggugcaaucucaacucacugcaaccucugccucugggguuuaagugauucuccugccucagccucccagguagcugggauuacaggcacccaucacguugcuuggcuaauuuuuugcauuuuuaguaaagacaggguuuuaccauauuggccaggcuguucuugaacuccuaaccucaggugauccacccaccucagccucccaaagugcugggauuacagccaugaaccacagcggucggccuauguccguuauuucuuuguugacuucucgucuugaugaacuaucuagugcugucagaggaguauugaagcccccccacuauuauuguguugccaucuaucucacaucuuaggucugguaauaauucccuuauaaauuugggagcuccaguguuaggugcauauauauuuagaauugugauauuuuucuguuggaguaauucuuuuaucauuuuauaacguuccucuuugucuuuuuuuuuuuuuuuuuuuaacugcuguuggcuuuaaagucuguuuuuuccugguagaagaauagcuacugcugcuugcuuuugguuuccauuugcauggaauaucuuuuuccaccccuuuaccuuaaguuuaugugaguccuuauguguuaggugagucuuuugaagacagcagauauuuuguugguggauuuuuauccauucugccauucuauaucuuuuaauuggagaauuuaggccauuuacguucaacauuagcagugagaugugagguacuguuuucuucaucaugcuaguuguugccuuaauaccuuauguuuuguuuuaauuguguuauuguuuuauaggccuggugacauuuaugcuuuaaggagguucuauuuugguguguuucaagauuuagaaccccuuuuagcauuucuuauagcgcuggcuuaguuguggcaaauuuucucagcauuuguuugucugaaaaagacuuuaucucuccuucauuuaugaagcuccauuuuacuggauacaaaauccugggcugacaauuauuuuguuucagaaggcuaaagaugacaccccaauucuuucugucuuguaagguuucuauggauaauucugcuauuaaucugauagguuuuccuuuauagguuaucugauacuuuugucccacagcucuuaagauucuuuccuuugucuuaacuuuagauaaccuaaugacuaugugcuaggugaugaucuuuuuggaaugaauuucccagguguucuuugagcuucuuguauuuggguaucuugaucucuagcaaggccagggaaguuuuccucaaguauucccucaaauaugcuuuccaaacuuuuaaauuucucuucuuccuccagaaaaccaacuauacuuagguuugccauuuaacauaaucccaaauuucuuggaggcuguguucacuuuuuuauucuuuuuuuuuucuugucuuugucugauuggcuuaauuugaaagccuugucuuugagcuccaaaauucuuucuuuuacuuguucuagucuauuguugaaacuucccacacuacacuuuuuguauuuccguaagugugucuuucauuuccaaaaguugugauuguuuuuucuuuaugacaucuauuuauguggagaauuuuucauccauauccuguauuuuguuuuaauaucuuuuuuuuuuuuuuuuuuuuuuugagacagagucucgcucugucccccaggcuggagugcaauggcacaaucucggcucacugcaaccuccgccucccagguucaagccauucuccugccucagccucccaaguaccugggauuacaggugcccaccacacaccaaacuuuuuguauuuuuaguagagacaggguuucacuauguuggccaggcuggucuugaacuccugaccucaugauccaccugccucagccucccaaagugcugggauuucaggcgugagccaccaugccccaccuuguuuuaauaucuuuaaguuuguuuucaccuuucucugguaucugaguaccuuaauaaucaaccuucugaauuuuuuaucuggcuauucagagauuucuuuuugguuuggauccauugcuggggagcugguaugaucuuuuggggauacuauagaaccuuguuuuguuacauuaccagaauuacuuuucugguuccuucucguuugcguagauuauuucaguggagaggucugaaacucaacaucugcuguucagauuuucuugucccacagggugaucccuugauguggugcuuccccccuuacccuagggauggggcuuccugagagcuggaacgcagagauuguuauugcucuuuugggucugguuaccaagcugggcuaccaggcucuagacuggugcuggggaaugucuacagaguccuaugaugugauccaucuucaggucucucaaucauggauaccagcaccugcucugguagagguggcagcgaagugagguagacucugugagaguccaugguuguagauauguuuagugugcuggcuuucuugaaugaugguuaugcuagcagugauguuuucacagggacacgcucaggaacucugguuagccaguaucuuguaggcaguggaauuagguguugucuucuccuuccugggaucaggguuauucuaccaugaguugcuguaauggccugaguugguuggccuccaaccagaaggugguguuuccaagacagcaacagcugcaguauuaguggagggaucuaagcuugcccuaacuuggccaggguaaguauuucaguuucucaggugaugggcagggccauaaagcucccaagaguuuaucuuuuguaaucagcuacuaggguggguaaagaaauccuaucaggucagggcaggguuaugcaggucugagcucagccucuccuuggcuggggcuugcuauagccacuguggggaugcagggugguucucaggccaaaagacaucuuggcugccucugcugugucauauaguucaccagagaaguggggaauagccauuagugagaggccuaacccacccccccaugcaauuggcaaggccagucucacucccacagugccccaauaagaccuugccugaggacauagacuuccccacuaaaaaagcaagcauggcccuugcuccuuugcaucugcccacuccauuggcugcggcuccugugcucgaaucugcagccacuccugcuugucuccuggacuucaccugagaagauuugugcccaguugaaacaacuacaaauuucaguucagaguuuccuuugcacugugacuacuucccaauuccucuggcugccuuccccaagggccccuauaagauaucaucagagauggcuucccugggcuucagcuggagacugggacugccugcaaggcauuuucugcugcuacuucuacuuuuauauuucaugugacucccuaaauccauuucaacuccaggagagguuaaauccuucuuccauaaucucaugaucuggauuuucaggucccccaguagaaauguauguuuggaggcagguuuuccuucucucacacuuugggaaugcucaguuuuucaccuguuucaugaaauuuguaguagugugcugcuucuuucaaaggaucugggaauccuucagguuuuccugguauguuccuuuguugguucuuggagcaacagaucacagugugagucuccacacacaguucaguucauccaggugagaacugcacauuagcccuaucuccuaucugccaucuugcccaccaaguccagugccaugacauuuuaaaacaauuucuuugguaauugacauuuuaaaauaauuuuuugguaauugugagcacaugcaaacaauaauauauaaacucuauuuugaugaaauagaacaguuacuguugaugcauuuuacaaauuauuuuguaacacuuguauauuacacauugcaauaacuccuuuggaaccauacaauauuuuuaaauuuuaaauuuuuguggguacaucauagguauauauauuuaugggguacaugagauacuuugauacaggcaugcaauguguaaugaucacaucacagagaaggagguauccauccacucaagcauuuaugcuuuguguuacaaacaauccaauuagacucuuuuuaguuauuuuaaaauguacaauuaaguuauuauugacuaugguaacccugaugugcuaccuaauaguaggucuuacuauucuauuuuuuguacuuauuaaccauccccacuucccccugcaaccccucacuacccuucccagccucuggaaaccauccuuccacccuauguccaugaguucaauuguuuugauuuuuggaucccccaaauaagugagaacaugugauguuugucuuucugugccuggcuuauuucacuuaacauaaugaucucuaguuccauccauguuguugcaaaugacuguaucucauucuuuuuauggcugaauaguacuccauuguguauauguaccacauuuucuuuauccacucaucuguugauggaugcuuugguugcuuccaaaucuuggcuauugugaacaguacugcaauaaacaugagaguaaagauauuucuuccguauacugauuuccauucuuuuguguauauacccaucaguaggauugcuggaucauaugauaguucuauuuucagcuucucaaggaaguucugaaugcuucuuagugguuguacuaauuuacauuucuaccaacaguguaugaggauuuccuguuccccauauccucaccagcauuuguuacugccugucuuuuggauauaagccauuuuaacuguggugagaugauauuucauuguuguuuugauuugcauuuucugaugaucaaugaugucuagcacuuuuucacaugucuguuugccauuuguaugucuucuuuugagaaaugucuauuuaagucuuuggccaauuauugaaacauauuauuaaaauuuuccuauagaguuauuuugagcuccuuauauaauauucugguuauuaacaccaucucagauggguaguuugcaaauauuuucucccauuauguggggugucucuucacuuuguugauuguuugcugugcagaaguuuuuuuuuuaacuugagcugaucacauuuauccauuuuugcuuugguugccuaugcuugugugguauuacucaagaaauuuuugcccagaccaauguccuggagaguuuccccaguguuuucuuguaguagauucauauuuugaggucuuugcuuuaagucuuuauuuugauuugcuuuuuguauauguugagagacagaagucuaguuucauucuuccgcauaugaacauucaguuuucccagaaccauuuauugaagagacuguuuuccuaagaguauguucuuggcaccuuugucaaaaugaauucgcuguagcuguguggauuuguuucuggguuauacauucuguuccauugaucuacaugucuguuuuuaugcuguaccaugcuguuuugguuacucuagcucuguagcauaauuugaaguuagguaaugugauuccuccaguuuuguucuuuuuguucaggauagaucugguuauucugggucuuuugugguuccaaauaaauuuuaauuuuaaauuuaaaauuuuuuuuuuuauuucugugaagaaugucauugguauuuucauaggaauuacacugaaucuauagaucacuuugggaaggacggacauuuuaacaauauugauuauuucaauucaugaauaugaaauaccuuuucaucuuauugguguucuccucaauuucuuucaugaguguuuuauauuuuucauuauagagaucuuucacuuuaugguuaauucccagguauuuaauuuuaucuguggcuauuguaaaugggauuacauuuugauuuuuuuguuucagauugcucauuguuagcauauagaaaugcuacugguuuuuguauguugauuuuguauacuacaacuuugcagaauuuguuuaucaguucuaauaguuuuuuuguggagucuuuagguuuuuccaaauauaagaucauaucaucugcaaacaaggauaauaugacuucuuccacuccaauuuggaugcccuuuauuuuguucuuuugucugaaugcucuagcuuaggacuuucaguauuacguugaauaacaguggugaaaguaggcauccuugucauguuccagaucuucgaggaaaggcuuucagauuuccgccuucaguuccugugcuuuucuuauugacagaguucuuauuauagcuucgaucuuguuacuggauauucauaucuucagguuuuggauuucuuccugguuaaaucuugcuagguuguaugugucuaagaauuugucuauuuuuccuagauuuaccaauuuauuggcauauaguugcucauuguagccaccaauaauccuuuuaauuucugugguaucaguuguaaugucuccuuuuucaucuccaauuuuauuuauuuggaucuuuuuuuccuagucuggcuaaaggcuugucaacuguguuuaacuuuucaauaaaccaaauuuuuguuucauuggucuuuuguauuguuuucuucaauuuuauuuauuuaugcucugaucuuuauuauuucuuucuuccacuaauuuuaaguuugguuugcucuugcuuuucuaguucuuuaagcugcaucauuagguuauuugaaguuuuucuucuuuuuugauguagacaguuauagcuauaaacuuuccucuuaguacugcuuuuaucguaucccauagauuuuuugguauguuguguuuccaucaucauuuguuucaagccauuuuucaauuuccuucuuaauuuauucauuggcccacuggucauucaggagcauauuaauuuuccaguauuuguagaguuucaaaaauucaucuuguuaucaauuucuaguuuuauuccauuguggucaaagaauaugcuuaauauuauuuucauuuuuugaauguuuuaagucuuguuuugugaccuaacauauggucuauccuugagaaucauccauauacugagggaaagaaugugugaucuguagccauuggaugaaauguucuauaaauaugcguuaaauucauucagucuaaagagaagauuaagucugauguuuuuuuguuuauuaccuguccagaagaucuguccagugcugaaggugagguguugaauucucuaguuauuauuguauuggggcccaucucucucuuuagcucuaauaauauuugcuuuauauaucgcgguacuccacuguuaaaugcauauguauuuaaaacuguuauauccucuugcugaaaugacaccuuuaucauuauauagugaccuucuuugugucuuauuauaguuuuugucaugaaaucuaauuugucuguuauaaguguagcuacucuuuuucuuuuuuugguuucuauuugcauggaauauaucuuuuuccaucccuuuauuuuucagucuaugugucucuuuauaggugaaguguguuccuuguaggcaacagaucaaaugguuuuucuuuuucaucuauucagcuacuguaugucuucuguuugcagaguuuaguucauuuacauucaauguuauuauugauaaguaagaaguuacucuugccauguuguuauuuguuuucugguuguuuuuuugucuucucuuucuuccuguccuccuuuagugaaggugaucuucucuggugguauaauuuaguuucuugcuuuuuauuuuguguguauccauuguuugauuuugguuugugguuaccauggggcuuccaaauacuaucuuauaacacauuuuuuuaagcugauaacaacuaacacuguuuguauaaacaaacaaauaagcacaaguaauaauaaaaacucuaugccuuaccucuauccuucugcuuuuuaacuuuuuguuguuucuauuuauaucuuauuguacugucuaugucuucaaaaauuguuguacuuuuuauuuuuuauugguucaucauuuagucuuuuuacuuaggaugaaguaguuuacaccucaguuacuguguuauaauauuccauguuuuucuguguacuuaauauuaccagugaguuuguacuuucaggugauuucuuauugcucauuaacauccuuuaucuuguggacugaaguacucccuuuagcauuucucauaggacaggucugguguugauaaaaucccucagcuucuguuugucuagaaaagucuuuauuucuccuuuauauuugaaggauaucaucaccagauauacuauuuuaggguaaaaguuuuuuucuuucagcaccguaaauaugucaugccccucucuccuggucuguaagguuucaacugaaaagucugcuaccagacauauugaagcuccauugccugcuauaugcuucuuuucucuuguugcuuuuagaauccuuucuuuauccuugaccuuuuggaguuauuaaaugccuugagcuagucuucuuugggucaaaucugcuuaguguuuuauaaccuucuuguacuuggauauugauaucuuucccuaggguuuuguuauuauaccuuugaauuaacugucuaccccaucucuuuuucuaccuccucuuuauggccaauaacucuuagauuucccuuugggggcuauuuucuagauccuguagaugugcuucauuuuuaaaaauuauuauuuccucuuguuuucacugacugugcauuuucaaauaaccugucuucaagcuuacuaauucuucuguuugaucucuuaugcuauuaaaagacucugaugcauucuucaguaugccaauuaccuuuuucaaauccagaauuucugcuugauucuuuuuaauucaauuaauuuaaaaaauauauaauuauaugauauauuaguuauuuuuaauuaauauauaauuauuuuaaucucuuuguuaaauuuaucugauagaauucugaauaccuucuccgcuuuaucuuaaauuugaguuuccuuaaaacagcuauuuugaauucucugucugaaaagucacauaucucuguuucacuaggauugguuccugguaccuuauuuagcucauuuggugaagucauguuuuccuggaugguguugauacuaguagauguucuuggaugucugggcauuaaaaagcuagauauuuauuguagucuucaccuucucaccuucuuuguccccauccuucuuggcaaagcuuuccagauauucagaaggacuuggguauugugaucuaagcuguaacagcuuuagggggcaccccaagcccaguaaugcuguguuucuugcagacucauagacauacuaccuugauggccuuggacaagaucugaaagaauccuauggauuacuggacgaaaacucuuguucucuuucuucuuccucccacacaaauagagugucucucucuguucugagccacugaaagcuagggguggagugacacaacuacuccuuggccaccaccacuaggauugugcugggucagaucuaaagccagcacaggacuggguguugccccaagaccugcuguaaccacucccuggcugcugccuauguucgcucaaggcucugggguucuacaaucaucagguagcacagccagccaggccuauguccuucccuucaggguggcgagucacccgaggucccagguagguccagaguugccauccuccagcaaucagggaccagagucaaaaaccucagaacuccaccuguucuguuguacuguggcugagcugucacucaagccacaagaugcagcacuucccacucuucucucuccuuccaaaggaaaaggagugucacccuguggucaucaccacaacgggccacagggaauauugcuagccuaucuccaauauucccuuaaggcccacggcucucaagucaguuugugaugaauacugccugguccgggacucacccuucagggcaguggaagagccauuaaaucuuaagugacaaauggauaugaacaauuuuucauguguccaccaucuagaacaaaacauguauuuacacucuacagauuuuccuuugcuaguaucauaaguagaaaaauuaagaaucuuauucccauauuuaguguguuuauauguguuaucauuuaugcauauaaugcaaacagaaacuacugcauauagcaaauuuuaaauuucuaaguuucauuucacaaauaagccacggauuaacuaaugcuuuuuaaauacugucuuuggauuacuauguuaugaaaaugucuuguggaacuacugagaauuuaguaucugucucaucauguaaucaccuauuuuuaaauugucacaauuuauuuuguuguaaauacugcugauuuaaugguauauuugaaacacugggcauguauggaacauacucuggagaccuguuccugucucuggcaauaacgggcccucaagauuaaccaguguagucauguugacaugagcacauuagaaaaaucccucugcugccuccacuacugaccccauauucucaacauaucuguaauccucaaguaauucacuucucaagaacucaauuccuugcauggcuggagcucuggccagggacugauaaagcuggaaaaugaccagugaaaaaaaagcaaaaaacaauuccuuccagaauguaaccaguuucuuaaucguauaaguguguguguguguguguguguguauaauagcuguuauuauauauauauaauagcuguuauuauauauauaauagcuguuauuauauauauauacauuuuauagcuguuuccugauucuuuucuauguuauucauauacagucugaaguucacauuaugcacauuuuaauaaaaguauaugagcugagucuaaugaaaaauuuuuauauguguccuauacaccuguauuugcagcuaaguauuauuuuuguuuuucaaaccaugucaucguaccaguuaaugugcaauuuguuaaucagagagauuuuuuccaccuuuuuucauauuuucucugaaaugauccuuguuuuacaaaaggaauauuaugaacuuucuaaauuaaaauguauauauaaaucuugcuagacuggguguggccaacauacaauguguagucugaauuccuuagcugccuuauggucuacuauaguuacuuuucacagguggcauuagaucuuucuagugcaggucucauagcaacacaguagguaguaaccuaugacauauucuuaagaucuuuuauauugcguauaagccuuggcuugcuuaauaaaacgaauaaauuccauuuucuauaucuuuaaauuucuucugcaucuuagcaacuguaucuuaauaauuuugucuguuuucuuugggcauagaagucuuaaugguauuauccugauucaaucaaucagcacuugaacacuaacuauaagaaagaugugagcuaggauuuccaauuaaaugcuauagcauuaauaagaacuguuuuuucaaaacucaaagcuuugcagucuuauacaagcauguauccagaggaagcaacccuaccacuuaaaggaagcuauauucuuaugugaaaauuuuugacuaucaaauaauaucaaaauaaugugaucuuggagggcacccaucuugacuuucuucuauuagagaauaagaaaucaagucuuaggagaaaaaaguggguuacaccaaacaauacuaagagauaguggcaaaauaauagaaauguguuuuccuaauucuggguugcgugcuguuuuuaccuuacuacccugcaucucuuugacucagugggguuaugcuugguggcaaaccaagcauaaaauuuuuauugucuuucucacagcacggcacucauuuuggguggggaggggcaauaugcagauacuauuuuagacuuuuuaaaauauuauuuuaaaauggcaacaauguauagccuauuacauaaaaaaugucauaaguugguaauauaauuuaaucauucaugcauccacaagccauuuauuaaguuccugaucugguccaguagugccaggcucuggggacacaaagaugaaaaagacuugcuuuccuguuuucuaugagcuuaugguccaguggcaguuagaggacauuaagcuuaagacuacaaaauagaaacaagugcuaaaacagagauauauuguguauccaaauaaaagguccauauaacccagcuugagaaagcuguggagcaagcuggugacagagcauuugucgugaaccaugacagaugaauggggaugugucgcaugaagaaggagaaggugauaagagcaauuuuauccuucuuauugcucagaacacacacccuggagacaagagggauucuguaaauggaaauaaaggaucuggaugagucagaaauggaaaggucuggaauagugggcuauaagauugcagcauagguugaaaggucuagcacacgaucguaggcguggguguagaaaacuuguggagauaaaagauuacuucauauuuuaaaaaucauuucuucaaacucaagaacaucuucaauaugcauuuauugaaaagauauaucuaguugcucauaauaugcuuaccauuuaucugaguucuagagguacggcaaugagcacgauauaaaauccaucaucucaggcaacuuacagucuaguuucaaacaugggaagcagaaaacaaacaaauaucuaacacguuuauuuuacuuacuuauaucuucugugaaaaaaagcuugguaaguggaaggagaaugauugaggagugagagagaccauuucaggcagauugguaagggagauccuaauauuugagcaaauuucggaaugauaugaagaucaaugggaagaguaaucuaagaugaacuaauggcaaauggaaaggccaugaagcaggaauaaucuggcagauuauuuugccagaauacaauaaagagagaaaagaguaggaaaugauauaagacaaaaaggcagggaacagauauuguaguuucuuguaaggcauauuaaagucuucagauuuuaucuuacauguuauggaaagccacagcagagauuuaagcaguagugugacuugaaugauuuaugcuuuuaguuguaauuguggcucauguguggucaauaauuaguagcagggcaagaguggaagcacagagaugacuuguaaacuacuacuuuagcuaaugggagauggucacuuagacuuuggaugguggcaguggaggugacagagaaguggaaauacauuaaaaaauauaauuuguuuuaaauauuuuaaaauagacuuuaaaucuaucauguaaagauacagccagaaagaucuggucauguuuuggaugagaccuaucagggggaaaaaaaaaugaaacaaggauuauugugagaauuuuggacugaauauuuauccaggcaaaugaugguaccauuuacugaggugggagaaauugugggaaauagaagagccaauaaagagaccaagacuagguagaccaggaggcgggaggaaaaucagagaaagccacaugaucaguuucaacagaaagagagucaucaacggacuuaagugguauuucaauguuaaguaaaaugaggacuaaauuaauuauugaauuuaucgaaaguauggguaauaugaucuuuccaagaggguuuccauggucugaugugaaagaaagacugauuauaucagucucgaagggagaguaggaagaaaaaaaaacgauuuuucuuucaagccauuuucuuucaucaaaagugauggcguuuucuauuuuuaaaagggcaaucauuacaauguauuuguaugcugauaagaaugauccaauaaagauggauuugccaauaauauuugucaauuauggcuucacaagagaacugugccuaugguuuguugaauuuacauuguacugccucaguuauauuauauauucugauuaucguaauauacaaauuauaucuucuugcauucuuuuuuuuuaacaguuuuuuuugagacagguucucacuauguugccuaggcugguuuugaacuccuccugccucagccacccaacgugcugggauuacaggcaugaaccacaaugccuggccaauuuuuugguggagauguagucuuuuuuuuuuuuuuuuuuuuuuuuuuuuuuuuugagacagggucucgcuccucuccgucacccaagcuggaguggcuggagugcaguggcaugauuauagcucacugcagcaucaaccucccaggcucaagugauccuuccacuucagccucccaaguagcuaagacugcaggugugcacuacuaaaucaggcuuuuuucuuuucuuuuuuuuuuuuuugauaaagaugggugucucccuauguugccuaggcugcucuugaauuccuagguucaagcaauccuuauaccuuggccucccaaguuacugagacuacaguuauaagccaucacauguggcuugaauucuuaauuuuagaaacuugaguuauucaaguuugguuuauacuuggaguguuuagacuaagauaguuuaauguuaaaaauuaaugcaacauaguacauuaagaaaaggcaccagaaauaauaaagaauaauuucaauaaaaugagcuauauaggaauaaauuguaauuccccuauauauguguaaaagaguaaaagaacuucauuauaauagaagguucaaagaauuagucacaaaauauuagaaucuuuuuuuuucaucagaaagagaaaugcuuauaaucacuguuucuagucaacauuauguuggggucuuagucauuagaaaaagaaaguaaaacauaauaauaauaaucauuaucauuauccuaagaauuguagagaagauggggagcugauaaauuuucaaaccuguuagaaaagucuacagcuuaaaaaagauuauucaauauaagaacaauauacaaaaaucaauuauauuuccaauaauaacuaaugagaaaauacaauauuuuaaaaauagaauuuaugauguaauaaaacaaaaucucacaaaauauaugcaagaacuuauugggagaaauuuaaaacuuuaaugaauaauauuaaagaagaaucacauaaaggaauauuccauauucaaagacuggaagaaucaauaacuuaguauauaaauuaauuccauuuucaaucauaaucccaauaauuuguguguguauauaaauguaauugagcaacugguggaaaaaauuuguauuuaagagccaaggucuaagaauagccaagacauuguugaagaacaaugcagagacaauuggccuaucaagaaucaugauuaaagcagguuugguacaggcacagccaauuaaaauaaugcaacaaauuuuuaaaaacuuaaagcaaagucuguguauauauguaaacuugacauaaaugcaaccuguugucagauauuuaugagaaauuuaaaauuguuuauucauauugaaaaaauaaaauuagaucccugucuuuaacccuacauaaaaauuguuccagauggauucaaggccuaaugaaacacagaccuucaaaauccauagaggaaagcacaaaauaacauuucuauuauuucuuuuuuuauuggaaacggagucucacucuguugcccaggcuggaguguaguagcgagauuuuggcucauugcaaccucugccuccuggguucaagcgauucuccugucucugccucccaaguagcugggauuaugggugcccaccaccaugccuggcuaauuuuuuguauuuuuaguagagacgggguuucaucauguuggccaggcuggucucgaacuccugaccucagauucccaaagugcccaccucggccucccaaagugcugggauuauagacaugagccacugcauccggcuuuuucuauuauuucuuaaagaaaguguaagaaaagcacucuaaugggagaaauggguacauaugguuuuguuaaaauucagcucucuucuucaucgacaugccauaaagaaugugaaauuuuaggccacugaguagaagagauaauuguaagauauaugucuaacaaauauuaguauccagcuacauaaagaacuucuacaaguaguuaacagaaacggaaauaacgcaaaagaaaaauaggcaagaaacauagaccaguaauuuacaaauggguaaaccacaugguuaaucaacucagggagaugcacaucuucacaguaaccagggaaauacaaagaagaacuacaaugagguuuuauuuuauguuugucagguuggcaaauacuuaaaaauguggcuguauccagaguucuugaggauaugaacaccuauacccugauucuuggagcuauuuuggaaaauaauuuggaauaaaaaguaaauaugaagaugagaauaucccauaauaauaauuauuucuaguuauauauccuaaaggaauucuugaacauuaaauauuuuguaaauauuguuugcaauaguaaauaaaaacaacauaaaaggccagccgacaagaguggaaaauaaguugagcuaugguuauacaauuguuauaaaauauuugaaaauaaaacaauuagaaguauauuuaugaaacaugagugaauuucaaaaucagaacauugaguagaaaaugcaaguaagaggagcauuuaaugcaugaugucacuuuuguaaaguuuaagaacacagauaucaauaaaauauucuaagaguugagaaaggagaguagaauuagaaaaugacauaagcuugacugggugugguggaucacgccuguaauuccugcacuuugggaggccaaggcgggcagauugccugagcucaggaauuugagaccagccuggccaacauagugaaacucagccucuacuaaaaauacaaaaauuagccaggcaugguggugcaugccuguaaucccagcuacuuaagaggcugaggcaggagaaucgcuuggaccugggaggcagagguuguggugagccgagaucaggccacugcacucuagccugggcaacagaaagacuccgucucagaaaaaaaaaaaaaaaaagaaagaaaauuacauaagcuuuaauuuuauauuugaaauuauauuucuuaauuuggcuauuggaaacaaacaugaaauauuccauaugaaagcaagauguaucuuauuucagguaaacuuuauauaaacauucagauuuauaaaagaaacuaacaaauacuggucauuuuauaagagcuauguguacuuuccugaauaacuuacaaaauaauuucuuaguuacaaugucuaguuauuuaaaguauuaacuaacuucuacaaaauuguuuagaaaacauucaggcaaaaagacucaacauaauguuagauuaugaugcaguguuuuuuagucauuuguaagaggauccauuugaaacuuucaucugucuucccgguggauaaguugaagaccauauauuuauagauaguuuuguuuagaagaucaauaauuaugaucucccugacauaacuuauuaaaaauuggcugucauugucuuuuuucaccccaaauaugcaauauaugagaaacacuucaugcauuuuuguaagccuagacucugauaggaaaggcaucucaccacagcacgcugugguaguuugaggcauuccauaaugccagcuauguaugcaguucagguagcaucagcagcuuuaaucauguguagagaaauaagguauguaaagcagauggaacucuguagggaacacugaggaaaugagcucaaagugcagauuauguucugcaggugguggaaaauagugauuauuuuuaagcucacaauuacagcccaaagauggaugacagaugaagcacugugaacaaguauaaauaaugacagaccauucucacccacaugaagaacaauuuggagcucauaugugucuuuuuuuguaggaaagcauuagccauuuucuaggaagaaggauauccguuaauguuuuuauuccauuguagagauguuaaaauccuuuuaaaauacagcuagaguuacugacuacauuuacaucgauacuuagacaagcuaaucuucccuuuccuuuuucacucacacuggguagggaugugguuuaugugcauuugcuagucaagaauucaucuguguggcaauaaggagucuucuaaccuguguagcaaggagauguuacucuuugauucuuguugcuuguaacaguaauuagauuuugaucuugaauucaaacuuggaggcuaaguaaaugucaucuuggauccaugacugaccauuccugaggaaccuuaaagagaacgcucccuguuauuuaaggauacuucauaacguauugcuugcucuucauuaaaaaaaaaaucacuccuaauaucuacuacaccacacugaccuaacugugguucaaauaugcuaaaugggccaggcgugguggcucaugcuuguaaucccagcacucugggaggcugaggugggcagaucacuugagcucaggaguuugagaccagccugggcaacacggcaaaacucugucuccaccaaaaauacaaaaaauuagcugggcaugaugacgugcaccugugauccuagcuacuugggaggcugaggugggagaaucgcuugagcccaggaaguagaggcugcagugaaccaagaucaugccacugcacuccagcccaggcaacagagcuagacucuaucucaaaacaaaccaaccaacaaacaaacaugccagaugcuccuguuuuaggacguuugccugggcuguuuccucugacuagaagaugcuuccccuaaaacuccccugggcuagcucucucaucucuguuuggccucuauucacagggcacguccucacugaggcccacccaacuguccuguuuaaacauauaacccacucugcauuuuaccuuugagggaacuaagaaaauaccaccccaaaaugugccacuguggcaugcugguugcuucaaacugagggcaccuggagaacagcaaaugcagugaggagcuuuuucugagcucccauuaccggccuuaggaaggauccuucaaaaggaacucaauugucaagaaaucuuugccccaguaaucucaccaaccagagaagaaaacuuggaucacaagagacaaaaagaaacaaacaaacaaagaaaaaaaaccacuugaaaacuacaacacccuuaaacuuuacucagaauauuuaaguggaaaaaguugacgggucuguacaauuuuacaauauugccuaggauuucauacagaaaaucaauuauuuacauuauaacaugcuuuaguuguaaauccguguuuauauuacaauugcauagcuucaauuucaacauguauaauguaaauuuaaaguuuuuauaaaggcaacuauaguaaauuuaaauaaugacuaauuuagcuuuacaauuugcucugaggggaaaaacacacugauuguccucacccuucacaccaguaccaccaccacgacaacaaaaaacaagaggggagccuggaggugaacccugcacucagacuauccccuaugcucugggccauuugucuuuccccgaauuuauuuacucuccccuaaauuuugacuauauccacucuaccuucuucccugggaagaagguauauaagcuucaaaaucucacuggccuuuuggguguucagguuucucuccagugauguccuccuguagguaacaaauuugugugucuuuucuccuguucaucugccucccuucagauuauuucguacacucacucaucaaacccucagaggauaaaggaaagucuucccaccccuacaucaccucuauuuuuuccuauagcacacaucaccuucugacagucaacaauuuccuccuuugugauguuuauuuuguauugucugucucccccacaaccuuaauuaauuaauuaauuaauuaauugagacagagucucgcucugucacccaggcuggagugcaguggugugaucuuggcucacugcaaguuccgccucccagguucacaccauucucccgccucagccuccugaguagcugggacuacaggcacccgccaccaugccuggcuaauuuuuuguauuuuuaguggagacgggguuucaccauguuagccaggaugcucucaaucuccugaccucgugguccgcccaccucggccucccaaagugcugggauuacaggcgugagccaccgcgcccggcccaccaccuucuuaaagggcaauaaacuccaggaugucagagaaguuuguuuguuuguuuguuuuaacuuuugcagauuuuauauauugaugaaucucugcuacccagaacagugcccauuagucuacagaaguucaauaaauauuaugccugucaggccucugagcacaagcuaagccaucauaucaccugugaccugcacguauacauccagauggccugaaguaacugaagaaucacaaaagaagugaaaauggccgguuccugccuuaaccgaugccauuaccuugugaaauuccuucuccuggcucagaagcuccccgacugagcaccuuuugacccccgccccugccugccagagaacaacccccuuugacuguaauuuuccacuaccuacccaaauccuauaaaacggccccaccccuaucucccuuugcugacucucuuuucggacucagcccgccugcacccgggugaaauaaacagccuugcugcucacacaaagccuguuugguggucucuucacacagacacgcgugacagugcugauaauacuccuuaacccuuucuucauuuuguuuuccaacagauaucucucauuaucaucaaugaugauuccuauaaaacauccauuugaaauguaguugauggccaggugugguggcugauaccuauuaucccagcucuuugggaggcugaggcaggaggauugcuugaacccaggagcuugagaccagccugggaaacacggugagacucugucuuuccaaaaaguaaaauaaaauaaauaauaaaauguaguucaugggguuauagauccuaccagauagcucuguaacaguaaguuuaaaaaaaacacuuagaaaauuuuuacagguaaaacaauaaaaguaauauuugaaauuauagaccccuguggaauuugaccuuuacuuacaauauuuauaagauacuaaacugcaaagacuuuucacagagcaacauaaaaguauguguaaggugcaagguacuucuuaaaaccauuguguuuuuuuuuuuuucugagaugaacaguaagauaauaauuauucuaugguaaguguacacacugucuccuuauagggcaagcagagucgugagcaugggagcuuccauuuauugaacaaugugcuuuauuccaagcacuguucuaggccuuaagcacgugaagaugaauaacaaauuuuaugccaccaaagcuagugggaagaagauacacaaaauaaguaauuaugguccaaccuaaaaauguaaacguucauuuucaggcaccugcuagggucaucuaaauaaugagaggcagcauauaaauaauaaacacauuuauaaccuacaacaaauuauuuaugcaauauuuuaaaaaauucuuuaguguuuaacuuuguaaaauuuuuauuauuguuggggaauuuuauuuucaguuagcaguuaguuuaaacuuaaguuguaccaggcuaaccugagagauuaugcucuuucugacaccguuaccugaaaagcuuugaugcagcagaaaauauacaauugaaaaggacaggaggauucccuauuaacaggcuaaagucaccuaagauggcgcugccuuucauguugacccuaguucacaucacagucugugucuucaaacaugggaagauuaaacacauccaagcaauuuacauccuugggggcacugcgggcuguguuauaugugacuuucccuugacgggguugugacccuuucucauugcuuccaacccaggaaaaagacuuaauuaaagacucuuugaugagacaaaagauauuauuuacauuagaaagaagagagagagagagagagagaaaggaagagagacagagagaaagagaaagagaaaggaaggaaauguugggccucacaaaacaauaccccacaguguggugccuugggaugcugagugccuugaacuaaaggugaaccaaagucucucugaucuucugucccguuucuugaccccuucucccagaagggcagggaggggcuuucucugaacuucccuuggaagaaaauucccaaauaaucagucccuggaaguauuuaauuuuccucauugacucagucucuagucacugcagcagcccccauugugaggagccuuagcaacacaguccgacagaucacuuuccuuagugaggauaauuagcuagaaauagcuuuuuggagaaagaaaaccuugaagauagcacaguuaacauauucaaagggacuaaaauugguguucucaacuuuaauuuuaacaaaaguacaaaugcauuuggugauuucacucauuaaaaaaaaaauucucugugaggcuuaucaaaauauucaagugccucuaaauccagcaaauucugcccccaugcaggacacugccacucugcuuuugcuuagucccuuaggucucagcuucaaagcacuugucagaaaauaccaaucacuucccaaaaccgcaaugcaaggccaagcgcagaucagcuguccauuuccguaugcuucccuaacaaccuauguuuaugucuguguuugcauuuaucacagugucucuguaacauauuuguuguagccacuacucuguuaaggucccuaugggugccauuuucacuguuuaauccuuauucccuuacagguuaucugguauugguacucuaguggucaauaaauacuugcugaguuaaugaaauaaaauuaagaauaaaagauguaaaggugcccugcucagccaucuggucaccugaaacccaaauagacauagauaguuuaaugcuuaaauaggauaaaucaucauuuuugccaaaugcuaagcuagcaaaucucugauuucggaauuaaaaagauuucagcagauccuccaaggggaaacguucaagaaaauaaauccguuccuuagcacuucacaggaaggcaauaaagugacuaucaaaauuaucuuguuugucauuugcuuuuucaguaugcuggcaacacuaaggugauucauuuaugguaagugaugauuauuucuguagccuaaaacauuaccacccuuacuuagguaagugagaaaguaaagcuucugaguuucuauuauuauuauugugaaauaaaguacuuuuugaauugugcuagaaaaagucaucuaagacuuggaaaugggcauagggauguacuguacgaacagcuuagugaacggugaacaggcuguuuuuuuugguuugcuugccuggggguuaccugaaccguuguuagacuugcuacucacuauuaugggaacaacaaucacaggaggcucauguuauuuacauuagaaagaagagacacacaaacacacacacacacagagagagagaaagagagagagagagaagggaagagggacagagagaaagagaaauaaaggaggugcugggguccacaaaacaauaccccaaaauaugaugcuuugauauccugagugccuugaacugaaggagaaccaaguucucucugcucuucuguuccguuucuugccccucuuucucccccaaaagcgcagggagaaccuuuuucugaacuuucccuuucuaaugaagggcagguccucugaaagaaacacauuugucaugaauugucucucugggaaucucaucaacuagggaagauggauuuauaucacaagaagggcggacaccaugcccagauugugacucagacucgcaccuauucuucugagggcugcuugaagacaacuuuuauuaccagagagacuuuaucugcaugacaagguaaccuuugcucgacaugcauuuccuuuccucaccucacauaauuugugucaccaccacccuuagaagccucaggccccuauuccuuucuguagcucaggauguuauauaagcuucagucaucgaacacauuuuccagucccauauuuugugggacuccaugcauuugcaguaauuaaaauuucuguuucauguuaaugugucuacugucaguugauuucauaggcucaauuaucaaaaauucagaggguagaaaguuuuuucaucccuauagaaggaaggaaaaaaaagaaauggacaaugaucaaaauaauuaaugcuaaaugaucuaauacagucuagaggcaguagguauaguaggaaacgaugcacuugaggucagaugauuuggggauuaaaucugcuacuuugcacuaugaacuuggacaaaucacuugaaauaucaaggccuuaguuuccugagguaaaaauggaguaucagacaaaaugggcuaggucauuuucaucucuaaaagcugaaaaugucauuuauucauugauauuuguuucagaagcauuuauugaagacuauuaugggaauaauaugaugucuauugcaaccuaugugcagugagcagaucugaauuccaaagaacacauuauugaaggccucagagugagccacacaugagggugguuuucagaguuugccuguguugcucuccacaacauaaugcaggugcauuccaaguacacaacaugacccccuugucuaaauuucagaagugccagaguugcuggauugguugguuccauuauuuacccucugauaguacugcuagaguggcaucuccccuucuaaaacaacagaguuuccacagagguaaaugaauuaugcuuccuauuccaaaugaagagcagagaagcaaaguggguggggcagagaaguagcaggcuccagauguggggcaagagauuagcugagaacaaccuguuuuaucccaaaggaagaaacagcagacaacgaaggucaugucauaaauauuuaaaaaccaacuggaagguacacccacuggcugaacaugggacaaugugaucaugaauaagaguaacaauugcaauagacuguuuuuuucuuguaaauuuguuugaguucuuuguagauucuggauauuagcccuuugucagaugaguagguugugaaaauuuucucccauuuuguagguugccuguucacucucaugguaguuucuuuugcugugcagaagcucuuuaguuuaauuagaucccauuugucaauuuuggcuuuuguugccauugcuuuugguguuuuagacaugaaguccuugcccacgccuauguccugaaugguaaugccuagguuuucuucuaggguuuuuaugguuuuuaggucuaacguuuaagucuuuaauccaucuugaauuaauuuuuguauaagguguaaggaagggauccaauuucagcuuccuacauauggcuagccaguuuucccagcaccauuuauuaaauagggaauccuuuccccauugcuuguuuuucucagguuugucaaagaucagauaguuguagauaugcggcguuauuucugagggcucuguucuguuccauugaucuauaucucuguuuuaguaccaguaccaugcuguuuugguuacuguagccuuguaguauaguuugaagucagguagcaugaugccuccagcuuuguucuuuuggcuuaggauugacuuggugaugugggcucuuuuuugguuccauaugaacuuuaaaguaguuuuuuccaauucugugaagaaagucauugguagcuugauggggauggcauugaaucuauaaauuagcuugggcaguauggccauuuucacgauauugauucuuccuacccaugagcauggaauguucuuccauuuguuuguaucuucuuuuauuucauugagcagugguuuguaguucuccuugaagagguccuucacuucccuuguaaguuggauucccagguauuuuauucucuuugaagcaauugugaaugggaguucacucaugauuuggcucucuguuugucuguuauugguguauaagaaugcuugugauuuuuguacauugauuuuguauccugagacuuugcugaacucaaacaaauuuacaagaaaaaaacaaacaaccccaucaacaagugggcaaaggauauaaacagacacuucucaaaagaagacauuuaugcagccaaaaaacacaugaaaaaaugcucaucaucacuggccaucagagaaaugcaaaucaaaaccacagugagauaccaucucacaccaguuagaauggcaaucauuaaaaagucaggaaacaacaggugcuggagaggauguggagaaauagaaacacuuuuacacuguuggugggacuguaaacuaguucaaccauuguggaagucaguguggcgauuccucagggaucuagaacuagaaauaccauuugacccugccaucccauuacuggguauauacccaaaggacuauaaaucaugcugcuacauacaugcacauguacguuuauugcagcacuauucacaauagcaaagacuuggaaccaacccaaauguccaacaaugauagacuggauuaagaaaauguggcacauauacaccauggaauacuaugcagccauaaaaaaugaugaguucauguccuuuguaggggcauggaugaaauuggaaaucaucauucucaguaaacuaucacaaagacaaaaaaccaagcacugcgcauucucacucauaggugggaauugaacaaugagaauacauggacacaggaaggggaacaucacacucuggggccuguugugggguggggggaguggggagggauagcauuaggagauauaccuaauguuaaaugacgaguuaaugggugcagcacaccagcauggcacauguauacauauguaacuaaccugcacauuaugcacauguacccuaaaacuuaaaguauuaaaaaaaaaaaagauguaggaugaacugaugaauguaaaauaucccauuaauaaacuuuuauauuaauugcccauugaugugguaauauuuuggauauauuggguuaaauaaaauauguucuuaaaguaaaaaaaaaaaaaaaauagacugaaguacauaaugccuaauaaacaaacauuagguuucauugauugccuuuggagaauacuagaaaacaaauuuauuuugaaaucuuauuaaagaaaaaaauaaacacuuguccuauaauuccuauaaaaaugcaggauaaucaucuaguucaacagguagcauuuuuuuuuaagggauaaauaccccaacuguaugaagaacaucaugauuuugcaacugcuaauaauuacacuaauggucauccauggcugcuaacaccacaaaagaacgacaaguagacauuuggaccucuugauggaaggauacugcaacaauuauaaaauauuauuaacaaacaaauacaacauaaauuuccucaaaucucuagaccauaccacugggaagauaucaguuaacaagacuguaggaaacaccacaggcggaagacuuacuuucuuuuacaaauaaacuuaaaauagggggaagagaaacagagaaagaaagagagacagaaaaagauugaaucuaaaaauuaagagacuuaagaaguagaucaacuaaucaguuuguagguuacaauucaauccgauuguacauaaaaaaauuacaggacaauuagggaaauguaaacacuggauauuuaaagacauuaagaaauuuguauuaauuguuucuagauauguuacuaugaugguguguauauauauauauauauauauauauauauauuuuuuuuuaagagucaaugucuuuaagagauacauacuaaaauauacuugucaggccucugagcccaagcuaagccaucauaucaccugugaccugcacguauacauccagauggccugaaguaacugaagaaucacaaaagacgugaaaauggccuguucauuccuuaacugaugacauuaccuugugaaauuccuucuccuagcucauccuggcucaaaagcucccccacugagcaccuugugucccccaccccugcccgccagagaacaacccccuuugacuguaauuuuccacuaccuacccaaauccuauaaaacggccccaccccaucucccuuugcuggcucuuuucagacucagcccgccugcacccgggugaaauaaacagccuugcugcucacacaaagccuguuugguggucucuucacagggacgccagugaaaauacugaugucuggaauuugcuucaaaauaauuucacaggagggaggagacagagguacaaauaaaacaacauuggcugugaauggaaaccuguugaggcugaguaacggggacacaggacuuuuacagugcucucuccaauuuuggauauguuuggaggcugaucacucagaagagaaaaaaucuacauuucuaauaauguucaggggauuauuacaauucauacuuauauuaugccagaaauuuaaaucuaauuucuaccucuaaauaagagaaugacuacccucauguuaucaccaugaccuacaucacacucaucaaauuuuuagaaaauaggaaaugauuacaguaaucaaugugcaaugaucaaauauaguuuagggguagugaauauuuauuuuagggacauaguaguaggagggggaaggaagaaaaggaaagggaaggucaaaggcaggaggagaagggaaaggaaaaaaaggauaugaaacacaguacccugcagaauguccucuaugccagaaaagguggagcaaaggcagacaaccaacaagagagagggaacaagacuuggcagaaaucagaaaacaaauucuggcccaccucuucuuggcccagucuuccagcuaagaaugcuuuucacagguuuaaauggaugggaaaucaaaggaagaauaauauuucacaauacaugaaaauuauauaaaaugcacaugucaguguccauaaaguuuuauuggaacuugggcaugcugauuuguuuacagguuaucucuggcugccauugcacuacaaaggcagaguugaauaguugugguagagaccgugaggcccacaaagccuaauguuacuaauauuauuuaccaucuggcucuucagaggacauuugcugaccccucaacaaaaguaacaagcaaaaaagcaaaaagaggaagaaaaauacuuuugcucuguagaacuuuuaagccuccuagaaugaaacugagaaaugacagucaguuccauaggagugaucaaguuaugagacagaucagugguggaugaaagaggaggauuuaacacgcccaugaccagggucuguuccaauuuccugcaugaggaaagcaugguauucuaagcauaaaaguacuugacaaccauuugucauuucuuguucagguauauuuaaauucugaaauguaguuauuuuaucaauuauugugaauaagguuguuuucaaauauuaaaagcuuaagaaacacuuaaugguauuaccugauauaacugaauacaagugaacccucauacacugcauugaauaguaucauccccaaaucauguccaccuggaaacugugaaugugaucuuauuuggaaauagcgucuuugcagauguaaucaaauuaagauaacauguuagaguaagaaugagccuuaauccaaugacugguauccucauaggaaaaggggaucugaacauggacacacacauggagaauaccaugugaugacaagacagagacgggagggaugcagugacaugccaaagaacucaaggauugcaaccaccagaagcuggaagaggcaaggaaagauuuuuuuccccagaaacuucagaaagagcauggcccuguggacaucauuauuucagaauucuggcuccccagaacuaugagaggauaaauuucuguuauuuugucaccuaguucaugguauuuuuuuuuuuuuuuuuuuuuuuugagacagaguuucacucguugcccaggcuggagugcaauggugccaucuuggcuuaccgcaaccuccaccuccuggguuaaagugauucuccugccucagccucccgaguagcugggauuacaccaugccggcuaauuuuuuuuuuuaauuuuuauuuuauuuuuuuaguagagacaggguuucuccauguuggucacgcuggucacgaacuccugaucucagaggauugacccaccuuggccucccaaacugcuaggauuacaggugugagcuacugcucuugaccaaugguacauuuuaaucuaucacucaacuuuacacaccauggaagcguuuaaccccuguucuauguucuaggcaaaagacggaagcaguggagaaguuuuuacaacgugguccuuauauauugggacaguuuauuuuagcccaauguauuaguucauucucgagcugcuaaugaagacuuaccugagucuggguaauuuauaaggaaagagguuuaacugacucacaguucagcauggcuggggaggccucaggaaacuuauaaucaucacagaaggggaagcaaacauguccuucuccacaugguggcaggagggagcagugccaagcaaagggggaaaagccccuuauaaaaccaucagcucucaugagaacucacucacuaucacaagaauagcaugaggguaaccgcccccaugauucaauuaacucccacuagguaccucccaugacauguggagauuaugggaacuacaauucaagaugagauuuggguggggacacagccaaaccauaucacccaaugauagcagacauaagaaaauauucuuaguaagcucacaguguagggcuuaugcacugauaaucauaaucucagacauuucagaggcuuacaaaugaggaugcugaauagaaaggcuguaauuucaccauagaauacuaugcagccauaaaaaagaaugaguucauguccuuugcagggacauggaugaagcuggaaaccaucauucucagcaaacuaacacaggaacagaaaaccaaacacuguauguucucacucguaagugggaguugaacaaugagaacacauggacacagggaagggaacaucacacaccagggccuguugcggggucgggggcaaggggagagacagcauuaggacaaauaccuaauacaugcgggauuuaaaaccuagaugacgaguugauagguacaacaaaccaccauggcacauguauaccuauguagcaaaccugcacguucugcacauguauuccagaacuuaaaguagaaaaaaaaaaaaagaaagaaagaaaggcuguaauuacaggcaaugccgaacucagaggccaaguucuuacagaaccacaauuaccccacagggguuuggcaggucucuggacuuuuguuuuucuaugcugaaaccauuaaugaucuuagaacugcuccuucccauuccacauucuaaguggucccagcaaccccaguguuugccugaccuauugcugcuggcaaugccaggauugaaaguacugagcauuguuucugaccuacgcccuugggaacuaaagggugcgaauugacuggagcaggauauggguggcuagcaaagaaccugaagcagaacaaaugaucauaugauuggauccccaggacacacguuuccgaacuaucaggaacuaacuuugcaaauuugaauuucccacucuuacucgcaaccagccccaagugcuuuuuaagaaaagugaugaaggggcugaaggaugggggauuuagacaugugaaaaagcacuucucugagaugagcuugagguaguuccuaucuaacucacauguuauuggugggaaauucauucauucauucauucaauaagcugcuuaccaugggcccagguaauggggcuuguuaguggugaauaaaacagacauggacuugaccuucaaagaauaucuuaaaagaugaaacagggaaagagacuaaauaagaauucaauaggauggguaauuuucaggaaauaaauagauuuuaguaaaaaauaccaacaggaaggaucuccuuagggugaacauggaccgugucaaaacaauugauauuugaacugguccuaaaagaucaaaaaguaagugauggaggauaaggcuggguugggagugaggggcauggguaggugggacaggggaaaguucuagauagaaggaagagaugguacaaauguuacuggaaagggaucccaauccagaccccaagagaggauucuuggaucucgcacaagaaagaacucagagcaaguccauggaguaaagugaaagcaauuuuauuaagaaaguaaaggcauaaaaaaauggcuacuccauagggagagcagcccugagggcugaugguugcccauuuuuaugguuauuucuugauuauaugcuaaacaagggguagacuauucaugaguuuucugggaaaggggugggcaauucccuggaacugaggacuccucccuucuuuagaccauauaggguaacuuccugacauugccauggcauuuguaaauugucaugacucuggagggagcguagcaaugaagacgacuagaggucacucccauugcaucuugguuuuggugggucuuggccagcuucuuuacugcaaccuguuuuaucagcaaagucuuuaugaccuguaucuugugccaaccuccuauuccauccugugacuuagaaugccuaaggauguccaggaaugcagcucaguaggucucagccuuauuucacccagcucuuauucaagauggaguugcucugguuugaaugccucugacacaaagguuguaagaggagaaacaacuuggugaguuccagaaaaaacaaaaggcugaaugaaugagauggggcucaggcugagguuagcaagaagccauucugcacaagguuugagaccccgagaaggaguguggauaccuaacacaaagaaugauaggaagcaccgacagguuuuaagcagggaagcaaaacaaucgaauuucuguuuuuaaaagaucacucugucuguuacauggagaauggauugggguagguagggguagaagaucuuguagcccugaauggaggugacaguagcuacaaucagggugauggcaguggauguaaggucaauaaguuuaacauauauuugacagaaauuuaaaaaauagaaguuauugguggguuggauauggcagguaguaaaagagagugagaaaaagaaaaggagagaaagagagacgaguguguaugaugacugccaguuuuuugucuaaaugaauaaugaaagaacacauuuuccugguggagggaucaaaaguuucauuuuuaacaagucagauuggggaugccugagagacaguuaaaugcugacgccugguaaacaacaagauauaaacaucuggagcuuaacagauguuggagcugcagcaugaagacggcauuuagugccauggaaauggaagagaugacugccaaaaaaaacaaaaaaucaaaaacaaaaacaaaacauuuauacgucaagcaaagagaagaaagcccaggguaaggccucaggaacuccaacuuuuagaggucacggagagucuucaaaggagauggaggucagugacaucuuguaagauucuaaguuagacacaguguauccuuacugcauagucaccaaccucucuacuccagacucagcaacuacgauuucugaggagggucucaggacagguggcaagguagaaagguaaaagugccacaacaaucguucagguaaagugcugugcacgcaaaugaucaagugcuagcuguaauuggaaaagcauuuugagaacugagauacggccguaaguuauuauggaaagcaagaugaagaauacucuucacuagaucauuugcuuccaucgaauacauuauuucaaaugagaugauguacaucaguagggaauauuuuaagccaccuaacguuuuuaaauguccccauaaaaauucugaaacuuuuucaauuuguaaauaugaguuacauguuggauagaguaacauuuauauccagaccuguacaauauuucccaaaugacacuucuuuggagauuggaaaauaaggcaucacaauacaauugcaugcauaaauuggugaaucauuugaaugcuaagguuaagggaugauaaacagagaucagggcuacuaaaucuagacaugagucacaaagcuaagaagggaauucauaaaaaguuuacugacuauggcuguuagaggagagugacacauuaagaauagagaaaauuuaugaggacaucaacgcucuuuuuauugaaggagaugauccuuaugugucucccuaucuuaguucccugaaaacaaucuggguaucucugcauucugccucugcucuggauuugggcaccaagcagaaagugaggggaggagggaagucugguuuugcuuuguuccucucucugcuauccuuugcucuccuuucacagcaauuuuauuucuucuuuuuuuccuucauucuaccccuuucucuuccuaucuccucucccaucucuucucucucuccuuccgcuuucucucuuguauaccauuaauagaaaggccuuucuauuuaagaugugauaagaacuuuguuuuuaccaugcucucuuuuuaccauauugcuucuuacuuuagagcuugccuugguuaaucuaugcuuuugacuaugauaaaaccuaauuuagucauucaggaaaaauucuucccuuuaaaacugcuaucuugcuuagaguuucuaaaagccuaguuuaaggcucaaagcugagaacaauaauaacucucaguuguagugaauauccaauagaacucagacucagaccuugacuuggaagggguggagaaggcgaaaacccagaaaauaagcagaucagauaguauuucaaagcauuuucuugcccuaagagcaugacuuagaaaucuuuauaucugcuauuuguuaauucauaagcagguagucaagccccucaucaaaggcuaccuuuuugauaaauaaaaacuugcucacuguuacauauggugagagcuaugaaaugcauguuaugacagccagaggacuggugggaacuucuccugccaccacgcaagccacugccagcuccugaagccacagcccgaagcagaagaucaaacccaagauaccagaggguagcugggcaugguggugcgcgccuguggucccagcuacuggggaggcugaugcaggguagucgcuuaacccgggaaguggagauugcagugagccgagacugggccacuguacuccagccuggugacuggagcgagacuccaucucaaaaaaaaaaaaaaaaaaagagacaccagaggguggcaaauccucucuugccuugcaaauguuggaauugcagaagugaaugugggaggugauaauaaaauauacuuucacauguugaaaccaaccccugcgucugucucuucaucuucaaagcagauauuagaacagugccugccuacuucgugaagcuguuuucaggaauaaauggguuacuacacaaaauucacuuaggagagagccuguuuuauacuaagccuucacuaaaugucaacaauuguuguaaucuggccuuucuccuccuuuaacagucuuuaaaaugucuaagaaacagagagauauugaagcuggacacacacuaaacagucugaagcaaaugugauaaaguugucuucuucaaaagcucuuaaaucuugucucccagaaugccuuaucucaaacaguaggauuaccuguaggauaaaugacaacaacaauaguaguagccaacuaugaucccaaguacaguucuaagcaauuugucauuuaauccuaacaccucuuuacaugauagguccucuaaaauugauauuuuacaacugaggaaauggagguuuuuaaaggccuaaauaaucuacccaagguuaaacagaugguaagugguaaaagggggacagaacccaagucuuuuuaacugaagaaccugugaaaucaaucacauggcugaaauuaauaacagagccaugucacuuaucauccaauucauuuccuagguuucccagaggaagaagaaucaguacauuaaccaaguuccuuggcuuaucugggcuuuaaauuuccacaacuguaaauuaugcuauacauacuagaugaucaguaagguuccuuccaucucugaaccuccacaguucuacuauuuggccaaagggauaaucagcaaaugaaaaaaaaaaaaauaagggaaggucuuaagaaagugcaccauuauuguuuuauucuuucccuacaauuauaaugucuguuccuuuuucauuucuccuaagugaaaguuauucugcaagguugccucaaggguaauguuuguuuuguaagaguuacagaaagauaaaaauauuuagguaaugauauucggugugauguaauuuuaauggaaauaauguuuugaguaagguuuaaucuuguuuuucaagucuuugccucgcauccugcagcuaugcaauaugugagcaguggggaggacugucaccuucauagcagcaggguaugaccauuuggaagaguuucucuagagcaauagauaauuuuggcuugaaguaagccuugaucaaagauuagacucuucauuuguccuuagggccuagaccuggagaagauaugaggggcuuaaugaaaauuucacaguggguuggagagaaauuuauccucuaugccuuguuaugcauuuuuuuguucuugucgugaaaauguggauuuguagcagaauguaauuuguugcagauaucauuuuauauuuucuaaacagugaaauguaaagaaaacaguuugaagauguugagaaaaggguaguaaauuugcuuaacaugaauugggucaugggauauuucauagaaucaaguuuauuugaaaaauacagaaaaguauaaaaaaagaauaaauuguguacagcuuaaucauuugcaaaaaaaaaaaaccagaaacaaccacuuuuaauuauuaguguauuauuuuuaguaauuauugguguauuaauuugcuauguaggcuuuuaauuuuuauaugcauauugucauaauuauaccauguaauccaauuauaguucaccauuuuguuuaguaaaauugaaugguuuauuuuuaaacuauauugauuaccauuagaauauuagcuuuagaguaucaaaauaauauacaaaaauguuucuucuaucuaaucauuuuuauuccuuuauauauuuauucauucacucauguaacaaauauuuacuaagugccuaagaggagcagcccuuugcuaggcacuaaagauguaagaauaaaucaggacacagucccuguucacaggcacuuaguccaaggcagaaauaauuauccuauacaaugucagugauaugaaagauaucaugaccugggagacagaggaagaacagcuaacucagacaauggugaaaaugaugguaugcuaauguuuuucauagaugacauugagccaugcuucuuggaauauauuaaucugucacuuaaaaagacuggauuaaggcagagaugaaauuucaggcaaagaaaauuuguaaaggcccugaacugcaaauaguuuacuauuguuguagcugacagcaugagaguuuaccuggugagaggaagaacagggaugcagauggugcaguucuuugaggauacaguaugccaguggacauuauccugaaggcuacuggggaacaaaucaaagauucaagcagaauaaaauaagaucacauuuuuauuuuuguaggacuauucugcugguuuuggggacaauugaucauuaagaguauaaucuagaaucagaaaaccaauaaacauaaauaaaaaagggaaggaaaugguaaggugguagcaauaaaagcagaggaaagguauuagauuagaagauacucaugugcugaauuguguccucucaaaauuuauauguggaagucuuaauccccagugcuuuagaauuugacgauauuuggagauaggaccuuuaaagaggacauaaagcuaaaaugaggccaggaaggugagccuucaucuaauccaacugaugucuucacaagaagaggaaaugaggaaagaccauuugaaaacacaaagagaaagcugucaucugccaaggagaaaggccacagacaaaaaaauaaaccuacagacaccuugauccuagacuccagaaguugagaaaauacauuucuauuguuuaagcuacccaguccaugguauuuuguuauggcagcccuaggaaacuaauacagauacuaagggaaaaaaugaaauuacuuguuuaguaaauugaugcuuggaguaaaaggcaaccuaagaugcaggaaaauuugaaggguuuugguuugagugaugaguucacacaggugcccuucaccaaguuaggaaauccaaggcuguaguagaugauaaauuuagauuggcaaaugaagacuuaaaggagcuuguggaauauuugggaagagauaucagcaugcuauuagaaccauaaaagcucaggggaggagguguagagguuugcugcucucucucacucaguaguuucuccucagauacuuggauguuccaaucccucauuuaaaaaugaacucaacuuguguuguucuaucaaacagggcuuuccucaucauucuauguaaacuauuaccuccuaccaccagcaucuacuucucugaaucugccuuuaaaauaccuaucaugacuugcuuagaauauauacauuugucuauguucugccucuucugauuagaguucaaacucugugagagcaggaaaguuauaaguuguucacggacagaauccucaguauuuguauauuaguccguucucaugcugcuguaaagaaauaacagacuggguaauuuaugaagaaaagaggcuuaauugacucaccauuccgcauggccagggaggccucaggaaacuuauaaucauggcggaaggcaccucuucacagggcagcaggagagagaaugagugcuaagcgaagggggaagcuccuuauaaagaccaucagaucuugugagaacucacugucacaagaacagcaugggggaaacugcccccaugauucaauuaucuccaccugcuuccgcccuugaugcauugggauuauuacaauucaacaugagauuuggguggggacacagagccaaaccauaucaauuuggaacggguuauggcauguaacaggcuaucaauaauuuuuuuaaauaaauaaaaaauaaauaaaagaagauaggaugaggaaagaaaaaguaaucagucugccaccuguuuuugugugacucacaaauuauguuuuuuacacuuuuaaaugguuggaaagaagcagaagaacaauauuuuauacugugaaaauuuaugaaacucauuuauguguuaccuguggcuacuuuuaccuacaaugacagaguucaguagcugccaaagaaaccauaugaggcccauagagccaacaauaaugacuguauggcccucuacaguaaaagccagauagauacaaucuacaggaucuuccacgcugcuggugaaaguccauauuggugccaccccuuugggacauaguuugucacuaauuucugaaacugaauaacuguauaguguuauaccaagaaauucuugcuaaguauauaccccugggauacucaugcaccuuuggaauaggugacauuuacaagaauauucauagcagcacuguucacaauggaaaaaacuuagagagaauccaaaagcuuauuaaugggagagugaaaaauacacuaugauacaggcauauacaacaauauggaugagucuuggcaauauuaugucauguuauauacagcaugauacacauuuuauaaauuaaaaauauauuuuuaagacauacauuuacaugccauaaaacuaugcaaaguacaucaagaaaaugcaggauucagguugcugguuacuucuagguagcaaagggagaaggaaaggggaaugagaaggaccauaaguucagcauauuauugacaugcuccuugcuguuuggagggcugcuggguccauaagccuuuauuauauuauuguaaaauaaaaguugauaaguuauugaugaauaaugacagucugucccaagccaaggauuauaaucagucgaacuuugugcaugcaaaggucaguuaggggaaacauuuucaccaaacuugaguucuagucuuaaaacuuuuacuaaccagcugucugauuugaggaaaguuacuuuaguucucuagaucuuuguuuuuuaaacaaaauaaagaauuggaucauuucuaaggaaacauucaauacuaaaugucuaagauucuauaaaauaagugguagaguuuuuuucuuuucaauucacagcucaaggaaaugauaaacagaaauaaauugaucauuuaaaauguuagauuuuugugaccaaacauucacuuaggguuucaaaagccaaucacccucuccaugaaguaaucaacauauacccuuauaaugcagagcagcacuuuugcuuuaauugcuaguugcugcauucuuuucguggucccuacaauuaaagaagccuuaagguaaggcaaugaaccaguauaaaugucucaaacaugaguaagugaugaggccccugucuacagaccagcugcuuaccagcacuuguugugagguugugugaauuauugaugcuauaccauaauuccuauaaaugucaguugccugaagaggcuuagaugccucucuuuuggcaucaggcuggccagcuguccccucaauguugccuggcacuaugaugugaaggaaagaacauaauggcacaucugauuagcuugguucuaauuauuauaucaauauagagaaaaaagcaauuuacagguugauaauuuucuuggguagucaaaaauuaaaaccuagggaaauaugucuucuuuugcauuaaaauaucaaaauauucaggguacuauagcuggaaggggugaagaaagagugcuucuguugauaaauucuaauacaucuauucacagaguauccucuuguuugagaacugucuccucauaaaguagugaaccucuuuugaaauguuuguucuagacuaccccagcaaucugguucuagcugaucaucuuuucuuggaugagaugaucccaucuucuccugggaucaucuuuucccuucucacaaaggaggguccaaauauauccagcaccucuuucucuguuuuuuguuucguuuuguuuuguuuuuucucucucucuguauguccaucucucuuucucuuuuacauaaagucucagacucuacaaaaaaaauucauaauuuauaaaguagcuuuaucuaucuaucuaucuuuuuggauucagaaauaguucugaguaaccugcuuuuucuacauuaguauuauggaacauuuaugauuggaugggagcuuaaauuuuaucuagaucaauugucucauuuucuaaacaggaaaacaaaggcucaggaaagcaaauuuauuuguccauggacucaggguuauacagacagcagagaaauauagcucaagacuucuggcuucuaacauaauauacuuuuaaauaaugcaauuuucuccccuaacaaugcuaugauggggaaagaaaaaacacacacaauaaaguauuuuuaaaaacaaaugccagggucuucaaauauauugaguucucucucauaagguuccaaguaaaauaccacuaugcgucuuauuugccuuuaaaagaauauccgaucuucagaagggagcuggacagugaaggauggaauggcagaauuuuacuagguaucgauaaaucuuugcuguugcuuuuggauaaaugauccuucaacagaacacuuccaacucuauaagcaugacguucagcagcagucuaguguuacaauugaguuuagguaauuuuuagggguguacaaaauccaaacuagaucaaguucaaaaauaaaacugagguaaaguaugcugaaauguaagcaaagcagccaugcagaaaacagaaauggggauucucuugucucugucaauuaauugcauguguugucuggcuuaugagguuugcacagaggaaggcucaccaacuuuaugcuauaaaaacacagguguaacauuucucugacauaaauaagugaaauugucaccagucuuaugagcucuagaccugcgucuugucuuagcaucgguucugaacugauaagguuuuaugaaugucuuauucacgacgcuaauucacaagugcugacccugcauucuguaaaucaaauagagagcaacaccuaaugaagagguagcugugguccacaugcuuaagauguugaaguggucccaggauguaauuaaauguauuuuagcugcaaacacuuccuuuccucacugcuuuuuuggggaugccucuguccaaauucucgugguuuguuagguugccaguaucuacucaauucaccaaaaacaagguaucaguuaaacaacuuugcacugaagugucacuagauuuuaaaagacaguggcuggaaaggguaaugaugagcacaaaugcuuaaucuucuguggguauaagugguagacucuguugccaggccacagguagcccauauggugucuuugcaugaauuagaaaaaggugucacuuuccccacaaaugcagaugggugccagagcaugugguuuccaaguggaacaggaacugauuucagcccugacucacuagucuggcugcccuugugcaaggaacaaccaacacaacuaaugacaagcccaauggcagcacaaaugcacagguuagcugugaaggguauuuccguuuuguuucugccucauucuuuacccucccauucccuccuuuucucccuccuuuccucuuucccucccucccucccucccucccucccucccucccuuccuuccuuccuuccuuccucuucucucucuguggguguguguguaucuauguaaacuaaaaauaaacuucuaagccccucagccaacugaauggaccccaccucuuggccaagggcauuuuaaaguuaaccugaaaagcuaguucagacccugauagaaaggaagagucagauaagccuccuuauacccuccuuucuuuugaaauucaggcccagcugaccagcauuaacaucaacacagaccuuaagacugauagaauggauucuuuaagccuguuaagaaacauuugcaaacuuuucucugaagccuguuaccuggaggcuucaucugcauaauaaaaccuuugucuccacaaccccuuaacguaacccagacauugcuuucucuugauucuaugucuuuagaccauaauuaaacucuuucaaucaauugccaaucagaaaaucuuuuaauuuaccuauaaccuggaagccccugcccccuaacuccuuccugcuucaguuucaccuuuccagacugaaccaauguacaucuuacauguauugauugaaguuuuaaaucucccuaaaauguguaaaaccaaguugggcacauauucucaggaucucccaagggccguaucaugcaugggccauuggucacucauauuuggcucagaauaaaacuuuucaaauauuuuacugacauauagccuauaaaguauuauauauaaacacauacauauguagauauauauacacacacacauauauacacacacacacacauauauauacacacaaacagacacacacacacuuuuagagagguaaaacaccacagaaauuccauagaaaauaauuuaaaauaaguuggucaauuauuuaaaaucugaauuaauuaaaggugagagauuauaaguauuuauauuuuuggccucaaaauuaccuuugccuacuauuuauuucuaguugugauuccacauuaauaucaucuauagcuauacacauauauugauaucauauauauagaucuauauauaucaucuaucuauauauuaauagaucuauauaucuauaaugagauaauaaauauuauuuacacauauauaauuguauacaauguaaauguauuuauauuuauauauaauuuuauaucaaauauacauauaaauuuguauauauauaacucaccaguuauuuuauuccuaacucauaguaaugauauuuauuguuuuuuaaauuagaacagcauauuaaauagugcaguauauaaggauauacugcauuauuugaaaaauaauacuccauacuugaaaaaguaauacacuuuaauuacuuaacaucuuuaauuggguaagccaaccaacccaggucuguaaauaugccugcugcugauuuggaaccgacauauggagauaguaaauuaggucaagccacgggaauucaauuuaugggaacugcuuuuaugaagcuguuucugucaaauaggaaagugcagacagaaggcugugggcaacacagagacucagagacugaugugcccuagcagacccaggagguccuaggaaggucacugagauucucacugagggucaugccaaucaacgucuguccuggccgcaugccuugucucaagaucuccgcaggccaucaagggcauccuucuccccugauccugggagcugaggauagggaguuuuugugaggcuuccccaagaggccaccucagcagagagaggccuguguaagcaugaagaugccugccugcuguagccucuucaaaacagagcuguuucuuucucagcagcaucucuggaucagagaggaagaggcaagaagcucugaauuuuucacaucgguaauaguggugcugcuaacccuuuuccagggaauuccauuuacagauuuaaacaugacauuuucuucccauaucuuaucuacacaaauuuguauucucuacuauuuuuucacaggcaaaccauguaauggcuuugacucugugguaauagaauagaucaucauacuucaugaaucaacagcuuuaauuuuuccauuugcuauuaggacagaauuugaaaauauuacuuaaauuuauccacuacauauuucagaauaaggaaaugacuuucuaaaaugauccuuuacaaaggaguaaauaaagauuugcccgccuugaaaaagauguugauuucugcuccuaguauuucuaaaaugucuaauaaauguauacagauggaauauuacuugaaaguaugcauuguuauauuucauaauuaggaggccauggauuguaagauacaccacucuaucgugaaccccuaagaaagagaaaaugaagcaucucaaaagagcucuucuaaucuuuuaaaaauuauaucacuuuugugcauacuugaaaaggaaaacauaagugacaugacuugguugagccauuccccaaauuucuucucuuucauagucuaacgcucuugaaacacuuugcggcuugaaucacugaugugcccucugaaugguucucucugucuacaaaagcauuggugacagaguucuuaaaaagguugagccucuauugucuccagaacuuuccucuaaggcacugaggccuauucuucaaguuuugauacaagugccacauguccacaggaagagacacccaugccaccgucucggcuuggccaauagagauugugagaugcuaccgauaguaagacacaugcugauuucagagauguugaaauugugaaaaaucauauggaucugagaaucaaugaauuauuuuguuaacugagacacugacaguaaacauaauguucauauuuuauaauguugacuuauagacaucuccccuuagagaauaugcugugaguacuuugguguccccacaauguggacaugugaggaauacaauuaucugcaaagaguuaaacuuuaaaauugguacauggaucagaauagaaaaauguaaacuaaccuauaugagauggauugauuuguaagucagaaagaacuaauuuuaaucuguuugacauuauauauauauauauauauauauauauaugucaugucuuuuauauauauauauaagaaaugagcagaaugguauuuguuccauuuuaaaaguuuggaaaaaaaauagaguuguaggagcagaagugguuggugauugucaaagcacuauccaauggagaggaauuuuauccagcagacugaaguagcaaaauaaugcaacaaacaggcuuagccguaugucaucaauucaugugauuuauguaauuccuuucaugcugauucuaagcccccaaauggagcugauuauguggaacugccauagagagaggaugcaguaguuauaauuuugaguuucaggguuucuagauaauuauuucucauaaauuaaauuaauuggcuuuuuaguuguauacaucagucuacugaguuuuauuuaaugggucauucgcuuaggcuuucaccaccucuugguuuucaacaaggucucugaacaauaauaauauuaugaauguaaucaauaucaccuuaggagacuuccugggaaucugcuugauagauuucccaggaauacacauauacauguuucugccugcaugccaaauguuugaaguaacaaaaacgauaucacaauaaugauuaaauaggcucuggggauuagaguccgcaguuaaaugaaugugaacauuguuuugcauaaggaaguccagauuaauauuaguagcuuuggcuauaguuacuuuuguauguuugguaaagucaggguaggauaugguuaguucagaaagaauaagaccagauuaacucauacgaggaaaaauaggaaaagaagcugacacaauuaauaagauaagcuagaaauaauaaaauaaauauauucacuauuuuguuuuacuucuguuaugauaauuaggauagauaaaucacuauuggcauaaagaauuucuuuacuacuaaauaucuggagggaauugauuuauucauucaaauacucuccagaauguuuuguagauagaaaguauucaaugacacuuguuuuguacuuuuuaaaguacuauaguuucauaucugcauauuaaauauaggaaacauuuucauauguaucauuugauuuaauaaauaacacucugggcuagauuugaaaugcccagaguuuggggcugcaaccugccucucaucccccuuauaaccucugaguccauaaggcauaaaaauggcauauuuugucagauuuagauuuguugaaacagagauuacauuuuaguaaagugaaccuauacaguaugaucgauaaccaacuuaauguaaucucucaaugucaccuccaauaagaacaugcaaucuacaagugccaguguaaaccaguucaggguaaagaauugaagauacuaagcuaauuuccaacaccacaacucucauuagaguuggcugucaauuacagacauucacuuguuugaaacuugaggcuauuaugaaaauucuuuaaaaguacaaugucucuuaaagaacuucaauaaacuaaguuuuuaauaagugauacaauucuuuauaucuuuuucuucuaaaaucucuuuguucauaucuuacagcacaaggagaaaaaauuauauaaucucacauuacauuccauaacucaaauuauuuauauguauaaauaggcaggcccuuacuauuguauuuucuuuaaucaauuagaaauauuuauuuagcaaacuccuacuauguauaaguucucugcuuuguauauaauguauauuuuuacaacagucauaccacuagaaacauuuuguuguuguuuuauuucagauaacuaaaccgaguacauguuguuacugcugaguugcuguuaagcuggaguuaaugacuaaucaccagauuuggaugggagaagggaaauucacugauaauaugucacaaugcuuuugucacaagaaauccuauacacuuacucugagcuacuggaaccugccuuuaugggcuuuucucuugguugaccaggggucuuauauuggcuuuauuuccaggaggaaaaacaacacaaaacucauuuugccaugcuauguacuuauuccagugauccugacauuguccaaagcaauguggagcauuuugauuggaauugucuauacagcaugguuccauguauauccauaaucaugaauguuucuccuaugaagguagauuugaauugugacaauagcccaaaauuacuuguauguaaaucuggugaauaaauacuuuuacuucugucuuuuaaacuagaccaaagaucuguuaaaaauauaauuugugucuuauaaauuuauacaguaucuuauaccucuagaauggcaccuggaauaaaguggauauuauaaugaagugacaaaaauggugaucuccaacaucacacaaagcuaguuuccacucuccugcuuaauaaugguugacucuaggccaguuaucuaccuaugauuuggcugccucacauauaaaagcgaauaguaauaguaccaccuacuuccuguggaauuguucacaugaagugccaugucuagaacacagcguuggagaaauucuagaacuuuauugaggaugauguuguuuaaaugcucaaaaugucagugaugaaugauuaagcuauuagauaaacaaauaaugggcugagcgcacuggcucacgccuguaaucccagcacuuugggaggcugagacgggcggaucaucugaggucagaaguucgagaccagccuggucaacaugcugaaacccugccucugcuaaaaauacaaaaauuagcugggcacgguggcacaugccuguaguccuagcuacucaggaggcugaagcaggagaaucgcuugaaccugggaggcgaagguugcagugagcagagaucgugccauugcacuucagccugggcaacagagcaagauuccgucucaaaaaaaaaaaaaaugauaauguaaaaaacaagaucaacaucauuuugcaaaccgauggaaauagacagcaauacaagguguuuucaggaaauguucgaacugucaugauugggguuaauucugugaagaugcugaacccaauuaaaaaaaauuucagcauuuaaguauggacugucaaaacauaagucucaauuuuuucaucuguaaaacuagaugugacuagguaauuaauauucucuucagcucaaaauucagugaggguguaauagccauuaccugaaacuuaggacuaagagcuugguaaggugagagacagaaggagaggccagggacggcaggguugcacagagaacucacaggggugggaggaguggucauuuuagaaugucuugggacagcuugucuucuuugagggaaggaauauaaaacauaguaauuguucauuaaauauuaaaucagaguuauaguuggaaggacagaaaaaggagacugucuaaaggacagaugugggaaugaagaguacuugggucaacaugcaugaacagucagcaaauaacucauuagaauccaguugaauaauuuacuaucaaaucacaacaucuguguuuuaaaauaaaguuaugcugaagacuucuuugcauuuagauaagguauucaauuuugacaauuugugaauuguacuagucacaauucuuggucuaaggucauacaaguuaauaguuuuggagaaaaguaccuauuaaauuagguacaaggauuuaguuaagccagaauuucccaaguguauguaccauugaugguuugugaaauaucauuucauaugauauugcauuaugauauaucuaaacaauaugauguucugacagcacaguaggaagcaaugucaagugaacuaaacacaaccuuucauggaaauuguugcuuagaaugagaauaagauuuuaaaaagggaguccauuaaaaacauauuuauuaaauaauuaaauagguggucuggggcuuggugaaacuucugaagacaaugcacaaaucacuaaaguuugagaauugcuuucuuaagguaauuaacuaucuaucagaaauuggcuauaaauggcauauuaauaauguaaacuuuucucauuuuucaauaauucaaugucucugacagcaacaacuguaucacuggcauauuauaacagauuauuugaaauaauuuuauacauacuuauaacauuauaaguuccacacaaucagauuuuauguguguuugucacuguguaccuaugccugaaacauaagaugcacucauaaauauugguuaaguaaauacauuaacaauuaugcaagcuuauuuaaacacauuaaaauucuaaaaacuguaccugggagauaacaaagaaugauaaacauagauauuucauaagucugggaaacgauucacacccucucucugcuaucugauaaaaccccacuguauuguacuuggcaugaagcuugcuguuaaucacaccacacaguucauuacauuuaaaaaagaacauaaugaccagaauuaggaagagauuuggaaccacgucaauuaagaauuuacuaaagugacugggaaguguaagcaaugacuuaaagauuauguuaaaagagaccaauuugcaagaauauuucugaauuaauuuuuucuccauauuuauuaaagauauucaauauuuuaaaauaauauugaugagaaacuaagaaacauugauuuugauuuaaaguucauaaacuuugugaguuuucuaagcuuagagaaggcaaaagacggaaaaguuguaucucuguugaaaaugauacuuuaauuucguaauacacaggguuuuaaaguguuuaaauaaaugguuucuuuuguaguuuucuaaaugaaaaguugauauugacaugcuuauauaaaucccauaauuuuuuauuuuaggaaugauuuauacuguauacuaaauaauuuuccacuaugguagaaaauuaauauaucauuuaaagcaacauucuuauaaucuaggaauauacuuaauaaauauacuucacaucucugaaaacaucaugauauaauaauacuguuaaagaaacccuuugcauguagaccugcuuuugaacacuauauucuuauuucguuuccuuuacuacacuaccguuaaugggagagcaaucaaugugaauaaggucaugucuguagagccaaagacaaauugaaccggcaccaaaaauucauuuuaaugacauugcagcaaccagaugagucagaugcuuaguguggccaugacaagcccucuaaauucuaaaugcuuucauaagaguucugcccaaggcuugaaacaagaaaaagaaaauaucaguuguuuuaucaaccaaucuccugcaaagccaacuucuuucuaaucaucucuuuuaauuagcugaacuuucauuccuuuacuuuccauuaucaaucaaaaguaucaaacaugcuuauaauaacugauuaaaaaaaucaccaugcagauaggcaauguaaugauaaaaccgcagcaucuaugaaacuuucugagcaaguuugguccuugccuacccauaguuacauacagauagauucuaaagcggccacaaugaaggaaguacucaaauguuguauagaaguuggaacauuuugcuaucaaauaucaauaggaauggagauuaggauuucaauauuaaaaaugaauacuguguauggaaauacuggauacuuaauaaauagaaucuggaacucccaaagaaaagauaaacuugaggagaguagagguggugagaacaaugacaccaacacgauaccaagagagaauucucuauccagagggggugagccuuucuugcaugguguguugcuuuauauuuguuugcagaugauauuuaacucauuuuuuuucucugaucucauuuuccucugagccuuugccuauaaaaugggguagcuauugagaaaaaaaaaacuuguuaugaaacagauauugaagcaaaagacagagcaguuaauagaaauaguggcuugccauuucagcccccuccugccaccccaauagaagaaacucuacaugggagagacuuuaaacguuacaugggcuacaagccuuuguauacacaaguagaaugggggcuacagauaggagugauuuagagagcaauggaagguauccugucugaaaauauugcuuccauauuuugguucaucuuguuguuauucucuuugaaaugcaaauaccacugggagaagaaacuauuauauuaaugugcuuagcgucaugucaaauccucuucuucuaucuacuggagaacacagagggaagacuaugguaauaaggauauauuaaagaagcaaugagcaaagcaaaauguaaagaaaacuaaugcuuaagcuggccugggauuguaguuaguaaguagcagcagugacgcagaaguaugaugaaugaaccgaggaucaucagugacacuguuaguaaaacacaacccuuuauagcauguuacaacuaagcaacaugcuggucacgugaaaguaaccaucucuugcacguguuuuccaaacugacugcuuuauguugacauaguuucuuuuauaaacaguugguaaaacuaccuggauagucaacucauaggcuaugugguuuguaauuuacuuuuaaaauacaucccaaggaugguuagauauaauugcauguguauuagacaauauggcucuauauccaaggguugguguaaggcuggucagucacccuaagcgagaacaaaacccacacuucauagggggguuggcuagcauuucauuaaaagaacagauuuuagagguagauacuaccccaaacguauaaguugcauuuaucauagcucaaaaccugcuauuuuguuacauaaauuuaauuguuaguugcauuauggaaguugacuuuucacugguggaagaaauuacugauguucaccuauguugcuuagcuaaaacauuuuaguaacucuucacucuugcaucaaaaugaugaaagaaucuagugaacucuuuaccuuuuacuuuucauaaugcugacugaggccugauucuuaaauagaucuuuuucagucauuaaauuagaggacucuaguuaccugaucccaguauaaggcaaacucaauccugcuucuagaauauuuucauauuuacuguaaaaacagccauacaaggacaaguuggagcaccuaaaaggauagagcacuuggacuuuuucaaguuuauaggacagauugugggaaugauuuuuuuagcauauugcuaauaaacgcaugucuucuaauuauaagugaugcacacucuuaccuaucucaaacuuguuuucuuauuuagcacugagauuggugguggcuacuuagcucuacugaaaaagacacaguggugaggucuauucacagcaguaguagugcugacauauaccagacacucugcuggguucaguaguaaacaagacagacauggcccuugaucagucuagaauccaguuaaccagaaaucauagagagaagaaaaaaauuuucaaauaauaauaauaguaauuuauauuauuauaagaacugaggguuucuucgaauguuucaaccuauuaaaaagugaaagugacacacuuaugccacuaaaugauacaggaugucauccaaaucuauauucuuuguguaaacagccuuuuguaaauuguguuacagagaauguuaauaucuguuuguguuucaguuuccauaucucaaaauugggacccuaauacuucucaggguuauugugaagaauaaaugaaacacaauagaugaaagaauuuaucauauuaccucucauacagcagauaaucaauaauaaacacuuuaagaauuaugacacuccuuaaccaaaaaggaaaauuuauuaauuuacauuaaaauuuggagauuuucauacauuuuaaaauacguguuuugaaacauguauuugaacuauuugguuuuaugacauuaaauuacagaauuaaaaauaaagaagcugcaccuugguuaggauggugaguaaacacuggcacacugacaauuaacuuauaugccuucuaaauccccuaaagcuagggaauucacacacacauacacacacacacacacacacacacaguuguauaccccuaaagcuagggaauacacacacacauauauacaccccuaaagcuagggaauacacacacucacacacacacauauaccccuaaagcuagggaauacacacacacacacacacacacacacacacacaccccuaaagcuagggaauacacacacagucucucacacacacacacacacacauauauauaccccuaaagcuagggaauacacacacacauaugcguacuccuaaagcuagggaauacacacacacacacacaaacacacacauaugcauacuccuaaagcuagggaauacacacacacacacacacauacacauaugcauacuccuaaagcuagggaauacacacacacacacacacacacacacacacacacacacacacacauuucccacaaagaccgggagaauaugaaucaauacuagcaauacaauuuuggaggauggaaaguaaaugaauaugugcucacugacuuaguagaaugcugaaucuuaacuugaaagucuggaaagaugagaaccaacccaacuuucgaccaugaauccauaaaagauucaguaauuaauaaaguaaggagaacugcauuaaggcuguuugacagauaguagaucccuaggucuccuaagccuuguggcugauugacuacuccucucucacucugggagauaacuggagguuuauuuucuaaaagaaucccugcauugagaagaaccaaguauuacaaagaauguggaaacuacacagaaaauggagauugccuacacuuguaccaaauacugaauguucaugcuguuagaccucuuuccccaaaugguuccaagauuguuggcaaccagaucagaaaccuccaggaaagaauuuuaaaacguauccuuagagaaccugacuaauaaagagaaaaugaaaaaaauaaugcugacaacagaugagagaguccuaaaacgggaacacucagcuuccucugcagugaggugaucaaauaauuuaucauccaaacaaggacacuacugagaauaaaaggaagagcuauucacaaggacaucagggcaaugggaguaaaaugggacuguacugagcaagccaggacauaauuguuacucuaacccacaguaaagcuccaagucaacaagacccucccacucguaauaauaaacacacagcuaauaauaaucacgaauaugaggaaagcugugaaggucagaaaaaaaugaacagaaucaaguaacuuggagaaaacuaagaaagaagggaaaaaaagauguuuuauuauccuugggauacaaaaaagguauugcauucauaaagcaguaauagaacgccauuagaaaaggaaauuuucaagaagaaaaaagaacucugauuuaaaaccacaaugaaaagcauucuagaaagagacaauagauaaaucauaagagacagaaucacaaacagauaaauaaaaagaaauguaagaacaugaguugccaauguuaaagugaacacccagcaaauacaugaaaacugaccuauuccaagucacguuguuuugaaauuucagaacaucuggaacaaaaacaagauucuucuaacuuucagagaagaaguagguuguacuaaaggaucaagaagcuaccaggggaugugcuauauccacauuagaggguaaaauuaaaaugaagaagacauuauauaaaaaucaugcauuccaauauaggggggaugaagacauucuuggauaaauaaacacagacauggugaagaugaaguccaugaugaugguauaccccagauauagagagcaaacacuucauguuagaacaaagugaaaugucagcaagaugcucaauauuauuuuauagucuuuuaaaaccugagagcaaaaagauaucagauucuacaauguacuaacaaacuucccgcucuguccuccaugcccugcugccuggagcagcaaaggcauucauuucaucucucaaaauuaugcugccuuguccuagcccugaaaccuagagcuacaccaagugagcuuagaaacagaaggacaaauagggguccagugaagauagaauaacauggaugcacauaaaagcaaaacaugaauaacaacaguaaugaugaugaagugaaugauacagcaaguuuuugccuaaucucacuuuuuaaugcugauuuuguucagaaaucugaguaaaaaccgaacaugagauuaauaauuaugugaagaguucaaugcuaaugaaauugucuguacguaaaugcagcaaacagauuuuuugacaacuucauccacagggauauuuuuucccaaaguuguauuuucauucuucauuaaugagacaaguacuuuuaugcagcaaucauuuauguggggcacugaaaaguuuuagggccucuaguuuaagucagguccaggaaauaaaacuuuaaauauuuuccaguuugggcaacauauaauauuggugcaauuuacuauuuaacuuucuugguuguggugauuggacaaagacacaagauaaaaagagagauuagcugcuauaugagauuuucuuucuaaaauuuccagggacauucugauaugaaacuugacauccucagaagaaauaaaaggugauccacaaauuggaaaaaccuaaaguuuggagaaacagaaacaguuauuauuggcuuuaaguuuagccggaagagagaaauuccuaguuaaaaaaaaguaugagauuauuccugugguuuuugauuuuugauugcaaagaaaugaguugaucuuaauugaauuucccaacauguguguguguguguguguguguguguguguguuucccauccuguuugaauaguugauuacuguagacuaggcaagaguuucagauuccaagugccagagguaaucaaacaacagucccuagccauccacacugugaagucuuucucggauuuugagcagagaaauugcauaagaaaggcagugcuuuuaaaagcacaaaaucaagcagugucuauaagauauuguuuugucagguuacaugaaaacauuugaaggaagagcauuugcauagagaguacgauuuuggaaaccucagaagggcugagugaccugugauauaccuaaagccacuucaucuugauuucaccuggggucuuguacccccuuucuggguccucuccugugguguaggccucacuggaucucaugguuuuccucucuuuuuuuuuuuuaauuugaaguuugaaaaccauuugagaacuucuauaguauuaaccuaucacuauggcugacacacaaugaagaugagauugcaaagaaagccuggcaggcagaagcucuggaaugaggcugaauccagaagggagucuuugggaguggguaauccguuacggagaagaguucuuuacaggcuguguuugaucagugaguugguuccgagauuuucaauugaagcuguaugagcagaauugaauucaaagauuuauacugauugugaagaacugaaauagcugaaugcgugaagcaggacuugcugagugauuacaaagguuuauaacaaagacagccugugagaggucgacaaagaggagaagaugugucugaaagaagacauaaaggacagcuauucucugaguggguuaaccauagaggagguaaacuagguuaggagacagaaagaggagagaaaauggcuuugaugagaaagaaauaaaaaugaguagagggaauauaauggaggaagccaguauacacaucagagaaauaguuaugauauaaaggaaaaugaagggguuagaagcuuaguagcgcccaacuuaugaauguuaauaagcccuaauauagaauaggagagcucuguguguccucauuucuacaugauuuccucucuaaaaggggaagaaugagacacuacgaucauuguuaccgaugauauccaguacaauuccauucaauccuguugcauauucaaacaagauuuuguuagauucaguuuaagacuuuacauugaaaaauuaacuagauguuggggauagaguuuaaguuauucugaaagcugggcucaaaccuuaagggaugauaaaccuagguagacaggaaauauacaaauuauguaaagcucuuagaaaauuauauuagagaaaauacuuguaguugaauuaagaauuaaaaaugaacucaucagaugggaauugaacaaugagaacacauggacacaggaaggggaacaucacacuucuggggacuguugugggguggggggaggggggagggauagcauuaggagauauaccuaaugcuaaaugaggaguuaaugggugcagcacaccaacauggcacauguauacauauguaacuaaccugcacauugugcacauguacccuaaaacuuaaaguauaauaauaauaaaaaaaagaacuaaaaaucauacuaauugccuauaaugguuuauauaucgauuucauuuaaaauguguccucugauuaaaaaccccaaggcauuaguuagauaauuaagaaguaaauuguuuauaacaaaaaugcuguccaaaccacagauaaugaaucagagcuguguaagaaaguuucaaugauaaugaagagauuugaauaaaaaaugcucauuucagcaaucauauugcaaaucguacuacagaaucuaaaaugaggagugcuguuccuauauaugugugaacuugugugugcacauacacauacacacgguaacuacaaaccagcucugaacacacaagccuggcugaaaagucaagcuuuauuauuuacuacauguguggcccaguacuuaaguucucugagcucuaguuucaucaucaaaaaaugggagaacaauaguauuacccaccuugugaggucgucaugaguuauuggaugaguuaaugcaugugauauuuuaaaaaugugccuggcauuuaguuugcccucaauuauguaugcagguaccuguauaaaauauacaaucuuuauugcacagugacuaauguguuaguaauugucauuucugguugacaagcaauuuuuauuuuugcuuaucuuuauugucaaaguuuuuacagaacaauauguuacaauuauaagagcauuaacaguaaagccuaagauuuuauaaucuaaauauggcacuguuguuacucaaaagguagaaauaaagguugcuggaauuaugaauaauuuacagaggcacauagguaagcaugcuaaacagaauucuaaaauggucuucaagauucuagccaccugguggguacaccaggcauaauacccucuccuagacuggggguggggccaucaaauaugauggggugucacuaaugggaccgggcuucuuuacauggaaaagaugaagagauuuugcagguguaauuaagggcuguaaacugguggguuugaguuaaucaaauggguaauuauccugagugacgaccaagucaggucagcgcuggaaagcgagucagagagcuccuccuggacaggcagagccacaaggcagggagcugggagcagcuucugggagcugagagcaaucuggggccaauagacaauaagaauaggagacgucagucuuuaaaccauaaggaaaugaaucuaucaacacuugaauaaacuuccaagaagaucccaagucucugguaaaacccaagcccugggugacaccuuggucucagccuggcaagacucugagcaguugacccaggucaccugugccuugacacacagaaacuguggauacuaaauuuguauuacuguaaacugcuaaggaaaauaguacagucaugugucacuuaauaacaggcauagguucugagaaaugugucauuaggugauuuggucauuguguaaaccucauagaguguacuuacacaaaucucaguggcauaacccauuacacaccugggcuguacgguaaagccuauugcuccuaggcuacaaaccuguacagcauauuacuguacugaauacuguggacaauuguaacagaauggugucuguguauauaaccuaucuacacauagaaaaggugcaguaaacauacaccauuauaaucuuauaggaccaccauucuagauguagucuguuguugacugaaauacuauguggugcaugacuguacuauaggauagaaacuguuuugcuuuguggacacggggagggggagguggagguggguggguuuaugauacucuccacuggagcccaaguccaccaccucagugacccauuuccuccugcccacacuguacuuguaaaacuugugagaaacauaauacuaaauacgauacuaauacugagugcaagcgcuuagaaacuuccguuacaagcucucuauaaauauuagauuaaaaagacacgaacagcuuucacuauuagagaggauaauagaauuugaucagcuaaauccuggggcuuuauaaagcacaaauuauguaaacaagcuuaauggcuuuuugauaaaacuacaaaaccagggcuaggaagaaugcaagaggaguacuuuauuuggacuuuaaacuucacgcacuagagcacagaugcuugcuuaaauuaagaaaaaaaugaaugcaaagggaguuauggagaaaaugaguuagaggauagaagaugaagaaaaauauugucuuagguuuaaggauagacaguaaaguuucaagaauaauggcuggaucgagcauuauuuacuauuguuacuauuaaucaucuagcagaaagaacuaagugaaagcagaaagaaccuuuuaaauacaaagguucaggguaucuagggagaggaugcugguaacaccugaagaaaauggaaaugaaaagcugaaauguuagaaauauacaauuaaaagagguugauacugaaaauauaagauaguuuauauucacaaaaguuuuaacaccaaauuuucagagggagcauaaaaauggagaaggaaggcgaggcuaacaaugaucacauuuuaucauguacccuaagaucuaaaaaaagaaaccaggcuuuggcuuucacaggaugauaaauuuuucuacaaaggauucugugaaaaaucuucucuccucaaugucaucaacugugcagcacuugaaaugcucuauaauuuaggacacccccuaauuucuaaauuuccaagagauguagcucugagcugcagacagucagaagaauuacauaguagaacuacugccuuacgauaaaaaaugaagagucaauuuaugucaaacuuagcaagaaauaguaaauucaagcuuguuugagauaagaagccucugucuaaauuauuugacugcaagcagugauuuuuuucaugucucaugguaacaauggaaauauuuuccuuuuuuuuuuugaaggaaaggcagugaagauaucaacuuauuccaauuacugaacuuuauuuacaagaaacccgagacaaagauuuuuuuauuuuauauuuauuuauuuuuugagacggagucucgcuguguugcccaggcugcagugcaguggcacaaucucggcucacuggaaccucugccccccggguucaagugacucuccugucucagccuccuguguagcugggacuacaggugugcgccaccacacccaguuaauuuuuguauuuuuaguagagacgggguuucgccauguuggucaggcuggucuccaacuccugaccucaggugauccacccaccuuggccucccaaagugcugggauuacaggcaugagccgccgugcccggccaaagauuuuuuuuuuaauguguucaagguccuacagugacuuugcguagcaucugccuguaggacaacuuuaccugguugaauuacagggacccaaagcaacauagaaucuuacccuuuuccuaguuuuccucugcuccucugugcuccaugucaugugguuaccauuuucaacuuucucugucucaucaggaacggucuggccaacuccucuucuuaaauacccaucaaaucaaucuccuccucuuuuacuuuauugccacuacuuuaagucuccauuuucaaccucugcauuacuacgggggcuuucgaacuuguuucccugucuuaucucuggguguccuuuggagaauauuauucacagcugucaaagugauguuuuuaauauacaaugccugauuaaauuacucuuuugcuugaaaccauccauugcuugcuuucaccucaggacaaacuuucaacugcuuugcauccuacacaaagcauuuuguaaguugaccuauuuuuccuucuccugauuucucagccgcauaacacccacuuguucuucaacacucagcucaugagucagccguuuuggggaagauuuugcugguguccuaugcagugcuugaaaugcucugucauuuagaacacccccuaauugccuaggauguagcucaauccauggcuccccuaugcugucuaugcagcauccuuagaagguucauuauuccuggccauaccauguuccccgcauucuaguggcuauuauuugccauacgucuguggcaccaccacauccacuguauaugugugcauggaugccaaguugcucuucauucuccaagucuuucugucauucucuaggauccaagcagucauuuuaaccuccacacagaugaucuguuugccccccaaaugcucucagacacuuuuucucuacuuacccucaauuauguauauuuuuccaaacacuuauuaaauauuuuaacacgagaacccuaaucucucucuauugaauuauugaguaauauaguuuggcucugaaucccuguccgaaucucaucuugaauuguaauccccacaauucccaaguguugagggaaggaccuggugagaggugauuggauuauggggacaguuuccuccauguacuucucauaauagugaguucucaugagaucuaaugguuuuauaaguguuugacaauucugccuucacaugcucucuccugccgccuugugaagaaggcaucugcuuccccuucugccaugauuguaaauuuccagaggcuuccccagccaugagcaacugugagucaauuaaaccucuuuccuuuauaaauuacucaaucucagggaaguucuucauagcagugugagaacgaacucagggaaguucuuuauagcagcgugagaacggacuaauuccucauccccccaccccccuucuccccuucccccucccccuuccuuuccccucccccucccucuaccccuccuccuccucuuacuccuccuccuucuucuucuuggcaggguuucuggcacucaggcuggaauucaguagugugaucauggcucauugcagccuugacaucccaggcucaagugauccucccaccucagccuccuaaguagcugggaccacagguuugcaccaccaugcccagcuaguuuuuguuuuugcuuuuuuuuuuuuuuugguagagauagggucucaccauguugccaaggcuggucuugaacuccugggcucaagcgauccaccugucuuggccucccaaagugcugggauuacaggcgugagucaucgugucccgccuauugaguuucuaagagcucauuccugagaugcuguuucucuguuacaucaacccccaaaugauauuaucaauucucauauauuaauaugcuaauaauuggcacauuuauaucucuaacccaaucaggcuuuuggggcucacccaacuguaaaauuugcaucucaguuuagauggcacauggcacuucacauuuaauuaggucaaaaguaaguucuugagcuuccuuuaaaacuguuuuacccuuaauuguccacuucuccuaaauggcacuaaaguucauccagcuacucaguccauauguugagaaguuaguauugauaacugucucucuuuaaacauucucauccaaacuuuuaccaauccugucaauucuaccuucaaaacagaucuaaaaauguaucaauuucucaucacuuuaaaccaucccuacccuaguucaagggagcaucaucucuucauuggacuuuugcaauaauagcuucagagcuggucccaauguuuucaugcugucucuuauagaagcccaagugguagauguaugaaugcaaucaagaucuuauuuuccugcuuaaaaucuuuccauagacgaccacccacugcaauugaaaaauaauaauaaaaaaaagcgcacuuuuuucugcccuacacuccuuauggcuggucugcucuggccugcccccacccaccuuuccccugcuuuauuuugagucacucucuuacgcucacuauguuccagccacugggauuucaguucuuuggaauaagccaaucucucuugugcccugggggauugauuuauauggcucauuucucuucuucaccuuuuugagugcuugccuccuuuuauacuucggauuuaggggagcauuuauaauuuuucaugacauagaguuacauaucaagacuuuauagacuacuucaugcuguuacucccuccucuucuuuaacauguaucucuugaaaauggaauagcccaagccaagcuuuguggcaucaugcucucuuuaugauguuaaauccacauucuuuccaggaaaaggaaggguugguuaguggcaaagaacugaaaggugccugcuggccuguaaggcaagauucuucaaggguccuugaacacacugauguuuguaacuaucuugaaugaauagaaaaaaaauucuacuugcaaaaaguuguauucugcuccuuagagcucagaagucauuugaagugcugaguuaaauugcagccaugcuguuuaagggagauauugaugaagauaagacauauguuucugagcaaaggguucaaugcacaggagaagcucuccugagaguagacuaguccuguguguuguguguguccuugauaugagaauuauguauauuauaguuuuguuuucuuuucuaauuuccuuugagaugaauuuaagaaaauaacuaaaauaaauucuuaauuguccaguccaagccacgaugcccugauuucccuugagguuaagaauagacuuuaauuguauuauauauuuucauauauuaggagaaaccagaaucgagauucuuauaaauuaagucaaguuaucauagguuaauauuuuagugcuaaaaagauaaaaaugaagguauauaaaaaagaauucaagugcauugacaaguccagcugucagugaacucuuagauuaaucucucugguaaguguguuccuucucugagacaugccuaaaguucuuuuucaaaauagaaaaaaaaauuaaacugggagcuagcaucuugcauauuucuaggggaaauuuagaaauuuagggggacgcuaguucccauuuuauuuuuuuauuucuauuuugaaaaaaaaauugagacaggucucacucuuuuagacuggagugcaguagugugaucacaacucacugcagccucgaaccuccggggcucaaggaauccuuccacaugagccacccaaguagcugggacauuuucuaaauagagauguggucucacuauguugcccaggcuggucagcuuccauuuuauuaucuucuccacaugucuuccauacuacacugaugcccucaucauuuucccuuucauucuguaccaugccuggcuuccugauacugcugagaguuccucgcuggugucugcuugccuagaguaccauucaugguuuucaguucuaguuuuacaaucugauuuccacuucacacauaaugaaucagagucugcagggguggagccaagaaguuuguauagaaaacaaaaccaaagacaaaauaaaacucuauaagugguucugaacuauagccagaagauccaugggcugcauauaauucaguuugaauuugccugaauaauaugggcaaguuuuauuuauuuauuuauuuauuuauuuauugagauggagucuugcucugucaccaagcuggagugcaguggcuugaucucggcucacuacaaccuccuccuccagggaucaagugauucuccugccuuagccuccugaguagcugggacuacaugugugugccacgaagcccagcuaauuuuuggauuuuuaguagagacaggguuuccucauguuggccagaauggucucgaccucuugaccucaugauccaccuaccucagucucccaagaugcugggauuacaggcgugaaccaccacaccuggucuaauaugggcaaguuauuuaacuacuaaagccuuuaaauuuuuucauccaauaacuuuuauugaagguuuaccguguguuagacaauaagcuaagaaccauaugcagauuaccuuauuguauucauacaauaaugcuaugagguggguauucucauuaauucauuuacagauaaagauucugagguuuacugaauuuagcaaaguuacuaaagugcccaauauuacacauguggugauuaaugaagccaggauguaaacucaagugucuguccaaaggauuugucaugauacuugacagaugguaaacagucacacucaguaacuaccaucaguagcaucuuauuaucauuacccuuaucauauuaugcccaggaguucacaucaaaugcuggucuuuugcuggagccaguaaauaaugcauaccucacaccuuccucuggauuuuugaagcguaagauauugccaagugucugauggaaaaucuguucuuaucuuagagaucugcacauuuuacacauuguuguggaaguugacaagaacccauaaucucauuucacauggaaguggagaaaaacuagguccucuucccaagaagaaaagcccaaauauauuucauaaaagcuucagguaauuuuugcuauuaucagaaugggauuucaggacuuagaaagauuucuucuaucauuauggagaaucgaggaaggucugucacgaucuaaaagcuuccucuagcaugcacagugagaauauuggagcagugaugcuaaauuucccuaaucuagguuacuaguucuuucuuugggcugaacuuugcaacuuuacuuucuguuuuuuucccccuacaugcugauuuuaaaaaaaugaugcuuaauuguucacaucaaacaugaacuuuuugaaaagcacagugucaaaauguuuuauugcucuaauaauacauuucaucaucuuaucuaacaaauccagcaauauguugcugauuagauguugugauaaaaacauagcaccaaagaaacaaaccauugguggaacuacuuauucgugacauauagaaaagcaucuucauaaaacauaaauaugacacaguuaccugucauguugcaguaaacuuucagaggccccagagguccgcugccaucaggaucuauccaguaauaauuugaugucuguccuagguguuuguaggcuucacaggaaggcucguagauagcuagaacaaacaaaauauccuacauaagcacagcacagaacaaauggcuccccagauaaaugucccaguggcauauugcaaugcuagcaaaccacuaguuaggaguaguucuuccuggaaagagcguucuuugucucuaaauuuaaauucaugauuuguuucuuucucuauaagcauuccugaccuaccaaagacagcaagcuccugguaugacuuuauguuggggaaaagacuaaaauaaucaauccuuaaauaaauguaauuuuuauuuuacuggggcucaugaucauugaaaacaauauuuaauuucuacuuauuuauagauauuauccccuuacuauaaaaaacuuauauuggcugcuuuguugguuaugaacuaagaggccaggaaaaauuacccuucacucucucugccucucucuugugcacacacacacauacacucacaugcacacuuauuuuuugcauaguuuguacaaguuguccauaaauaguauguaauuuugaaucuuccuuucucaaaaaaaggaaagagauuuccuugauucauuuuauuuguuccaggugcuuuaauuacaucaaaucuaguuuguguagacggcugacauucauguaauuaaauuauguucuuauucauuauuucccuuuuuauuccagugcucaugacaaauuuucuuuuucucacugagacugcaccuguuuucagaaguacaaaacggacauuuacauaucuccuuuguaguuagaacaucuaaaaugcuacugacaaaacuuucuuuuaaacagcucugcccaggaauuaaugaagaaugugaaaguuuucuucacaaaacuaagauauguuuucgguaaaaauaugucaaccugauacaaaagcagugaagucuuuggguaaguugcacuugaauuacacuccuuagggguuguuguguguuaaacuauaaaauaguacaaaauaaauuacaaaacauuguuaagcuuauauuguacuaauuaaaaauaauugcaugguccuagaauuagagagcuuucacugaggagggucucaaggucauugccaccucucuggauuuccagccuggcuaugcacaaaccucaguaguuacucuaacaggaauaauuagguucuggaaaaacuuguuucuccagucaaauucacuagagccugguuggaaucagaaagucaguuucauggguggucugauucugggaccucccuuuuuuaaccuuccucuaccaaguucucugugccuccuuuggcuuucuaugccuuccucuuuccaaggauguuagaccuucaacucuaugucauuuaaacaacagcauacuagauucaagcuuucuaaaauucuuugaucuacccauuucuucuuccaugccucccucccucauuuccucccuuugcacauaguuauugaggaacuaugcugcacugagcagugcguuaggcauugcagauacagcugugaacaacacggauagaagaccuucgaaaccguguuuguucacuaauuauuuugguauugcucauuuguaaacugcucuuagaagaggauggggcuagaaagcucggcaaagcccagacaacuuuugucccaguguaauuauuaauaugcccacuuucaaugucccaagggucucauucagaugauaaacuacacggcugcucuaauucagaaugucauaccaaguaaaacaguacaauaaaaagcagaggaaaaguauuuuuaaacuuuuagcaggaagaugccauaagucaauauagguuuuauaucaacuuauacagaaugaaaacucugugcagcaaugcaauagguuuuagggaaguaauucaaaagguaaaaagaguauuuaggcuguuucaacuauaggcugccaguugaaagauuaccaguacuuaaacuaaagcaauaugacaaagaauagaguaaauaggacugauucaauuuuuuuuuuuuuuuuuuuuuuugagacggaguuucguucuuguugcccaggcuggaaugcaauggcgcgaucucggcucaccacaacuucugccucccagauucaagcgauucuccugccucagccucccaaguagcugggauuacaggcauccgccaccaugcccggcuaauuuaguauuuuuaguggagacgggguuucuccauguuggucaggcuggucucgaauucccgaccucaggugaucugcgccucggccucucaaagugcugggauuauaggcgugagccacugcaccuggccucaaauguuuuuuuuuuuuuuuuaagaucggcaagacauagaauccaacuggauguaggugauuaggaauacagaggaguuaagaguaaacuaaacucacaaucuuugaaaauaaaacuguuuuguuaauuuuuuacaccucucuccagauuauuaaaauugguauguauagcucaagagaaaccaggaugucagguucaaauucuaguuuuccucuuagucccuuuguccaaucugccauugaaaccauuccccuucuuuuccauuauaauauuuaguaauaaaucauugucuuuuucuucugccaaaacuccuuaucauugucuuucauuugguaucuuguuuacaacacucaccuuauucauugguuguucuacccaaauaucuccucacuucucacuaaagugugcuuuuuaaccaauguucuucuaguuaugaaacaucacuuuuauguuaaauaauguguaauguuuccucaauaucuauaaauuauaucacagaucuucaucuauguguacaagaacuuggguuauccuaacaggucuuucuuggcuucagcugcuugccaaugugaauguugugcucuggucaggcaaauuccccacaggagcucgcuuaccucacacucacccuuucugguguggccuuuaucuacaauauacuaccagccacuuucucaaucuacaaaaguucucagucagaguuaacaauuaggccgggcacgguggcucaugccuguaaucccaacacuuugggagacuuaggugggaggaaugcuuggagccaggaguuggagaccagccugggcaacauugugagaccccaucucuacagacauuuuuaaaaaauauuaggccgggcaugguggcucacgccuguaaucccagcacuuugggaggccaacgugggcugaaggucaagagauuaagagcauccuggccaacauggugaaaccuggucuuuucuaaaaauacaaaaauuagcugggcaugguggcacaugccuguugucccagcuauucaggaggcuaaggcaggagaaucgcuugaacccaggaggcgaaggaugcagugagauaagauugugccaccgcacuccagccugggugacagaguaagacuccaucucaaagaaaggaaggaagaaaggaaggaaggaaggaaggaaggaaggaaggaaggaaggaaggaaagaacgaacgaaggaaaaaaguuuucuuuuucuucaaaguauaacaauuauugugcuugccuuucaccuacaauaggccuaagcugcuuugccucaucaacgcuuacagaaaaccaaacacuucaguccaaaauucugcaugugugaaacaccuggagagcuuauuaaaacagaaauuccuggauuucaccccaaagacuuggacucaguagagaauuugcaguuaugacaagcucccaaaugacgcuggcacuacuguccucagacugcauuuggagaagcauagauuucauccugaaaaaagguaaauucaagguagacuaauuuuuauuuauauuuaaauauccagcaaaaguagguuacugaaagacaauacaguaaaauuguacauaugauaagguuagaaugccaccucacuucacuggaaauaugauaaaauggaaugggaugcaaaaccauaaugucaaaagaaauauauaaauacacagaaaaauguuuauaaauacauaaaaauaguaagagguguuauuuuucagcaguaauauugugggugauuuaaaacuguucacagauuuuuaaauuuccuacaucacuuuauaaugugcauauguuauguuauuuugucuuuaaaauacauuuaaaaauauguaucuagaauuuugacacugcaguaaaaugacaagaauagcugugauagagcaaagucacauuaguuuuaucaucugaauaaagaauuaagaaauuuuagaucauaucuccuuucugucauuuaccgccuggauacucucccuaacgugguuuuuucaacuguaaaauugagguauuaaguuggugcaaaaguaauugcggcuuugcuaugaaaagucauggcaaaaacugcaaauacuuuuguagcaaccuaauaguaauaccuucuucaccaaguuguugugaagauuaaauaaaaucagauacuucaaaaacuagaaguuauugaguauauuucauuuuuuuaugcagagaaugagcuaaugacaguauuuacccugcaugccucagccaguuagcucugcacccaguggaguccuagcuggguugcacaauuuuugcacauuaagcccuaggagaugacagaacacaggagcuaaggcagcagccacugaagaaacagaagggucugaaccauugucgauaauugaguuuugccaguagacugcugaagaacagaaagguaauuggguugauggcaaaauaaauagacucaucaagucuauugauuuauuuguaaaguaauuuuucucuguugcaacuccaagucccaaguaaaaguucucaugcuauauauucauaauaucagcuauucagaaauauuacuacugaacauaucagauugaauuucauagcaugcaaaaauuuagacagugacaaguccuaaaugucuuuuuuuuuucuuuugagauggagucuggcucuguugcccaggcuggagugcaguggugcaaucucggcucacugcaaucuuugccucccggguucaagcgauccucuugcguuagcuucccaagcagcugggauuacaggugccugccaacaugucuggcuaauuuuuguauuuucaguagagaugggguuucaccauguuggccaagcuggucucaaaauccugacccccgccugccucagccucccgacccccgccugccucagccucccaaagugcugggauuacaggugugagccacugugcccagccacuaaaugucuuauucauuuucauuaaacaaugaaugaauguugucuguguauuaccuaucauggaaaaugaugaaguacuauuguaugaguuuccucuugcugcucuaacaaaugacagacacuuagugacuuaaaacaacaccaauuuaucuuacaguucuggagaugaugauucuguuaauaauaaugauacaguucugguuagaaguuugaaaugggguucacugggcuaaauucaaaguguugguagcacuguguuucuccugcaaauucuaggggggaaaucuauauacuugccuuuuccagauuauagaggccacacacauuccugggcucaucaucucagucccccaucuucaaagcuaggaauuagguggaauuucccuccugcugcaucacugcaacucucugcuuucauagucucuuucucugacuauuuuaaggagcucugucauuacacaaagccacccagauaauccaggauaaucuccucaaaucaaggcucuuaacaagcacaaagucccuuugccauauaaaguuacauauucacugguuccaugaauuaggacaugaaccucugguggggagcauuauuuuuaucacagauauauaaaaacuauauaaaauaauaugauuuuauauaaauaauguauggaaauaauaucacaacuauauaaaaaugaugacucuauuuaaagaauaacuuuuauuaagcaacuaaugugcuuccaguguuguggaugaacacaagguauauuaagcagaauaauaaagaaagacggaagaaugaagucaaauuuucauacugacuuuaaagguccacauagccuugaagguuaugucuaccaguagaauacgaaacaccauggcccaagcagacgaugugacagagaaauucuguuaaagcagaaauucugcucucugcuuacaugcagacguggccgcaggccuauacaggauugccaaaaugcuggcagaaagagaaaagcaaaagguuuaagaguaaagacaaguaacaggcaugaauugcugggaaauaaagcaucgauuaaagaauggauaggguagggggagaaacaugaaggaggcccuauucccuaggagaagagcuagaguuccaugacgcugaugagcugaggaagacucucuccacaccugucuacuccucgugcuuugagagaaacaauuaaacuugaaauauacauccuuccuguugugaccuugaaaagcaugaggaucacuagaaguggccggguauuaacccaugugagaaacuuacucauaagucaaagcugagcacauacauaaagguuaucuuuggaacaucauaagcagucuuccugacuguacagaagagggaaaaauauucacuuuuaaugauuugauaugaaacugggaaaaagcaugaaauaauuuuaaaucuaauuuugauaagaaaugcuguaauauaacauuuugcguauccaucaaucgcuuaugaaugcccucaccuuucugcucuuuuauacuggaggcgaucacaugcuuacuauauacuuguacauacuugcuguagggaccagguuauaagaugcuaaaaugagggauugguuuucugggaauuucuacccuugaauggauaaagaagccuuuucauguaaaacguaggcauagcggcgauauaguuuauauggggcuuaucuggguugguauuguucaguguaggauggucucuggggcccuccuuauucugcucccuuuuuaaccaugaaaccaccuucugauccuaaucuugcuuucaaaaauaaguuucuauauuggaaagagguaauucucauuagaaaccaugaaacugacuuuuuuaucucaacagacucuagugaauuugguugcaggaauguguuugcccagaaccuaauuauuccuguuaagguaaccacugagguuugugcacagccaaguuggaaauccagagaggcggcaaugaccuugagacccuccucagugaaagcucucuaauucuaggaccaugcaauuauuuuuaauuaguacaauauaagcuucacaauaccuaaguccucauuaacacuugaauauuaaccucauauguucucugucuguuuggauuuuuuuuuuuuagagcuugaaugaauacccugaguaaacuacauuauuucccuuaggaaccauugucucauuaucagcacacagcaaaugaagaugguagagagaauguggauuuaaaaacagauauucuguaugcuaauauugugucaugaucuuucccugcauauaauuucuguaugagauguuauucauuauagcccccuaauggguuuauuuaccuguccaagccucaaggggagggaggaaauuaggauuuuuuuaaaaaagacaaaguuucaauuucuuguugaaauuacaauagcuuguaguucuuuuacuugauaaguccuucaaaaaguuucugaaagccagaguauaucuacauuuauuauuucauuucuacucucucccuuccccauacccagcccauuuuuucuuuuguuugauccuucccaaaucccucuauaaauuggcuucaaggcacuguuucaaagaaaaaaaaaaauaauccauacuauugcaaugccagucacaaaaccaggacucuuugccccuguaucacugugauugccauauuuccuggagacuucaauauccauucuugguauucuuugaccugcacuccacaauauaucaaauuuuccuguauuacaugacuaaaccuaaacaacucuacuuguauuuuauucaggguuacuauuagguuauagaaaacucuaagaaggagagaaagccuacaaaauccaacaggcaugcuacaaacacgcuuccucaauuuaaugggucuggacgaagaagcuuagcauccaguucaucuugcucagauccuauagagguugcuuauguugcugcaucuccugagucuccauucccaucucuaaccuucucucucucauuuccuuuuuuuucuuuucuuuugagauagaguuuugcucgucgccuaggcuggagugcaaugacgcgaucucggcucacugaaaccuccaccucccggguucaagcgauucuccugccuugguagcugggauuacaggcacgcgccagcaugccuggcuaauuuuugugcuuuuaguagagacaggguuucaccauguuggccagacuggucucuuacaccugaccuuggcccucccaaagugcugggauuacaggcgcaaaccaccaccucagccccuuucuuauugcuaauuauuuuaggaacaccuacuaaugugguaguaguaucuaacacuauaccuugcccuaggaagaaaaaaguaaaaaagucauaaauccuagcucuggggaauuugcuauguaauacauggggcaggcauguuaacuaaauaauauauauaauuuguuagauguuauaaaagauuauaaaacaaaguacucagagacuuuagaaaaauaaacuggauaaguugauuuaggacaguuuggaaauacuuuauuugugaagugguuuuaugcuaagucuuauaggaugaauaggagguugcaaggaagacaagagaaggacuuuccuuacacuuccuccccagaaccaugugauuccaugcuuguccugagaucauuuaaugguuuucuccauuuaccuccucucuuuuuuccauuggcugcaucuucucuauucaucugcacuggucucugcgaucuuagauucaagggcagguagacacgugcuacaugcuagucccguuucccuguccaaucuaggggaacuccugcuucuucaccacuuacaccuuagccccucaagucagaauguuaucacugcugucucaccuucaagaaugucacugauaccuacccugggcuuucacuacguucucauucucuaggaguuuaguagacauugucauuguuggcugacuccucauggaaacauucuucucuucauuucugugcccuuagcuuguauuucuuuuugccucuugacuguccuauccugugucuugcacugucauuuuucuucugcuggccuggagagagagcuauucuucaagggcucugucacugccaucugcucaaagcaauuauuuaauaguuaacuugucuaggauugcucaccuagaaaaaggcagagccaggauuugaacacaggaauucuggcuacaggguccuaacacuuguuuaaacauugugcugaauuguuucuacugauauuauggaggaagaaggcguauuuuauucucauuguugaaggacaguguggagaaaagugagggaugugauucacuaaggaaaugacucuuggaaguguagauuuuucuuauuuauaucucuguguguguguguguguguguguguguguguguguguugaggaaaguaaaauggaguaaagaaauucaaauucuccauuuguuuuuagcuaaacaaaucacaguuaaaugaaaaaucagauuuuuaaauuaaaaaguguuaauucuaaaugcaaacuuuagucauuuaaagucauucuaugauucaaauaauaaaaagauagcuacguuuguauacuaauuuacagcuuuaaaauguuuuacuguaauuuauggaauucaaugaaugaggcaauaggacugauuuuuaauuguuaaauaaagccuuuuaaauuuaaugaaaaaauaaaccauuaaaaaaugugagcuucaaaauuugaaaaugaaacaggccguuucccauagcagaaagaauuguguuuaaacucgcauauaacucaaauaaaaaacaaacaaaauacaccgcccaaaacugaaggccauagaaggacacagugggaagacuuuuagaucaagaaucagaacuccuuuuugugacuugguucuguaacuuacaguccauaugacuuggauuauuugccacuuaaauuuucugaguauaaauuuucucauaaaaaugaggaauuugaugggauauucaaguuuuacuuuggccaagcacucuaaguuaauaguuuauggugcauauuucaaaaggccauaauaaucugaaugucuuugcuaagccuuuauaauuucuuguccauuauuuaaguauugauguaguaaugaagacauuauuggugauuucagagcucuucagucagaguuaaaagaagauucaaauauagauaauccuguuaagaaauagagaacacccaucgaugaauacaaguugagagucuuuuuucaaaccgaaacagcaacaagauauuagcauccuugagagucuacuguuaaaaccaaugcagcaacaagauauuagcaucugauuuagguucaggauaaggaacuucccaggcaguggcuuucuccaacuucuuuugagauaugaggauuauauaaauguaggcuuguuuuauaauaggacagguuucaaaaauaucagacuauugcuaugauugcuaaauguggcuuacauugcuugagauucuguuaaagucaucucagaaucagaaucaaauaaugaaauugcuagucuucaaaguaagccccuucaguagagauuaaggagucaauaacuucagcauuccuuacacaaucaaggaccagagaaguaauaauauuuucaaauauuccagaaucuuaaagcaucugccaaaaucuaggcacauagaaacugcugcauuaaacuauucgcacuguaaugaaaguuuuugugaucuuuauucugacuuuauugauccuauuuacagcagacagcaugagaagaaaaacaauuuauuaccaccugcuagaauaguugaaccugauaaugauauaccugagcuaacaggagaaaccuauacuguuugucuucuaauuuaagaaaacaagaaagccuacauauuucuggauaauguuuaccuuaaugcacauaagaaccauaucauaauuuuugcuacauccauaccugauagcacagugccugguguaugcaaguuagucagugaaagcucacugaauauuuaaauucuaugggaauaguauuuuuuauggauacuaucuccuuacccaguauuuucagauaaauuuaugauuucuuacagcauugugguuuaaguacacacacaaacguauauacuauaucuauauguacauauaguacauauauuuucacagaacaauuuuuuucacuucugccuuuacuuguuaguuuaccugcuauauaauaucuguugugguuauuuggggaacaagaucguuucagaaggugcuggcccagcucuacaguugccuggcauugucuuuccucaguggccagaggcaaagcaaaugaacuugacauugcugcugagggacugcuccucuccccacaucagccccuucccuuuuucuucacuucaguuugagacuuucuuccacucaugcucaguguauuuaguccauucucaugcugcuaauaaagacauaugagacuggguaauuuauaaaggaaauaguuuaauggacucccaguuccacauagcuggggaggccucacaaucaugguggaagaugaaggaagagcaaaggcauaucuuacaugguggcaggcaagagagauugugcaggggaacuccuauuuauaaaacaaucagaucucaugagacuuauucacuaccacaagaacagcaugguggaaaccaccccaugauucaaucauuuccaccuggcccugcccuugacauauggggauuauuacaauuuaaggugagauuuggguggggacacagucaaaccauaucacucagcucucucaaaaaagagaaccccacugaaaaauaauuaacaaaucccaaauauauuuuuccaccgggaauuucaaucaugaucaaauugagugauuuuuuccaaggcauuuauguuguuaaaaguggaagaauaaagucauauuugcuaaggaucugcaguacucauuucucauuauauagugcaacuucuaaauccuucuaugaaaauugugauauuccccccucagagaaaauuuccauaaaagaaaaauuuuuaucaaacaauuauaugaucauugacauucuaauaaaaauaauguauugcuuuauacagcaugugcaaccaaauaauucaaauauaaugcguguguuauuuaaauaaauagcucugauuccaggguguaugugauaagaaaugggggaagaaaagaagacaugguguggauaauuaacuccucuauguagauuacauauuacuauaucagacacaucgagcccacugcuucaaaucccuugacucaucccuuauaccagaacugcuguggugacuacuuuuuauagaccucagcaggauuugccaugggaggcauuggucuuaccauaucugucaaguauauggguuccccuuuacuucaaagaauggcugugaccuggucacuuaaagcuccgcagguuagaaguccaguugucucuguuugcagaugacaugauuuuauauuuagaaaaccccaucaucucagccccaaaacaucuugaacugauaagcaacuucagcaaaaucucaggauacaaaaucaaugugcaaaaaucacaagaauuccuuuacaccaacaauagguaagcagagagccaaaucaugaaugaacucccacucacaauuacuacaaagagaauaaaaaccuaggaauacaacuuacaagggacgugaaggaccucuucaaggagaacuacaaaccauugcucaagaaaauaagacaggacaucaacaaauggaaaaacauuucauccucacggagaggaagaaucauuaucaugaaaauggccauacugcccaaaguaauuuauagauucaauacuauucccaucaaacuaccauugacauucuucacagaauuauaaauguuuaaaauuucauauggaaucaaagaagaccccaaauagccaagacaauccuaaguaaaaagaacaaagguggaggcaucaugcuaucugacuucaaacuauacuacaaggcuacaguaaccaaaagagcauguacugguaccgaaacagacauauagaccaauggaacagaacagagaccucagaaauaacaccauacaucuacaagcaucugcucuuugacaaaugcgacaaaaacaagcaauggggaaacgaucuccuauucaguaaaugguccugggaaaauuggcuagccauaugcagaaaacugaaacuggaccccuuccuuacaccuuauacagaauuaucucaagauggacuaaagacuuaaauuuaaaacccaaaaucauaaaaacccuagaagaaaaccuaugcaauaccauucaggacauaggcaugggcagagacuucaugacaaaaaugucaaaagcaauugcaacaaaagccaaaguugacaaaugggaucuaauuaaacugaagagcgucugcacagcaaaaggaacuaucaucagagugaacaggcaaccuacagaaugggagaaaauuuuuggaaucuacccaucugacaaaggucuaauauccagaauuuacaaggaacuuaaacauauuuauaagaaaaaaucaaacaaccccaucaaaaagugggcaaauaauaugaacagacacuuuucaaaagaagacauuuaggcucccaacaaacauaugaaaaaaagcucaaauucacugaucgucagagaaaugcaaaucuaaaccacaaugagacaccaucucacaccagucagaauggcgauuauuaaaaagucagaaaacaauagaugcuggugaggcuguggagaaauaggaacacuuucacacuguugguaggaaugaaaauuaguucaacccuuguggaagacaguguggcaauuccucaaggaucuagaaccagaaacaccauuugacucagcagucccauuacuggguacauacccaaaguauuauaaaucauucuauuauaaagacacaugcacacauguuuacugcagcacuauuuacaauagcaaagacauagaaccaaccaaaaugcccaucagugauagacuggauaaagaaaauguggcacuauacaccauggaauacuacacagccauaaaaaggaaugagauuauguccuuuucagggacauagaugaagcuggaagccaucauccuuagcaaacuaacacaggaaaagaaaacccaacaccgcauguucucacucauaagugagaguugaauauugagaacacauggacacggagaggggaacaacacacaccagggccuguugggguguguggggugcagggagggaacuuagaggauaggucaauagguacagcaaaccaccauggcacacguagaccuauguaacaaaccugcauguucugcacauguaucccguuguuguuguguguguguguguguguguuuagaagaaauaaagacaaaacaaaaaaacaaaaauaaaaacaaaaacaaagcuccucaugccaguggaccaucaagcaaagaaaggaguuacuacuguucuggcaaagguagcuuaucugaaugagcugaggagacagcgcugcugcccccuagcaggcagggagaagaaugucuggagcccaggggauugaauguaauaccuguugcugcuucugugcucaguguuaauggugauuaagcaaccgcagcauuaguggcuggugaagagcaagguaacuaaggaccuagaucuccaggagaugaaagucugggucacugcaucagucaagcaaccagcugaaauacuggcuuaggaugaguugaaggaaaggauaaauaauaucaauuauugccuuggauucagcuguaauacagggauuaucacuuauucugccaaucuuuuguauugaaacuuugcagagauugaagaugacuuuaugacagauuagacuugagagaagacaugagcaagucucaguucugcaaggggugggcuguaucagacacuucuuguauacuaauuuauauccuuuuggccccaccucuuacugcagccacugcugugguaaccaaugucuccuagguuuugauuagcuaaucacagauacagcaucugcccuguuccucuugcuucuugcccugaggguuucauugauacugcagagcaggguuagucucagaaauugauguggccucaugcaugcauaugccaaaaaucugguaaagucaaugcccuuggagucacucgaacaaaggggaugagaaucaguuucauccauguguacuccugggcagaaagaucugcgauguguuucagagguuuccucagggagcugcccugggacugaaaaccugacucaacugaccacagucaacuugacaaugcacuguuguauuggcuuuucuccuuucccuguacacuggcuucacccaagcuccaaggggucacacaaaucauauugaguauuuaacuguaauaaagcauuuguccuaggcuaagaaauuaugaugcacaaguacauaucuacuuuuuuuaauccucaaaagaugguguuacaauaacuaaguaaacggucuuaguugugggcaugucccuugauguucacuuuuccagaagauuguucuauacucagcacucaucuagcauagaguaggcacuugauaaacagcuuuuaaugaauuaauauauaaguaauauaaacuguuauuaaacaguaaguaacuucacucuaucugaauaaaauuauuaauaguuccauuuucuuuuuuuccugcugaucuuuaccauaccaacaugauaauguguacauaaauaugcaauugcacacauugacagaauuuuacaguaguguucuuuaaugaaucauaccuccucucaucugugcucuugucagggcccucccaccaugauucugggucugaucauauggcuuguuuugauuaaagagacauuagcaaaugugauuugauuagucuguucucaugauguuaauaaagauauaccugagacuggguaauuuauaaaagaaggagguuuaauugacucacuguuccacauggcuggggaggcuucacaaucauggcggaaggugaaagucacaucuuacauggcggcaggcaagagagaaugagacccaagugaaaggggaaaccccuuauaaaaccaucagaucuuggagacuuauucacuaccacgagaauaguauaggggaaauugucucccaugauucaauuauuucccacugggucccucuacaacacgugggaauuaugggagcuacaauuuaaggugagauuuggguggggacacagucaaaucauaucagugaugcaaccuuagguuuuaaaaguugcuuuucaaaccuaugugaagaaagcugggcuggcuugcuggcagcauauggcccagcugaggaacagacuaaccaucagacuuguguggaaggacauggacaucacagacugcccagccccaggcaagcugucauuugacuacagcugcaugaauuacccuauggaagacuagcaaagaauuauucagaagagccuaucucagacugauaaccuauucgaaucauggguaaauaaagugauuguuguuuuaagcacuuaauuuuuagggaggcuuguuagauugcaauagauaacuaacacagacaacucacauacacacaguuguguuggcuuacauuuuuuuucuaaaaugguaucauacuaaccaaauuuacucaauuauugcccacugaagguuuucacuuugugucuaguuuuugcuacuaccaaaaugcugaaaguaaacaucacuaaaguucugguuucaguagacaaauuucugagugaggaguuagggcuuguauuguugagcacaaaaggcaucgugcccagggcccacaagauguuagggauucagggaauauuuuuaucuuaaaaauuuaagaaaaaguaaauccaguaauaauaaauucaguuugacuuauauuccucuuuacaccaacacaaucauaaaauauauuuucugucuguauauguauacauacauauauaugucuaugaguacguguauguguguguguguauuaucaguucauucucaugcugcuaauaaagacaaacucgagacugaguaauuuauaaaggaaagagguuuaauggacucacaguuccacauggcuagggaggcucacaaucauggggaaagauaaaggaagagcaaagagacaucuuacaugguggcaggcaagagagaaugagagccaagcaaaaccggacaccccuuauaaaaccaucagaucucgugagacuuauucacuaccacgagaacaguaugggggaacugcccccaugauucaauugucucccaccaggucccucccacaacacaugggaauuaugggaguuacaauucaagaugagauuugggugggcacacagccaaaucuuaucacauauauauauaauauuaauagagaaagaagacaacacaggcacaaguuucuagggcccaugaaagucaugcuguggcccuggaaagaggacuugcauuuuuuuuuuauuggaauagauauuucaaaauuguuuucugaaagccuauaacaauuuucauuuuugccagaaauaaaugaaaguacccuuuuaacucauccccaccaacaguaguuauuaucacuuuuaauuuuuugccacucugauggaugugaagugagagcuucauugcuacuuaauuugcauuucucucauuaccaggagccugaaauuuuuuuuuggaagucuggggccauugaaaugugcucuucugugggcuucugagucaucauucuuugcauaauuuauauuucuaagagcaguuuguaugugccauaacuguugcaaacauaauuugccaauuuaguauguggagaacaacauuauauguuguacauuuacacacaaaaguuucagauuuuuacagaucucugauggcuuugguaauagguuaccucaaagccucauuuguacauguagucuucuguauuuucuuccaguuuggaaacacuuauauuuaaagauuuaauuccucuagaauaaauauuccaugacaugaagaauauuuauaaauuguuuuguuuaaaacagguagcuuuguguuuaaaacuaauaaauaauaacaauuguuugcuaucauaaaccuacagaaaagauauggugaauugaacauagaaugggaagacaagagguuacuuagccucucugaaauuaguuuccauuauaaaaagagggaauugaguuaaaucauggguuuucaaauggagcguauggaauccugaggcucgccaugguucuuuggagauuuacagaaaugagagauggauauacccaaacagugaggguuaagcuucauauaaauucugucaauuacuggcuuauuacaugcaucaagaucacgccuaugguuuuauuugaggggguagaagugcuugggaauaaaacauaaaaacucugaauuagauaaucuucauguccuuauuauagaguuguucagaauaagaaugagaaugcaaaacagaacaaacaaaggaaaguaggaaaaaacuuucacauuaaucuucauagaaauaguauaagguaggugucauuuuugggagcaggccccucaaaaucuggccauaaacuggccccaaaacuggccauaaauaaaaucucugcagcacuguaacauguucauaauggcccuaacacccaugcuggaagguuguggguuuaccagaaugaaggcaaggaacacuuagcccgcccagggcagaaaaccgcuuaaaggcauucuuaagucacaaacaauagcaugagcuaucugugccuuaaggauaaguuccugcugcaguuaacuagcccauccuauuccuuuaauucaacccaucccuuuguuucccaugagggauacuuuuaguuaauuuaauaucuauagaaacaaugcuaaugacugguuugcuguuaauaaauauguggguaaaucccuguucggggcucucagcucugaaggcugugagaccccugauuucccacuucacaccucuauauuucugugugugugucuuuaauuccucuagcacugcuggguuagggucuccccagcugagcuggucucagcauaucauuauccccaaaggaaaaucuagguuuucuggagcuugaauuuaaugucauuuuggaaucucucuuuaagaaaagauugaaauauuuaaauacaaauacauauguaggucugaacaugggcacugggagugcacuugaaaauuauuccuacacuagaugccuagcaauaugugacaauauagagaaauaacuucagagcacauaaauauugucacuaaacacaaauuuauggaucucaacuuucccuuagcaugacaccaaaccuguucaagguuucuccaaagaucuucaccaugugauggaagaaagucauacugaaagagacagagcucuuagcuagucacaguuaagguaucuuaacauuguaaacuuaacauaagcauaugacuaugugaacauauaugcccuacacaaauaaaaggcccugaagcuuaagucccaauagcuucucaguuaacuuccuccgauuauucccagcuugcaaauaaagaugcuaagucucagggagauuuaguaauuugccaaagucacacagcuaguccguaaaugaagucuuggauuucaacaggugcucugccugcccaggugaugucacuucugcuguccaguacaaacucuuacuuucuuauuugcuuuuuuuuuggagcuuuuuuuuuuuuaccacugaacaauccaaaugucucccugaacaaauucuucauuuaaaaaagaagaaaggaaaaggauaucacuuuaaauggugaagugugugguaggugaggaggcacuuacaugauaaguggagaguuuaguuaauuagauuauuauagcauuggacuguagccacuguguccggcaacucuaauuagacaucaaugcugcaauaagccuauuuugaaaauuaagauauaauuggaaaaacacgugauagucaucuucucacccuuagaauuucaaagcacauauggaccugaacuaccugaaauucugaaaaagcuucauaaggagaugaugugccacuggcucucauuuauaggcaugucuguuaucugggccaaaacuguauauccugcuugcauuuuuuauuacccaaaaaguugcucgaugauuucaccuaaaucgcuaaugauuaaguggggcacauauauaaacuauccagcauugcuccauuucuuuucccuuagugaacacggaaagaucaaacucauuuuaaucauuaaacauaauaugagaagguuaaaaaugcucuuuuaaauaguucuaugcauuccaugaucaaauagaaauauauugaguguaaccaaaguuuugaauaauucaugaccugcucaaccuuaccuuacaggguacgauuuaaaauugaccacauugauuuuauugcccaguauacagugagaucucauuuaucugacaucauuugggagcgaguuguucauagaaccacagaauuuuagaauuugagaagaccucggagagcaugugaucuaucucccucacuguaacuacuuauauuacgacaacaacaacaacagcuguuugagcucuuccuaugugucauauucuaugcugaguguuuuguaaguguugugccuucuguuugucacaguaauccuaugaggaagguauuauucuuuccauuuucaaaggaggaaagugaggcuuagagcaauuaaaguaacagaaggcuauggagcuugaaaguaauggaauagaaugagauuugagccuauagccccuguuccuagccacugcauuauacuaagagucaaagauaucauauggcuuacucacucaaagucacucacuaauuuagugucaauuaccagaccagaauuuggguguucuaacuguuaccaucuucccccuauaucguauacauuuuuaaaagaaguagauguuaaacauaaauggaguuuuccuugcuauaagcacuaaaacucauuuuauuuuaaguaucuuuaguggaaaucauucuaaguuauugcaguuuucugccuccuucaucauauuacauuaaauauaauugcuauuucuugcugacucagguuucaaaauuaccuacaucaaucacuggauuacgcugcaccaaucugacaccuuuaccaaaugaucucagaaaauuuuguuucauuaacuuguuucuuuuuuuuuugagacagagucuugcucugucaccaggcuggauugcaguggcaccaucucggcucauugcgaccuccaacuccccgguucaagcgauucuuuugccucagccugccaaguagcugggauuacaggcacgugccaccaugcccagcuuauuuuuacauuuuuaguagagauggaguuucaccauguuggccaggaugcucucgaucuccugaccuugugaucugcccuccuuguuucccuuuuuauaaguagugaauccuugcaauauauuguuacuggagaugucauguugcauugugcaaauucuaauugcucuucuuguauccuaaugcacagaaauauaacuuacucuuuauaucugucauagguuaggaaacaauauaggcagacuuguuuaaauugggaguuugaauaacuaaacagaacaaaugugaccucuggguuagaggugacuuucuuuggagguauuaagcugcauucugaaaaaugaaguggaggcagacagaagaguccaggggaagugcugugaaaguagaaggaaagagauguguaaaggauggagguaagagugugauguucuggggggucuggagugacacucagagugacuggaguccagauuucaagaggagcaaguaggagcugaugagacugcagacaaucagggaccaggucuucaaagaacugaugcuuuaacugaaggacuuugauuaagucucaaaguaaugcagaacauuugaaggaguguaaagaagcagaaugagaugaucaaauuuuauuacuaauuuccuuugucugguaucagccuagacaugagagaguuaacaguggaaucaggaauagcaauuauagagaggaucaaauuuuauuacgaauuuccuuuggcugguaugagccuggacaugagagaguuaacaguagagucagaaagagcaguuauaaagccaucacauggucuugaaauacgauccucucaguagaagucaguauccucauuucuguaauaacaaagaaagaaugaacaauuccuaaaaaugcuuccagcucuaaaauucuguauucccugauucuuuggguugugauuauuccugacaccaugguccauaguaugcaaagaaauaaaaguuuuugacuugguguagggaucucagucucuacuugauuacaccugggaguugauagugucacuacauuggcaucugacauuuauuuuccuggucugaacaaauguaaagguuugugaugaugggguaaaaacacaacacaauucagcuuucaagaaucucaauuuguuuaguaguccaguaauauucucagacuauccuaguggcuucuccagaagguacuagugaguggauagcgucacugucuaagugccuggacuuugaagccaaaauaguuuggcucuggaugacucuucuguuuaugagcuuuggaaguaucagcacaucacuuaaccuuuagugucccaguuccauuaucuguagaaggggaauagcacuauaauguaucucauagaguuuugugaggaaugaacauuuagagagucuuguacuuauugagugcuguguaaguaccaggucucauuaugcuagcuauuaucuucccaaggaccauuacucuggaaaugaaagagauauggagaauacuaaagauaaaugggaauuuagcucacauuuuugauauauguauauauauguguguauauauauauucuuuugaaauaagaaccuauuggcuuauuaauucagaccuaacuuaugaacauucuaaaaucagaacugucuagauaaccuaaaaacaacauuaagcccaaagcuggcaucauucagccccuguauaagcuguuauauuaagagacaccucacuaucuuggaauaaacagaguuucaaagaguacugacgguucaaaaauuuuuuucuuacauugagcugaaaacacacucccuggagcaucuuacuagggguccuaaugcuuuucucccuuaacaauaagccuuuaauugaugaaacuaaguagagaaaaaaaguuaaaauacucaggaaaaaaaacuggcauaaacaugauaucaggccuuuuaguugaggauuauugaauuuguuuuuauuguguucccugggaaacauccaaacuacagguggcucuaugaaaauuucaaagauaggagggauuuuuuuuuauauauauaaucucacucuguuucccaggcuggaguacaguggcaugaucacagcucauugcagccuugaccuccugggcucaagcgauccuccugccucagccucccgaguaguugggacuauagaugcgugccaccucaugggcuaaguuuuuauuuuuuuguagaagggggucucacuauguuucccagacuggucuugaacuccuggcuucaagugauccuuccuccuuggccuuccaaagaguuggaauuacaggcgugagucacugcacuuggccuaauguguuuuuuguuguuguuuguuuuacuaauuguuuaacagggcuacuaucacucuaggagacaguuggaaauaguauuaaaaagauguacccuucaaauaauugucugcaauagaagaaauuuucauucaccaacaaccacauuugauucaacauucuuaaaagauugcuugauuuuuuggccaccuugacuuagauuuucuuauaccgaugaacguuuaguuucuucugucuuaaauuugacuugcaucacugugaggaguaaguuuauuaaaaagcuucauggaguucaugaaaacauuuguucagaagguuagaaucaaacagucaccacuaacucagcuuccugggagauuuuuaguggucuguaaauaaauguuuuuucaaauucacaucagaagaaauaaaauaaauagagauaauauauucaaggaaucuuuaguuaacauccagcaugugcuacaugcauuuuuagguacuauaaggaaaaaugcacaaaacuuaaaaauagcccuuuuugucagcacauuuuacauagauccauuuucagagucaaaauauaaacaccugaaucaguacaaaccuuuauaacauggauuucuggacccuuguuauaugaaggcauaugauaaaagaugugcguuucuuugaaaaugguuagauuuuucauuuuaauuuuuaaugggcugaaaaguccacaugaucuagauuaucacccuguaauuaagucacgcuuauauuguguuagcauuggagauuucuuuaguaagaagcuacaacuuuuuuuuuuuaagguucuuuaagaaaaaaugacagagauggccuuuguagguaaguaaggccccacuauuacauauugcauuugauaguagccaauaccacauuuacauugagaauagguacuuuacuuuagcaaaauauuacaugucacauuaaauuaauguugaucauuuggaaugaaugaauuuuguuauucaguuugaauauaauuuuuaaguuuguuuucuuuuacgauuauauaagaguuccaagcauacagauuuauucauagcuuuaugauuaugaaugcuuaauaaucaaaauaauuuaauuuaccacuguguauuugcauuuuuaaaaauguacuuauuugaaaaacauuaggaaagagugugaaagucugagacuaccuauuagaaagguuauaacuguguuacucacauuguauuuaaugcuagacuaaaagaccagcaugguucuuuccacauuugggaaucuguaacgugcuaaaguguauugugaaagauuagacaaaggagguaucacuguggucuggguguugaauggaauagagcaggcaggaaacugguugaaucuuaauaaaagggucagauuuagaaagauagggaagagaagacagaggaguguccauucuuagauguguggacagagaacugggauuuuuaugugacuuuagaagagguggcguggugagaggggaggcuuuacggccaggcauagguuaaacacauuauuugaagcuauguucaaggccugggagguagcaucaggcaguaugagcaguugcgggucuugaaaaagaaagugauugcaucaagcagcuauugaaaaauuuuagucugauggcagagagggagguacauuaggaagucagagaacgcugcguguuagcacugcucucaccaccuugaaauguacugagcccucuccaggacuccucucccucccacugaaguagauguccaaagauuucggacacauacaccauggacagauauuuccccucacucgcaaaaacucaaguggcaccagcauuuuggagacagaagucccagugggcacaaggcagcuggggucuggggcuugacuccucucugucccuuuggugucccccaaaacuguuggaagggagugagcacgaggaccaggaaguucuuguuuguuuuucuucaugaaauuuaucacagccagaaaugauauuuacuuuucuuuuucucuccaacuaaaaaguaaguuucaagagggcagggacuuuaucuguaccuacucacuggcacauucgcagcacccugugcgugauagaugcucaauaaauauuuguugaaugaguaaaugaaugaaaauauauuugaauuuauacagaugaagaguaauuggagaggaguuucaaaggaggaauugauuuuaaaaugcugggaaaagaaacauguuaaauuucagacucauuugguaaacucuguggaugcaauaauuuuaaaaguugucuuggguagcuuaguuccugccacggugagucauguaagugcucagagcuucagagauuuguuucuuccccuacuggggugaguauguguggauuucucuccucuuccugucugguucuaaccuccuuguugggaaaugcuauaugaucaaggauaccaggacugccucuugauauauuaaaugggaauauaaaggaauuuaguaaaucccuauuuccuggcaacgccugucuuuuacgucuguuccaguacauugcugcagacuaggaaagccuauuuuugcugacagagggugaauauuaaacuguuuuuacugcuguauuugcauucuuauugugaccuucgcgguccucgccuccuccccaucuuccacucacagauggaagcuuggccugaguggggagaaaguccuacacagagacaccgaggagccaggcaaauggagauauuuccaaaacauuuaucuccauuacacauucaucagauuagaacuuuggaggaagaaaaagccauuuauucauccaaaagcaagaacccgggaagaaucugaauaucauuuaauggcagccaucuuagauuuuaggaaguuuucauucuccaacuagaaaucuuuuuccacugucauauuuaauuuccaccuuuuaacuaguugauuuugacacagcugguggccaccuuuuuauuuauuuauuuauuuauuuuuauuuuucugagacagagucucacucuuucgcucaggcugcagugcaguggcgcgaucuugacucacugcaagcuccgccuccuggguucaagcaauucuccugccucagccuccugaguagcugggauuacaggggcccgccaucaggcccagauaauuuuguauuuuuaguagagacgggguuucaccauguuguccaggcuggucucaaacuccugaccucaggugauccauccgccucggccucucaaagugcugggauuauaggcaugaaccaccgcgcccggccuuggccaccuauuguuaucagauguuugucaagcuguauuucaauauuuaauaacccccuggauaaugccacacauugggguagggcguggguaggcgggaaggggcaccaaaauggcagggaagagucaggccccagaccccagcuuccuugcgcccacugagacuucugucuccaaacugcuggugccacuugaauuucugcaagugaggggaaauacuuguccauaguguauauaucugaagucuuuggauaucuacuucaguguaagggcgagaagucagggagaggcauuugauaaauuucaacgaguggauagaaaugcuaagcucuuaucacaauccugcuucaucuugauugugagaaucaaaggaaauuaucacuuguuuuuauugcccauugaaauuuugauuccuaguucuuucuccacccgaaggccacuuuaaacuuuaaaagucccaucuuugaaauaaagauuuauuuuuuaugaaauucauggguuuugcauaccugcaaaagacucaaguuuuaguaauuuucuugggaaccguccaaggugucagucacuuuacgaaaccaucaaucugaaaguccccuuggcauucagaaucauaugauugcccuauccuguuccguguaaggguacuacuggcuuauucuucuguauccuaaggaggccugggcagaggaaauugagcucuaacuuguuaagaaauauaauucuaaguggcacugggaccauacaaacugauuuaaauaaacauuuucauuaauauucagucuuagagggcuauaucaagguuucucaaccucagcaccacugacguuuugggcuggaaaauucuuugccaggggcucugcagugcuuuguaggauguucaccagcguuacuggccucucccauuagauaccauagcaaccccaaccaaaugggacaaucacaaaugucucuaggcauugccaaaugucaccugggggucaaaaucacuccagguugaaaacuacuggcuuacacaaugccccaaaaucagguugagccuccauguugauagagaauugcguaaauucuaaaagccagaaaguuaaaggcaauacugaucucuuuaaaccacagaauagcuugcuaacugaauagugguauuauuaagcucucucagucucugauucuuuaucuguaaaggauguuaagaaugaaacgguuuaauacuaguucuaaugguuucacuuauugauaguucacauuuauuacaugcuuaaugugucuucaauuuuaacuguugcuaguacaacugaagccaguauaugauugugaguauaguuaaaacuauucuuaccaaugcccuguuggucugcuaucacugaggcaaugaaguaaaaaguaaggugcuuuuuuuuuuuuugagaugggaucuccugggcucaagugauccucuugccucagccuccugaguagcugggauuacacauaugagccauugugccuggcuccaaguaaguauuuuuuuuuuuuuaaauaaagcuuauuuuuuuaagcaugaagcuuaaaaauguuaccugcauuuugaccugucagcugacuuuaaaagauucaauuuuauaaauauagguauuuaacuuuucuuuuauuucuguaucacuaaagaguauacacaauaaguacuugucccuugagcucuuucuuccuacucauuuucaguaaguuuauggaaaucaguucugggaagaguucacccaaagguuucauauuuaugagguuuagaaaagguagagacuuauguaaacauaaucaggucaucaaaaauucacaaccuucuguaauauuugauuguuaauagaaauuuuguccuaggcaugaauaaacauuaucuuugaauuugcaguuagaauaaagucuuuuaugauaacuuuuaguuuuuucuaagaucaaaauaaaacaaaacaacauccccaaacagaaacugaauuccagcuauagcuuugucauuauaaucuauguguucucuuacacaucaucugaauucuuucagucuacauuuacucaucaguaaaacagaggugauagauuuuuucucccagaguucuuaugagaaauaaauggggcaguauaugaguaacuacuucaggaaucauauuauuuaauacaaaaguaagauauugauaugguuuggcugugucccugcccaaaucucaacuugaguuguaucucccagaauucccacauguugugggaggaacucagggggagguaauugaaucaugggggcuggucuuucccacucuauucuugugauaguaaauaagucucaugagaucugauggguuuaucagggguuucugcuuuuacuucuuccucauuuucucuugcugcugccacguaagaagugucuuucaccuuccaccaugauucugaggccuccucagucaugugaaacuguaaguccaauuaaacuuccuuuuucuucccagugucagguaugucuucaucagcagcaugaaaacagacuaauacaguaaauugguagcaguagaguggggcgcugcugaaaagauacccgaaaaugugugaagcaacuuuggaacuggguaacaggcagaggcuggaacaguuuggagggcugagaagaucagaaaaugugggaaaguuuggaaccuccuagagacuuguugaauggcuuuguccaaaaugcugauagugacaugaacaauaaaauccaggcugagguggucucagauggagaugaggaaauuauugggaacaggaucaaagguaaguuuuguuauguuuagcaaagagacugguggcauuuugccccugcccuagagauguguggaacuuugaacuugagagaguugauuuacggcaucuggcggaauaaauuucuaagcagcaaaacauucaagagguaacuuagguacuguuaaaggcauucaguuuuagaaaggaagcagaguauaaagguuuggaaaauuugcagccugacuaugugauagaaaagaaaaaccuggccgggcaugguggcucaugccuguaaucccagcacuuugggaggccgaggcgggcagaucacaaggucaggagaucgagaccauccuggcuaacauggugaaacccugucucuacuaaaaauacaaaaaaauuagucggacaugguggcaggcaccuguagucccagcuacucgggaggcugaggcaggagaauggcgugaacccaggaguugaagcuugcagugagcugagaucacaccacugcauuccagccugggugacagagugagacuuugucucggaaaaaaaaaaaaaaaagaaaagaaaaacccauuuucuggggagaaauucaagccggcugcagaaauuugcauaaccagcaaggagccuaauguuauccccaagaccauggggaaaaugucuccaggucaugucaaagaccuucacagcagccccucccaucacaggccuggaggcccaugaggaaaaagugguuucaugggccaggcccagguuccccgugcuacgugcagccuagggacuugguguccuguguaccagccucuccagccauggcugaaaggggccaauguacagcuugggcugugguuucagaggguguaagcccuaagccuugguagauuccaugugguguugagccugcagguacacagaagucaggaauugagguuugggaaccucugccuagauuucagaggauguauggaagcgccuagaugcuaaggcagaaauuugcugcagggauggggcccucauggagaaccucugcuagggcagugaggaagggaaaugugggguuggaguccccacacagaguccuaacuggggcacugccuaguggagcuguaagaagagggccaccauccuccagaccccaaaauguuagauccacugacagcuugcaccuugaacuuggaaaagccacagacacucaacuccagcccaugaaacaucugggaaggaggcuguacccuguaaagccauaggggaggaguugcccaagaccaugggaacccaccccuugcaucagcgugaccuggaugucagaucuggggucaaaggagaucauuuuggagcuuuaaaauuugacugccccacuggauuucagacuugcauggucccuguagcuccuuuguuucggccaauuucuccccuuuggaaccgcuguauuuguccaaaaccuguaauccuauuguaucuagaaagcaacuagcuugcuuuugauuuuacaggcucauagguggaaaggacuugccuugucucagaugagacuuuggacuguggacuuuugaguuaaugucgaaaugaguuaagacuuugggggacuauugggaaggcaugauugguuuugaaaugugaggacaugagauuuggaggagucaguggcggaaugauaugguuugacuguguccucacccaaaucucaacuugaauuguaucucccagaauucccauguguuguaggagggacugagggggagguaacugaauccagggugccagucuuuccugugcuauuuuugugguagucaauaagucucaugagaucuaaugggucuauuagggguuucugcuuuugcuucuucuucauuuuuucuugccacugccauguaagaaaugccuuucagcugggugcgguggcucaccccuguaaucccagcacuuugggagccugaggcaggcagaucacaaggucagaaguucgagaccagccuggccaacacagugaaaccccaucuccacuaaaaauacaaaaauuagccaggcacggaggcacacgccuauagucccagcuacuuggaaggcugaugaaucacuugaacccaggagguggagguuguggugagcugagaucgugccacugcacuccagccugggcagcaaagcaagacucugucucaaaaaaaaaaaaaaaaagugccuuuugccuuccaccaugauucugaggccuccucacacauguggaacuauaaguccaauuaaacuucuuuuucuuagcagucucagguauguccuuaucagcagugugaaaacagacuaauacagauguuauuuuugucauugccacuacugucaucacaauccccacgauuauugauaauacacugaauauucaaaauaacauucuggaccuuucuugaauaaauaaacacuaauagccagagagauaguuaaacuuuuauuagauugggaccuuaucacaccugguggaguccugugauuuccuggccuuuggaauaaauuuuucauguuuaaaaacauaauggaacauuauggaaauagucagaaaaaaaucuuuuuauccggcucuguugauagcgauaaaugcauauccccuuugaaaucucuaaugauaaaauugccuaugcacuaaagguuuauuuucuggaaaccuguaguccuaacacaugaaaaauauacaaacauacuuugcuuuuauuuuauuaagccucaacguccuugauucccuggccucugcuuugaaagaaguugguaacaucaccauaauaguuugacuucauaaacaaacaaacaaacaagaaaauagaaaccaaaaaaaaaacagcauuguuacuuugcucuggaaauaggcugugaaauaauucucaaaaagccacaguguuauguuguagccucaugaucauagccaggaggaugaagcccuuguuucuacugucaggcgcuucuacagagagaguggcacagugccuauaauauaguaauaucaauaaaugaaugaauaauggaaggaaugagaaaaggaagauugguuuuuaucuuuuuaugguggaguucacuuucaaaagccaaaaugaaucaccagaacagguauaaauauuaaauauauuugcuaaucuuuauuugcauugggaaagagaaagcugacuuucucacugagacccaugguauaaaaacaauccaaauuguccagugucauuuuucaugauauggugcuguuaaacucagaaucuacaagcucucaaggguauaauguagauagauggugcugauaugcucacauauuuucugugccauuugauucuaaaauggacauguaucguuuccauuuuaugauuagcauaacuuuuuuacacauuauuccacuugccaugauuaaagaugguuucauccccauggucuggcucuuuucuuguuuaucuaaugguugcccaguggcuacuguacuguauauguucugagcucaucuacugugugucauuuuaaaaaaucacaaaagauauuacuuacuuccugcuuaccucugcauuuggcuauuugauagaauacuagcuuguucggauugguauuauaacagauuuacauauagaaucaacuccugggcucuccuccgaugccuguucuucugggcauuacacauccuacuuccacuguucccucucaugugugggccaaccuagcucccuugaccaggaauauaaaauuguuaccagaagagagaggccauuugucuuaugauuaaaccaggaacauguaagauguacaagaaaaacagaaaaagcuagucugugugugagcacacaugcgugaaugcauguguguacauguaugugugugcaugugugucugugaguguuguguguaaaggagagagggaaagcuagcacacugagggagaccaagugagagacagaaugaguaagguucuguucaugcucugcagccuuucugagcccuucucuggccuccugugccaugagacacaccugcauccuuagaaaaccaaccaauguggccuucgcacagagaauguuacacuuacuggcagcccaaacuacccuaacccaugcagucugccuuaugccacgaucccugugaaugaggaaauagaacuucauguauuuuucuccccuaaauauucuucugaguucagccacaauugaguuugacuauuuagaguaaacagcuucccaccucagaaacuuaugucucuucauggacuuccuugggcucaaagggagccugcuuggccacauauaggugcaaccuggaagugugugaaagucaauauccuuagaguccacccugaaccaacacaggacaggagucagugaauaacgucccagcauccccacguaccaaaagguuucucagagacucuccagugggauugagcucaauuaauagcagcaguuucucccuaucaaugcacuuuuuuuguuuguuugcuuuccucccucuccugucuuauuaucuccacuccuucacuugggcuuuccaggauaaccucccaaauaauccuucuccuagucucaggccagccugggucuuaaucucagaaucugacuugagaagaaucaaaacuaugacagaagccaacuuugcuuuuguaaaaagggcuuccuaagggaaugagauaguuacacggcucacaucugccccucccuagugugccugccuggucucaccugugccaaagaguaagaagauucaagccauuauaauuuaaauucugcuauguaauguggcuacugaugcuacuugguaaaaacuaacuauuauuuugacaagaguuucagaauacauuuuaaaaauucaacaagcauuugcauuauuuacagggacuuucauacaguauguauacauuuucuugagaaaugcuaucuuuuagaaaaugagguauaacgcugcgcauacugagaggacuuaagcugcauuuccaauuuugcagcuuuucacuuuuuaggaccuuggguaugcucucuaagauuucuaaaccuugguuuucuaauuuauaaaauaugaaaagaaauaccugucuuggccgggcacaguugcucacgccuguaaucccagcacugugggaggccgaggugggcggaucacaaggucaggagaucgagaccauccuggcuaacacagugaaacccugucucuacuaaaaauacaagaaaauuagccauacaugguggugggcaccuguagucccagcuacuugggaggcugaggcagaagaauggugugaacccaggagauggagcuugcagugagccgagaucacaccacugcacuccagcccaggugacagagaaagacuccaucaaaaaaaaaaaaaaaaaaaaaaaaaaagaaaugccugucuuccauaauucauggaaaucaaagguauaccuguucuauugguuaauguuaaccuguucuaauaguuaauggugccuuaaugacagaaaaacuuaauccguggcuuauagucuaaggaaacaaauacaaguacaaauuaagccaaaguccccaaaucccaaguuauuuggaaacgucuuucuucuuucucuuaauacuugacauaccgguggaagaggacuagucaugagcacaugauuccuccaucuuuaccagcuagccuaggacugaacucaaagagguuuucauuuucacuuaaaaaaucuaauugauuuggugagcacauacugaaauauauuuuagaaucuguugaccuauauacuacagguucuagcucuuacuuauggucgaggcaaaaaaugaacauuagccuuuaaaaucaggaccuugucaaaaauuauuccuucaagcaaugagcacuaaaccauuauuagagugcucaaguugauuguauauuuuuuucuuaaauaugcuacuucucacugauuuaauccucacgaguaaaacuuuaccucgagcuugauaucuauauuccagacaggcugauuauagcauauuuuccauagacuaggagaauauacugccagaagggaucccagaaacugcuuaauuuucuucuaccuccuuaguccacaagagaaagcccaaacaaaugaacuuauuugucccaaagucacacugugaauuagauuuuuuaaaaaugccaaagauucaagcauuccugcaauguuuuuccacaacaauauuuucuuuuccuuuuuuuuuuuuuuuuugagauggagucucacucugucucccaggcuggagugcaguggggugaucucggcucacuucaaccuccuccucccauguucaagcaaugcuccugccucagccucucgaguagcugggauuacaggcacacaccaccacaccuggcuaauuuuuguauuuuaguacagaugggguuucaccauguuggacaggcuggugucaaacuccugaccucaagugaucugccugccucaaccuuccgaagugcugggauuacagaugugagccacugcacccagccuaacaauauuuucuaaaacaauuggacuacuggcuccuugagauccugaaacccaugcuccccaagaaaaaguuucuguuggaaaauaaauuuaggaaacaacauaucggaauaugaaagagucauaauauuaauacaguuaguaaauauguuuacugaaguaacuugauccgagagaauuuauuuuuucccuauguauggcuucuuaacauaaucuucccuucuuauguuaagacguacagccccauuaaauccauuaaaucacaaucuuccagaauaaaguucaaggacuugguuuaagauauccaauauuuuaucacuagcuucugccuacccauccaacuauaucugcugcccauucuuuauaugcucuggacacgcccaaccauuuuuaguucccacaaguaucugguaucucacuucuuucacaugugacauuuuauccacuuagaauaugauuuaagggcuuggaguguugguuugcauugcuuuccuuauauuugucucuauuucugucuuuccuugucuuugcccacuuauaauaugauuuaaggacuuugagaguugguuugcauuucucuccuuauauuugucucuaucucuccuugucuuuguuauacagacacacaugucauuugccauuuagaauuccuaagacagcauaugcucuguguuucuuugacaucaacaauauuauuauaacaaagacauguuucugauucucaacuuaaagauguaugagaauguuaugucaaaacaaauauguuaagcaaaaauuaagaauaaggcuagauugucucuugagauauucugucacccguuuguggcucucaugccugccagaaaugccagcccccgacuuucccugcugucagaauuucaccaacagcugauuucaccauccuuucuuugccugcuaacaagauauaacaagcaauuguuucacuuucuagguuucacccauguguaagugcuuggagucauuuuuaaugguggaaauuauucaguagaaacugaaccaguagaaauuauuguaugacucaggcuucuacugguccuggugucauugugaccacuagagcugugguuucucucccuucccuuuguuuuuacuccauucucuggucccucuccuggggacucacuguggaggaugaacgcagaauuggaacuccuaugcugcacuaacuuacaagaaaaugucagggcugcuuugagguccacugagacccucaagcagaguuuucaauuuacuuucugcacagaguaugcauguugcauugggugugcugaccugaaccuuaguuacacaucccuccagagucccugaauuagaagacagccacgcuccucuaagucaguucuugucacagugcaaaauccagcugaugaguugugucucuuuggcuuauaaaccuuugucucccacauuagaaauuauauuuuagucuucugugaauguuggggaccuagcacagugccagggcauaacagagccacgcuuuuuuguuguuguuguugagauggaguuucacucuuguugcccaggcuggagugcaauggugugaucucggcucaccgcaaccuccgccucccggguucaagcaauuguccugccucagccacccgaguagcugggauuacaggcaggcaccaccaugcccggcuagccacgcuauuuuucaacugaacaaagcagugggcauauauaguaauagcaaaaggauauuuuaaagaaaaaccaaagcacuauuugcaaacaucuaggcuguagacaaggugugaguggagcaaagcuaccaugugugcaguugugugagagucugacccgaaguuuuaucagugaagaauaagagaucuauuucacacauuccgaagucaucuguggaacugcagcugagguaagcaaugucaacggacucauaaaauguuucauuaaauaucaaguucccaaacggaggaaacuguuugaccuccgugcuuaaauauugcagaggaguauuaggggcaagugagugagauucaccgcaguauuuauuuucugcagguaacgugaaugaaauucuguuauguucaauuauaauuuauagcuccauacgagacaucuguacauagcacacggucugugcugugaacuaggcaugggaauugaguaagacaggaaccuggcuguugaggaauaagagcccgaagagggagacacgcaaggagacaggugcucacaaggcaccugugcaguucaggaugcccugauacagggggcccaagcugcugcagaagcagagaggaggaggcucagcuguguggagggagcuuccuggaagaggaaauucuucagcugucuccaggaacagacagaacuuauccagacaagguaggaaagaaggauauguaggaaagcuucuacggugaucccaaaggauccccaacuccugguauucaugccuuuguauaauccccucccucugagacucgcuggaccuagugacuugcuuccaaagaauacaauacggugaagugaugaaaugucauuuccaugauuagacuauuacaagacuguggcuucuguuuugugcauucauucucucucucgcugucuccucucucugugucagaacucucccucuuggugaaccgggaugccauguggucagccccaugacgaggcuccaugagaaagaacagaugugcccagucgaugacuagcaaagagcugagacuugccagcagcauuugaaugauuuuggaaguggaucuuuacccucuugggccuuaugaucagugcggcccucacugacaucagcaucuugauugcaucuugacugugagagacccaggccacaggcacucagcuaagcugugccugaaaucuugacccacagacacugugaaauaaugaguuucuugcuuuaggcuacuacaaucuggaguaauuuguugcucuguaacacauaacuaguaugaaaaugaauucauuugauuguguugguuuacaaguuuguuauucauuuagaaauaauacauuucaaauauauuguauucccaggcauaugaauaaggcagaguaauauuuuuuucuugucuucaauaaacuauuauuuuuuaguagguuuuuuuuuuuuuguuuuuuuguuuuuuuuuugcugggccagaaaauuuugaaguuugaguaugggcacagcaucagcuauccauguuucucaauggauuuaaaaaggcauucuuucaaacuuuuuucccccaaaaugugaagauggcaaauuuguaaaacuggagaauaugcaaaaaaauguuuacugcuccuuaucccaccaagccauuuguuucuaccauuuuacugcuuaauucuaauaugcucccuugaaauuuuuuuuuaauuuauaggcucugcuacaacuuuugguaauaauucuaaauauuacauaugaaaaucauauugugaauaaaaaggaaggugcaaauuuuagguuuuuuuucuaaaauauuauugguagauacuuuaauucauucauuuucuguuccccaggcauuuauugaaaauauugguggaagguuuggauaauaguuauuaggaauaccuagauauuccuuuaagcaccaauuaaaaucagaaauaaaaaaccaguaaguauaugcuauggucagaauauucguguguccuccaaguucauauguugaaauccuaauccccuaagcuggugguaagagguggggaacugugggaggugauuaggccaugagggcagagcccucacagguggaauuagugcccucauaaaagaggccucagagauacuccuugugccccuucugcuacaugagcacacuugugagagagugccaucuaugaaccagaaaguaggggacccucaucagaaucugccagcaccuugaucuuggacuucccagcuucuagaacugucagaaauaagguucuguuauuuauaagccaugcaguuuauggcauuugguuacaguagcuggaacagacuaacagaugguauuugguagcugaaccacucucucaguucugcaugagggauauaaccuacaaaccugggagcacaaaggggaaaacauuauguuucacagauaagcauauucaagaaagccucauaaaagcgccuggucucauguuuccacacagagggacuuuagccaaggugacuuugggccucucucuauauuccucuacucccacccugacccccaccuucaaaaucacugauccuggcgagugaagacaggcagagaaugacucgucuauuuugugaauuuagaagaagaaacaauaccugaucagagcagcuuauauucuccauuucaggcugccuaggagcaauauucucgcaucuuccacaugggaaacaccuuggggcaggcucuuccuuugccaggggagacuuccacggaaugggauuucaguuuuugcauagacaguaauauuagcaguaugccuagacuguagguagaucuaagcacugcuuucaaauaagcuuuuauuguaauaaagcagacauuuugauggccagcuuuuuucuacuaggcaucuuauuucuaaauugauccaaaccuuguaugagaagaaagggucaugcuucuuugguucccgauaauuacaacaaaauuauaguggaacuaugaucaauagaggaaggagaauggcaugaacaacuacaccgaagcaggcaaauuaauggaauuuauccuagggauuccaggaaugggaaacagaccauuugguuggaaugcaggguuaacauaggagagacauggaaaauuagccaggaaaggcagauuggguggacccugaauaccaagauaggcauuuuugacuuaaucuggaagguguggcagagaucaggugucugauccaaagcguugcucacauucauguggucaaggaauguuaauuuuacugucacuacuuaccaacccucaugcuagucauuagcaacagaagagcuaucccuuuggagggagauauccagaaaucugugaagagucaaaaccuagggguaaaugaagugacugacugacagaggacagggucuacggaagcugagcaugggccuucugagacuauaauaggaagaaaacacccugaaaauaacacacuaguaggagaagaaauggacaguuuagugaauuggaauuuucuggaaaguaaaauacaaagucuuauagaaagguucuaacuuuucuauaacgacacucauuagggucaaaugcucuugauaagcaguaggccuaugucaucuucucuuaggaauggaugggaagacagacaccaaaugcagaccuuucuauuucacuccuguguuccuccuccacggaaguuaaauaugaguaccugugucucagaaacuuagaggaagccaucuuugcaugucauuuaccuaauggacagagcaugaagcgaguaccaugagagacacuaaccucagcgauaaccaguuguuagagcuuccuugaaagcauaauacuuacagggcaaugguaguaaacaaaaucauccuucugagaaaaauuauguaaaguaggaaccaccucuugcucuacuugauuugauauugcacaggaagcuauaagaaauguaacuuauuccuguagauucucuauuuuuaauuugcaguuaaguucccuucaguaucuuugaucugaaauacuauggaaauacauuaacauucuaaaugcauuuucagccucaauauuggcugccaaguauucguguucauaagaauauuaacucaguuuucacacucuggcuucucauacuucuaauauuuugcccaaaauacaacgacuggauucuuuggaaagacuuuuucuaaaagauuauuuuuggaaagaagccuuccaaagcuuucaaugacuccuugaaaguuuauauaucaaagaaacgcucccuccaacaggaaaaauguuaaccuacugguccuacuaaagauuuuaugauucguggguggucauaaugcuuucuaauuucugcuucuaucacacaguaaaaaaauauuugauuuuaugaauuuauucuuuuuuguuugagauggagucucacucuguugcccagguuggagugcagugguacgacuguggcucacugcaaccucugucuccuggguuccagcaacucuccugccucauccuccccaguagcugggaugacaggcacaccaccauguccagcuaauuuuuauauuuuuguuuaguugagaugggguugcaccccguuggccaggcuggucuccaacuccugaccucaagcaauccgcccaccuuggccucccaaagugcuggcauuacaggcaugagccacugugccuggccaaguuuauuccuuugaaaaauaaucacagaauacaauuugagguuugagguaggcagaauaaugacuucccaagauguugcugcccuaucccuuaaaccuguggauaaauuacuuuauaugacaaaagggauuuugcagaugugauuagguuaaggaucuugagguaggagauuauuuuagauuuuuuagaugggcccaauagaaacacaaggaucuuaacaagugaaagagaaaggcaggguagucagugccagagcaaugcgaugugagaaagauuacaucagucaucgcuggcuuugaagaugacggccagugcccuaagcccaggaaugcgggaggccuccagaagcugaaaaagaauggaccagauugucucagagccucccagaggaaugcguuccuguugauuuuaaccuagugagacccguuucagacuucugaccucccaaacuguaagauaacauauuuguguuguuuucagcuacaacauuugugauaauuuguuagagcagcccuaggaaacugcagcauaauuuuuuuuuuuuuuuuuuuuuuugagacagagucugucgccaggcuggagugcaguggcgcuaucucggcucacugcaaccuccgccucccggguucaagcgauucuccugccucagccucccgaguaucuggaacuacaggcgcccgccaccacucccugcuaauuuuuguauuuuuaguagagacgggguuucacuauguuggccaggcuggucuagaacuccugaccucaggugauccgcccgccuugcccucccaaagugcugggauuacaggcgugagccaccacgcccagccauaauuuuuuauaaggucucuuuucagggugguugacagugaggggcgugauagcaaaaucaaagcacagaauccaggguuagaaacaagccuggcuacauucguucagugcugauuauuucaguguuucugaaaucuauaaaaauacuugagagaacacaugauccaacucuguccaccggaagagcuacaaaauguuucugaucuagaaaaacacuggccuuugacagacauauguucucauagcaucuguauguacaugugcuagacugcaagagaugaugcuaggacaggcccccaaaguccagaccuugacugagcuaagaggucagcaucuugccugucuccuucaucuucugcuucuucauccuaguggucuaccaccuucucucauuuauuuuuucucuccccagucucucacauucuccuuuuuuuucuacuuaauuuuuucucuuucugaaauucgucaucauuugaaacagaaguuagucucuuaguuccauuuaucuagaaaguuuaguuguuucuauguucaguguauguucauuucuucuccaaggaugauacaccgcagguauaugauagauauacuuuguaaaaucuuucaauuguucaugcuuaauuuuaacaguaacuaccaagaaugaaauucggcuuuaaggauugauaacuauauacucuuaaacaaaacagacacggugaggugggaggaucacucgagcccaggaggcagagguugcagugagccaugaucacgccacugcacuccaaccugggacaauagauugaguuucugucucaaaagaaaaaggaaacaaaaagaaaaacaacagugcuuauuucuagauggugacgcaauggaugguucuuauucuuuuuaucuucauaaaaauauuuuucuauuuuuaagacacuaaaaugacuggcuaaaaaacuguuaauuccauucauuguuacuugagacuuuuuaaaagucccuuuuaaggacuugaaaucuuaaguuucugggacauggauuaaacauuugaacaaaaacaacaaccaaugccaaauaaugcugacagaguaucccuuacuuugugcuguagucuuauuuacauaugugcgaaugaaucuuagguccuguuuauuguuccucuuguuuaucauagcuuucuauaguugacuuacacuuauuuugcuacuccagugcuauauacuuauugugcauuuucagaaauagcuuuucugaaaucagugaauggaucuuuuaugucccaauugaacuuucucucccacagcugcucaauuugcuguuuguaaugaaguugacguucggauguuucuuuccaaguucaccccauccuuuuagcacauggugaaaaauucaacaaggaaguucucccugccugcuguauugaagauuuaagaguaggaguauucguacuugccauauaagacccuaacccuaacagucagagcugccucugaagcauuaagaagaacucuuugugaauagcaucagaucccauuucacaauuuuccucuugaauaucucagcaagacugauuccaaaucuuaaucgaauucauuacaucuugguggggcaugguggcugacgccuguaauccuaguaccuugggaggucauggagggaagaucacuugaggucaggaguuggagaccagccugcccaacauggugaaaccuggucucuacuaaaaauacaaaaaaaaaaaaauuagcugggugugguggugggugccugcaaucccagcuauucaggaggcugaggcaggggaaucgcuugaauccgggaggcaguggucgcagugagccgagauugcgccacugcacugcauccugggcacagagcgagauuaugucacacacacacacacgcaaaaaaaaaaaaaaaaaagaaaagaaagaaauuaauuacauuuugugguuuucugaaugagaguugcuucuggguuguaucuagcuauaugauugacauagagaacuagaaagaagaaacaccugaaauuaaaagcucaguguuuauaaauuauaaaugaauuuuugugcaucgugcuucauauucuguuaugauguuaaaaacuagagcuaauccuaguaacacacacacacacacacacacacacauucucucucucucugucucauacacauacauuaguaagcuaaugggaaaaacuauugcacauacaucaucagaaugugguuacguacuucagcaguauugcuuuaucccaaguagauuuagguaagcuggauuugcaaaugaacuuuaaauguguuuugcuucucugacacuuguaaguggaauuuuaauauuggccccuaauaauguuuugcaauuaaccagcauuuuaacacggaaauaagcaauaaacuaaugcuuuaacacuuuuuuaauugaaaaaauuaagagaagcuaauuaauuuguaaacuguacauagugaaucauugagccugaguaauuuugucuauuuuuuuguucuacacaugaguagcuguaaaaaaaaguacaaauauauaauuagcaauagacaacuuuuaacacuuccuggaaauauuugugcauuuuuuggcaaucacauuauaagaguuuuauuaaguuuucuccuaacauuuuaaaugauuuuaaucuuuuguuaauucaucuagauuuuguaagucucuuaucucugcuauaauagcagcaauagagucagacuuaaauuuuccaguaagaaaugguuuggggcuauucauuuuaagaucuauacuuaaauuuuacuuugguuuuuaccuuucauuucaguaucaguauaucauaccauaacuaucuuaauguaagcacucaauauuuuccaacugaaaaaucuacugaaucaggcuuuuguaggucuaauuucagccccuucucuucagacuaguuuuguugcuguucccagcacaaauaaaugaauguaguuaauccaaaaaauauuuauuguguaccuacuaauguucuggacacuauuuuagauggggagacaauuauaaacauaauagacagguaaaagucccugaacucauguaauuaacauucuaauugcgggagacaggugauauagcacacaaauaagcaaaagaugcaguauauuagaauauaaugggcugcauacagugguucacgccuguaaucccagcacuuugggaggccgaggugggcagaucacgaggucaagagaucgagaccauccuggccaacaugguaaaaccccaucuccacuaaaaauacaaaaauuagcugggcaugguaucacaagccuguagucccagcuacuugggaggcugaggcaggaggaucgcuugaacccaggagguggagguugcagugagccgagaucacaccacugcacuccagccugggcgacagagcgagacuugucucaaaacaaacaaacaaaaaaagaauauaaugaacuaugaagaaaaauaaagcagauaagggagauaaggaaaacagaagugagguuacuauuuuaaauaugguuguuaaggugggucuucaagagaagaugacaucugggcaaugacuggauggaguugauggaucuugccaugcaguagguaaguuggaagaacagcacacgccaugcccugagaaucuaaugcuugcccgauguguucaugggacagcaacacauccaguaugauuaaaaugugugagcaacugagugagcaaacaaggggaagggcaguagaagccaagaucaucgagguauaguucagggccuuggaggcuguuguuuuuaacaugagguuggacaugaccagaaugcauauuuuaacagaaucacacuggcugcugugaugagagugaauagggccugggugaaaguaggucgacuaaggcaggaagcuacugcaaaaacagacagaggacgaugguguuugaaccagaauggcggugauagagucauugagagcagaacuaguugaugggguagacguggguugugaguguagagaggcagccaggauggguuuuggccucagcaauggguaggauggcccauucucuucucuauacucacuguggauaaguucuuagugaauuuuaugaucuucucauuuccaacagcaaaacaccuuauuauuuuuuuuuuuuaguucaaaucucacuuucuaagaaucuuaaccuaauuaaccucaugcuuuucuaaacaguccauuaaacuucauucccuugggcaugugccuagguuuauucuguuacuuuguccucauuagaauaguuuucaggcucuuauguuaaaaagcuugaaaaacaagaaacaaauauauaauagacuuuuaaaguagaugguaauauuuaaauauugaaaccuauuuaaaaugcauacacauuuaaauauauaaaauacaugauuuuacuuauuuauaaacagaaaaaaaauuaaaauagauguaaaaaucuaucuacaucuauugauuuauaauauccauaucuauauauauuuuauaccuucaucuauccaaaaaacugugaucuaauuaaacagcugaauaaaccaauaugguuguucuguauuguucuuaguaccuaauacauuaugacugugauuauggggauauaguagcaaagccuacugucauuguauuuuuuucuaauuuuuucauguaacacaaggauaacuuuuaauaauauguguuauuuuucuuacagaggggugaaauuugcuugaguagauuuaugguguuuucauuuccagcagagaucugagugucaaagugcucucuaccucuggugaaaggaccaugugguggugguuggccuucagaugaggggaaggaggggugugugauuucaggugugucuuccaaaacagaaaaauccaggucugauccuguucuugucugauaauuucuuaucucuggugaaaacgcauaucccccgggugcagauugaagcaugcgucucugguuccauuuuaaugggaauacacuuuuacaugagagguagagauagagcaggaaggugcagggaaccugagggcaggcuaugucucuaaagugaggaaggcaggcacagaugagcagcuugugcagccuguauuuuuggcuugcuucaugauuuuguauuuggccuugagccaagccuggggaugggaauccaacacuugcuucacugauuucuaugaguguaauuacugugguuaaaaauaauguuccuucacauacauggaaggcuuuauaaucaacauguguugccuccuuuuagcauuacagcaauccccagcgaggugaguagagaacccuguauuuauuuucuagaugagaaaaaugagccucaaagagagaaaguggcuuuaccaaggccaccuacacauuuauucauaauacauuaucaugcaacuacuauuuuguagggguacaauggaaaaaaaaaagggcaauccacggccucuugccuuaagaagauuauaauccauucgggcauuuagacaaacaaauagguauuucaaauaugaguacagauuuaaaauacaguaaaacuaaacaucuggucuuuuauuccucuuuaguuucucuuuaccaaauauuuuuaaaugaaaauacauguaucauuuauuauacaaauaauagauuuucauuugauuucaacugaaacaauuuauuaaaaauaugaaaaaauauucaaaugaccuacucuuauuacuuggaaaauaucacuguuaaaauugauauaucacuuuauguuuuuuucuuucuuuauauuuucaaccagguauuuucauuuuaguuuuauuuucuguuuaguauagaguagguuucuuauguuuucucugucaaacaacauagcucugcuugcuaacucuaauuguuucuuagcaugucaucagaucauuuauuuuaccauacaacuauugauguuaaaauauuuucacauuuuucaucauucaaaacuaugcugagaugaaaagcauacauaaaucuuuguaacucugucuuauuauuugcuugcuauacaauucuaaaaauggaauuguuguccaaaagccacgcauauuugaguuuuacaguguugacuucuggaaggugauaugauagacagaucuugauagauguugauuuaaauucuauuuaugguucuuuaaauaagaauaaaacuuagguuccuaaugauaaauaacuuuaagcuaauguauuuuuaaaaaucucuuugcaauaucaugaaaauuuuccuacuacuuugaucuuuaguuaugagaaaaaaugauguaugaaaguugaauauggcuagauucuggaauaggucugaguaucugugaccuaaacuguagaucaucuaacuaaaauguaacauuaggaacuguuguauggacaauuagucuuuauauggacacuuuucuuauguugcuaaugugaauauuuaguacugaagauuuugauugugcaaaaaaauuuagaauucucucuaucaagaaaagugcucccugguuccaaaaaacugucucaaaaggacaagucugcaaaugggaguguggacacugugacaccacagaauuaguaauacaugagugcaugcacguaugagaugugugggcacggcgauggugagaguguggagagcucccuauuuuaggauauaaagugcauuaggugggaucccaugcuguauauguuuucacccaacuccuauuauuucuucucucaaaaauguguccaguuuguaucuuacuaagacucuuccaagguaaugcugucuacuauuaugcuuuggucaagguaauuacaugcaucacgaggccacugagugugauaaaaacaagcaaacaaauaaauauacaaacagcuuuuaucuagguuuacguuggcaccuguaccuccugcuauagaaagcacuuugaaggcauuuucuuugcucauguaaagucagagaaaauagguuagcucuuauuuagggacaaucagcccagaauggacauaagaaauacaaaguucucugguggcuacuauagugguuugucugaucuuugucguuuuguugcaaagagcuuucuaucuacacagcgacuaaguaugauuggaugccauuaaauacuccuguuaagcacuuuggggagcuaugggucuguuuuuagucuccuuucucucuuucuugcugauaaauguaaaagaaaauauuaacugggcuuaguuuagaaacauuauguacacauaaaaaauaugccccacgauacuagaucugggauaaaacucauuaacuuacuauuagaaaguuacuaaauuacuuccuagcuuuauugcaaaaugcaaaaaaaaaaaauguuguuuuaaaggauaauuagcuuuuucauuaaaaaagaaaaucggcuugaggaagaaaaaaacuuguuuaaagaaaugaagaauuaaauaguggaaucauuacucuaugaauucuuggugcugauaacacucuuaaauaguguaugaagaucagaacaaaaagaaaaagugcuagaggggcucaaagagugugaaaggucgguauucacgauguacuaaauguaucaccuuuugucacugacauaauaaagguagccagaggggcgaaaaacugcaaaggacugcaguugucuguaugcaccgacacaauagcuuaauucuuacuuggcugcuucagaacagugggaaauaaugcuuccucacauauauauaugaaucagaccuuaugaaucagaagggauggugcccaggagucuguacuuguauugacuuacucaugagaucaucaaauaaaauauaauuuaagaaucacugauuuagaggaaacaaagcaaaaaaccauauagacauagaacuguuggauugacuggugguauccaaguucaguaacuaaagcuuccucauguauauauauaugaggaagcauuauauauauauauauauauaugguuguaggcccaucacaggagcacuuacuuaugaaaucuaaaauuuagaaauugaguguuguaauaaaauaaaauuuccaagcaauauuugucauauauuaaccuaccaagccuuuuguaaagugcauacuaguuaucauacuacuugggaauuaugaauuaauaauaauucaaaauuuaugaguguacuuaugaaccauuaaacuuuuggagauuuuuuuaaucuauuuuguauggcauugguuguacuuuuacuuuuugggaauuuuuuuuuuuuggaaccauuuguaguaaucacaaauacauguucaauguaaaaaccaaagaaucugaaaugauugauucagaacauaagcucuaccauauuuccuugucugcuauccucauaacugggacucccuuuauuucugaaguccuuugucaguguauucugcagggaucuccuugacuauguccucuguccuggugagggugaagagacugaaacucuugaucaugagguaauggaaagucugcauggcugguggcuuacauggcaaggauaagguggaauggccagccaauuugcucuguaaaaggccacuaaauacuggguuuuagcccucagagucuggggaacuugaagucaaagaagagaaagaauuagaauacgcagaaccccagacagguuucaucuucugaucagauagaaaggcuaagagagaaaacagauucccuagucacacuggcacgaauccucugcucuggaaucuucucauaagcccagugaaauucagauuccaugacucuauuauagaccuuaugaaucagaagggauggugcccaggagucuguacuuguauugacuuacucaugugcccaucaaauaaaauacaauuuaagaaucaccgauuuagaggaaacaaagcaaaaaaccauacagacauagaacuguuggauugacuggugguaucgaaguucaguaacuaaaacucaaaaaccucuuuccuucaauucccagaaguacccaggaauuaacugccagaugaaacaaucugcagagaaaaccucugagcacauuccaggcagcauaaaaggauuaaacuuuauaucaaagacuaacuuuacaagcaaggaaacaagcagaagagagcuuuucugucccugaaguuucuuuaacuggggaaccuagucuuucuuuuuacaacuauauguaagccagcuuaaaguguaacugcuaagacagugagagggaccaaaucucagugauaccaaaaaauuuccaaauaugugacuaauaucagguucucucucauuugauacagguuagaaagaaaaagcacaaugaagggaagagacagagaaagagaagagugaaaguuuaacccaaguccagcugcuuuccuucaagcaaaaaagucagaccaguaaguaauuucgggagugucaggcuggauauauggaauuuccauucauuauaugacaagcauuuguugaauaacuauugcaucaguccuguccuguuuuuugguaugagaaguuaauaagauauuuuuugacaucaaaaagcaaauaucccacaacucuguauugcucuuucuaugacacggucugcacagcaugcugugggagaacagagagugggggcccuaaaucagauuugggaugauacaauguuuccugcaaucaaagagacuugagcugaguaaugaagaacaugccaaugauaauuaaguaaaagagggaguuugcauuccauacaaagacguguacaaagcauuauagcaugcucagaaugccugcagcugagugggaacuggguaaagguuaaacuauacaaagacaggaacuagauuaugcauauuuugugagauuaguuuauucaaauuuuauauuuacaacuuuggagauuuauuaaaggguuuuguauucguccauuuucauacugcuaugaagaaauauccgagacugaguaauuuauaaagaaaaagagguuuaauggacucacaguuccacauggcugcggaggccucacaaucauggcagaaggcgaaggagucauaggcaugucuuacauagugucaggcaagagagagugugcaggggaacugcccuuuaaaaaaucaucagaucucaugagacguauucccuaugcugagaacagcacgggaaaaucugccccuaugauuuaauuaucucccaucaggucccucccaugacaugcagggauuaugggagcuacaauucaauaugagauuuggguggggacacagccaaagaauauccggauuuaaccugauaagaccugauaagucauggcaucaaauucucacuuuugcagaugugugaaggauaaacugaaggcccuuaaaucaagaguugcaagguuuuugcuguuauucagaaauggggaguaucuguguugaaguaugaccugaagaggaagaugggauacaaauggcauuccagagauggaagaugcugaacuuggugaccaauuagauguggcuagauuacuggcuucaguggcuggguugcuaaaggaccguuuuuccuuuauaggaaaugcaggaggaaaaggaagucugguuggaaugggggacagggggcagaaagaauaaguugauuuucaauaugccaagcuugaugcagggauauaauggcuaggaucuagagacaucauucauucaauaauaauuuauuacauuucuacuaugugcuggucacuguccaccaggacauuuaaugggcccagcaaaauguucuagaguggcaauauggaugaaggaaucacuauguaaaugaaaauugaugccaugguuagggacaguaaggguaagugcauauguugagaaggaaagccugaggacacagcuggagagcaccacuacuggaggacaaggcuaaagaaaaagcccaggaaguauacugagaagcagaggcuugaacuacacugaacccaaaugaagagcugcugaguuacagaaaacaaagaaaaaccacuauaagaaagagaaaguggccaggcgcgguggcucacgccuguaaucucagcacuuugggaggacgaggcaggccgaucacgaggucaggagaucaaccauccuggcuaacauggugaaacuccgucucuacuaaaaaauacaaaaaauuagccgcgcgugguggcagacaccuguagucccagcuacucgggaggcugaggcaggagaauggugugaaccugggaggcggagcuugcagugagccgagauugcccuacugcacuccagccugggugacagagcgagacuccaaaaaaaaaaaaaaaaaaaaaaaaagaaagaaagagaaagcaacuucuauaaaauauagaugucccauuuauauaaguuaacaucaauuugccaauauagaaguaacugacaagagucgauccagugauauagagaagaugguagccacguugaaggguugaaggguggacugguguggggaggagcgggugaagagagacaaccuccuuggguuacuuagcugaguccauaagaaauguuguugagaaagauuaacaauuuuuaaacacauguuacuccccauuuuuaccuuauuuucauaccccugcauucuuaucuacuuuccuauaugucauauuugcuaacuugacuuauggucaccuacaaacacuaauauuagguaccagaagcucucuggagaguaggucugaaggaagcagagcggggagagagugugcaguccugggaaacccaggaaaauggagauccaugguaauguccacagcugcuacuuuggagagucuacaauaggucugaucaugaacauccacuucacaugcauuuuaaauuguuuuauuuuuuucuuuuaagaaaacaacuuacaagguaaauacaaucauuuucauuugacaggagaggggagugaggaucagggaggccaaaucacuagccucagcucacacccacaguaagugacagaguuggggcuagaaccccagaccuuuuaaaauaucacaggaaggaagaaacagcugaguaauuuggagacguaaagagagcagaaaaucaauuuggucuaacaaguguguuuuuguuauagcuaguguggaaaaccagacaguggguagauguuaguggcccagguggcucaacugcuaaagcccagcuuugauucauuagguuaaacaagucacaccuuccgggcaacuaacuacauuuaguacaauuuugaaagaaaucaauuuaaaaagauacaacuuuucaaagggccagggguugauuagcagccacuggaaggacgugucaaaaucuagaaacuugggccaggcgugguggcucacgccuguaaucccagcauuuugggaggccgaggcagguggauugccugaggucgggauuuugacaccagccugaccaacauggagaaaccuugucucuacuaaaaauauaaaauuagccgggcaugguggugcaugccuguaaucccagcuacucaggaggcugaagcaggagaauugcuugaacccaggaggcggagguugcagugagccgagaucgcgccauugcacuguaaccugagcaacaagagcaaaacuccaucucgaacaaaaaacaaacagaacaaacaaacaaaaaauuuuagaaacuugaaggacccgagccuuuggccaacgauggcuccauuuccucauauugaugggucuuagaaugguccuagugccuggccaugccuuccucuguugcuaguaguccuuaaucauuuugacuaucucuaucacaaagagagaaagguuucaucagaaggcucaugacaucuccuuagcuaagaacugguuuggucuaucauuaucuuuuacaacuguucaccccagucugcuguaaugauaagugaugcuugagccgguucuuaagagacuccuucuugacaaggggagggaaagagugacacauucucguuacaagaucugauccaaacccauuugacucugaucuuucugcaccuggaaaagauccauuuguuaacucagacuuucuccaaaaggcacuacagggaagaaauggcaaugauucugacaggaaaaagcuuuuaccgagugccaguuuuauguguauuauaaccuacagcucuacagguugugaaauacuucauccuguugggaacuacagcguuuaaggccauuuguuuggugaucgauagcauuacauaaaaagaagcuggaaaaagagaaagcaaaauuaagaaaacagauacauuucuuccauuuaaauuaaucuccucgcucuuuugcauuguuucugucccuuaaauucucccagauuuacaacuaagugcugauaauugcuggaaauagccacgaauuuuauggaauaauuggcucuauuuuaagacacacuuuaguguguacacuacauaguguggcuauaaaauaauaaaagagauuuuugcaugucgcugcuggauaucauucucauuauuuuuagucacacauuguauaugugugugcgcauggcaacauuuuauuguuugaaggucuuuuauaguuuuuagaaguuacaaaauaauagaauuaauugcuuugaauuuagucauuuugcacugggcaaauauugauuucuuucccaacaccuuuaauuucuaauggagcuugaaauuaacuuuggauuuuaauucuauuuuauucuggguuuguacaucagggccauuaauaaugucaggagagugcugagagaacuguuucugagccaggggcccggagugagcuuugcagcauuugaaucuucauccuuuauagaaacggggaaaaucuauguggggauguauaucauacuaguguuuuaugaaugaggaaucaaaugaaaaaaguuauccugugaaaagacacccucaugucacuugcuaaaguuugcaucagugugugcaugcgugugugugugcaugugugugugcauauuuaaucacauucaaaauggucggggaagcaaaggacagauuuucccuaacccaaaaugccuggaaaaaugagucuuucugauucauauauauauauauaugaauauaguuuuuaaauuauauuuuuaaacaaaaaauacaaucucgauauaauuuauauuaaugugauuauaacuccaaaauuuaauguaauuuaaauauggucuuucucagagguuuuuuguuuuuuuuuuuuuaagacagaaucucauucugucgcccaggaccccaagccguggugcaaucucgggucacugcaaccucugccucccggguucaagugauucuccugccuuagccucccgaguauuugggauuacaggcacguaacaccacgcccagcuaauuuuuguauuuuuaguagagaugagguuucaccauguuggcgaggcuggucuugaaguccugggcucaagugauccucccgccucggccucccaaagugcugggauuaccgaagugagccacugugcccggacuaaaacauuuuuaaugauuauauacugucuccauaaaaugagguagcuagaauaaaugauugccaagaccccuugggagcccuagguuuucauacaugccucuaggucagugagggcccccucuuuucucagagguacccugaacuuacucccacagcagcugcucucaggcugaugcacuggggacucaugucaggagcuacaggacagggcuucucuacuagagcugccaauagaaaaccaacuucucagaaccacuucccagucuccaggcuguuuggaauuggugcucugagaguuggaaaugccauggcagaagggagggaguauggacaagcacagauuucacaaaaucaacaggaaaugguuugaaauuguggcucugccaugaacuuugaaccucagcuuuuucaucugaaaaauaaaauaucuuccuuacaugcaauuuugaagaaugaaaauucaauaccuaacauacucuccucucccuucuccucaggguucuuuaaacccacagaguguguucaaaaugaaaaauuuaaucaacaaagacuauuagguuuugcaaaaagagagacagaauaguuaacuuaggccuacacaauuuauuuucugggagaaaaaacuguggguaaaacacuuggaaaaaaaauuaacugaguguauaaauaccagagacauuacacagaacuaauugcugucaaaaauauuuuuuuuuuuuuacaaaagagaaauccguuuaaguuuuagugagcaaacaagauuucacaaaauaaaaagagaaugugacuggagccuacagaaaguaaauuuugagugugguaaaaguggggagaagaguaaucuggggugcagguuaggggauggcauaacggagcugggaaagcacaggggacacagggagcuccgugcuggacaggagcagguguggcaaagcgggguguagagaguccugcaaaagcucacuuccacccaaacucaugaugggaucguauuugggaauacagucuuugcagauguaauuugucaagauuaauuuguacuggaucaauguggacacucaauccaauggcuggugucuuuacaagagaaaggagagaaagauucugacacagggacagagacagaaacacccagggaacguggcugugugaagaaggaggcagagaauagauugaggcauguacaagucaagguaugccaaaaauuacuggcaaucaauagaagccagugaaaggcaaagaaaagucuuuccuagaaauuucaaggggagcgugggcuugccagcaccuugauuauggacuucuaaacugcaaaucugugagagaauaaauuucuguuguuuugaccagcaagaaugugguuauuuauuaauggcagcccuagaaaucaaacacccuuagcauccuaugccuuggaaucaucugucaggaaaagcacagaggguacuucucgcucaacuauugcuuuucuacacucuucugauguguauaauagaguccuugccucaaaauguccaaaaauccauuguguugauauugaagccuacuuuuccugcuacuuucuuuuuuuaauuucagucucauggagguacacaugacaaauaaaauuguauauauuuaaaauguacaacaugaugauuuguuuuauauauauauauauauacacacacacacacacacacacacauugugaaaugauuaccacaaucggguuaauuaacacacccaucaacucagauauucuuuuuugugugagaacacuucagaucuacucuuuuagcaaauuucaaguauacaauacaguauaauuaacuguagucaccauguuguauauuagcuccccagaacuuauucaucuuguaauugaaaguuuguaccuuuugaucaacauuucuccauugucccuacccucagcuucugcauuuacuauuauuuuacucccuguuucugugaguuugacauuucauuuuuuuuuagguucccuauauaagugauagauacagcauuuguuuuucucugucuggcuuauuucacuuagcauuaugcugucuagguuuagccauguugucacaaaugacuuugauaugcauuucccucacacuuaguaugugauuccuccagcuuucuuuugcuauugcuuuguccauuuggggucuuuugugauuccacaugaauuuuaggauuuuuuuuucuauuucuauaaaacaucugauuggaaauuugauagagauuccuugauuguauagcuugcauugauaaggauauuuuagugggacuaacuguuaaacucuuccaaucugagaacauggguuaucuuuccaucuauuugugucgucuucacuuuuuuucauccauguucaugguaucaauguauggauccuucacucaccucuuugguuaaauauaugccuaaguaauuuaugcuuuuugauacuauuacaagugggaagauuucaauuuuucuuucagauaguucauugguaguguauagaaacaaaacugauuuuuguaugauuuuguauacugccacuuuacugaauuugcuuguuaauucuaauaguuuuuugguggagucuguaggguuuucuauauguagaugcuccuggauuuaccauggggucacauacugauaaacugauaaguugaaaauaccaaaaguaaaaaauguaucuaauacaucuaacauagcaaacaucauagcuuaaccuagccaaacuuaaaugugcucagaacacuuacauuacccuauaguugggcaaaaucaucuaauagaaagucuauuuuuuaauacagugugaauuaucucaugaaccacauauugcuaguucaggaaaagaucuaaaauuugaaguacaccaaauugcauuggcuucacaccacuauaaaauugaaaaaguuguaagucaaaccaccugaagucagggacaucucucuauaagagcaugucaucugcaaacagagaaaaucuaacuucuuccuuuuggauuuggauguguuuuuuucuucuucuuacccaauugcucugcuuacgacuuucagugcauuguugaauagaagugacaggaguggggauccuugucuuuuuccugauccuugagggaaagcguucaguuuuucaccauugaggaugaugauagcugugggcuccucacauacagccuuuauugaauugagguauguuccuucuguaucuaguuugcugagaguuuuuauuaugaaaggauguugaauuuugucaaaugcuucuucugugucuguugaaaugaucauaugauucuuauccuucauuuuguuuauacgguguaaucacauuugcuaauuuagauauaucaaaccauccuugcauccagggauaaaucccaguugaucuugguguauaauucuuggaauaugcuguagaacuugguuugcugcuauuuucuugaagauuuuugcauguaugcucaucagggauacugacuuguaauuuuaauuguagucuccuagucuggauucaguaucaggguaaugcuggacucauaaaaugaguuuggaagugucagauauuuuuugauagaacaaaacuuggcauaaagaauaucauguacuauauaucaggaacauuaccaaaugaaaauaaaguucuucucucuuauugagaauugaaaagaauuuaagaugcuguaucccacagagaaagcuucucuuauguagcaagggcuuuguauguuccgagucugaugaaccuaucuuuacagucauuugagagguauguguauauauuuggggguauguguguguguuugugcauucagacacaguuacaguuuaguugccccaaauuguauuuaauacuuaccaagcacuaagcagugggauaggcauuuguguucaaagaugaaaagcaccuggucgguggcauuaagaagaacaguggauagagagcuuaugucaauacaauaggguugcugaugacauaaagggacuuauaugagguauaccuccaggaaugaguauuauuugauuucauuuuuauuuaggaucuaucuaguauaagaacugucaauguguuuauacuguucaugguuuguaagagaccaggcuggucuguuuuugcauucauaauuuuaauguaaaaaugucuaugccuuugucuuugauaagguuuuaauaacugauuuauaaucucucucauuguuauaaaugaaaagcccuucugcauaaaggauaaaagaguaaaugucagugauagaucauauugcuaauuuuauccauaaacuguuuccaaagaggcauuaaugaaaucacuucugcuuacuaccaguuuuuuuaaaaaaaaaucuugcucugguuuuacauggaaaaaaauacuguucuuuugauuuuaaaaauacuuuuugaccuuaaguauauauuuaaaucuaagguaagaaguaagauuacuuuaaaaauagauacauuucuacuucuucuaagcugcauuuauauuaucuucagggucacuugcaaugcauauaaagcccucuauuuguccacaaaucacacuguagaaagcacagagcuagaaacacuaguguucucagccuugccauucagagguaacuugucucuguuugcaaguaacaugaucuuauauacagaugaagagugcagcucucuccuccuuuucuccccacccacucuccuaacgucuccauauucuuucucccuccugcuuaaagccuuccuucuuugguuaaaacuaguagguagccacaugcuugggggagagaacuaggguaaaauuugggaaauuggggugguugcagaccuguguaagaagguagcauuucagaggacucauuuuuuaggcauaguugcuaaccuuaauacaucauuauaucgguauuuuuuuuuugagacagaguuuugcacuguugcccaggcuggagugcgguggcacuaucuuggcucacugcaagcucugccucccggguucaggccauucucuugccucagccucccgaguagcugggacuacaggcgccugccaccacgcccagcuauuuuuuuuauuuuuaguagagacgggguuucaccauguguuagacaggauggucuugaucuccugaccucaugaucuacccaccucggccucccaaagugcugggauuacaggcgagagccaccaugccuggcugguaaguauuuuaaaauaucuacuaaauuaccccuccaaaaaacuuguauauuuauucuuaauuuuuuaagucuguggauaacaagcucaucuucccaaccaucaaaguuauauucauuuacugcacuuuuagaaagcaaaagauuucucaagauucaaauaugauuuuuccacugggcuuccucauuuaaaaaguacaaugaaaacacaguuuucuuaaacugcucaacagagagacugcuggaaucuaaaugaucccagcaugacaauuacaguuugcacagauuaauuuuuuuuuuauuaccacaugugaaacugauguuaaucaagugucaaugugagcccauuccuuggauaauaaccacaugugguagaauuuacuaccugauauucauuuauuucaucuuaagguagguagugcaugagaagcauagggugaugacaaaugggaaaaaaaacuaccacuuugaaugugaacugaaauccuaauucaaauccuuuagaauuuuuaaauagcaaagagauuacuugggcuuuagacuaacaugcuucugcuauguucaacuucuuucaauaucucaucuauauguauaaaggaagaggagaaauguuacuuauuaauaaacauuuuucuugauuacuaauagcaauccaaaugcuucucaauaaauuucuccucuauacuauuuuugcccuaugcaucauucuguaguauuauuuuuacuucuaaaauacguguuagcucaaaaaccuaguuuagacuguagaaaggaagcuuagcgaaaaugaccucuguucaguggaacuguggcaaucacacugcaggaaagcaaaaguuucaagacagaguugaugguacauuuuaucugguaaaagcggaaaauaggucauaagcaguggaucuagcaacaauaagagaaggacuuguuuugcaaugacugcacuuucaucauccaucacugggcuuccccucccagcccacuucucuucagcacccuuugggaugacuggccuuguggcuaaucagccacauggucagcugagaagagaggagauuuuuuuuuuuuuuuuuuuuaucauagcuugggcuuucccaucaggugcuguaacacacaggaguagacaccuauacuaacaaccaagcagcaaguacugcugucuggaguuuccuacuugccuuacucaagggcaucuaauacgcaugcaaucccaguacuucucuccuggaacugcuaugcugugggaaggcaggaauccuuauuauugagaaucucucccuuguggaaguccagaaaauguuauuuugcucuuacacagagcuuaauuaagucagcuuaauuuaaagaacuauacaaaagaaaaauagugcuuuuggacaauaaauuaacaaaguuugugcuguccaccuagcuucagguaauuuaggaaccuguaggacaaucagucuggccugccccaaugcagguuuuauuaucucaggaaaucucuaucuaugucauucaaacucuagaggagcucauuuucugaguagggauauguuuccaucaaaugcuugaauauucucuaagugggauaacucagcaacagauagccauaugguagaaaacacacacaggcuuuucuagagcucugaauuccuuugcaguaauacaaaugggaggcauuuuccucuucacagacaaauucuuagagguauuucuuuauccaguguaguuggaugggcucacuuggcucuaccuagccuagugaaaguugaucacaugacuuggcaagaaagacauguuuaauuaauaucucaacaggcccagauaguggcagagaguauuaggacauuuugaugccugcuaaugagaaaugacagcaauucuguaguugccaacauugucuggcauuuggugguggcauccgugaugccaagaaugggcuuucaagaguagaguaggcauauuuuucagacaggagcuucuauggcagcuuugggaugaaacugggugaugaaacuaagggacuacgagcccuugaauguuuuucucauuuuacuuaaaaauaaaaccauauucuuuauucaaauccauauccauuuacauuauuucacuuuuauuggcuaagucuaaagauuuccaaaucagcgauuucacaaacauuugaaagaagucagaugagagaauaccccaaaagucaagcaucaaaauuuucuuggaaacggcugcauuuuuuauaagaaacuauugcuuauuaaugguguuagacauauucaucaaagauaacaggaggagauuauuuagguggauggauaauuucgccccagauuacaacaaucuuuauauuuuuguagcauucuuuugccaagagggagaggaaaggaggaagaaaaagcaaaaugcggcaacagcaacaacaaaauggaugaaguaagaguucuguuuaucaugauuuuauaaaaaaaaauaaaaaauaaaaaauacgggaaccaauaauucaacuuucagaauuucuuccugugaauggugcaaaaucaagagaauccucacugaguaguuuuuaaauagaguuuagcaaacaaauccaggugucuuaauuucagaagacauaaauuugaugcagcugagucacagcuggaccgcuccugaggggaggaagcaucucauuauaccagauuuagguuaauaaucacaagagaauauaaaauuagcuuuguuaccuaagaucauacuauaagcuaaauaauugagaaguaauuuaguaaaauaaaagcgucuguaucacuuucaguaaagaaauguuaauaguuaaagaagugauaucaaaucauccaaaugguuuucaaaaaugcacuguaagcauuuucagcagccuuaccaguucuccuuacuucagaaauaacugagagcccauaaccuguuaugggaaaacuuaaauaucauucagugaccuuucuuucuucuaaagcagcauucuccaaccuuuuuggcaccagagacugguuucauggaagacaguuuuuccauggaucaggagguaggggaugguuucaggaugauucaaguacauacauuuauuuugcaauuuauuucuauuauuaugacauugugaugaauaaugaaauaaucauacaacucaccauaauguaaaaucagugggagcccugagcuuguuuuccugcaacuagguggucccauaugggggugaugggaaacaguggcagaucaucaggcauuagauucucauaaggaacaugcaaccuacaucccucgcaugcacaguucacaauagcauucgugcuccucugagaaucugaugcugcccgugaucugacaggaaguggagcucagguggaaaugugagcaauggggaguggcuguaaauagaggugaagcuucacuccaccacugcucaccuucugcuauguggcccaguuccuaaaaggccacaaacugguauuguggggauuggggacuccuguucuaauggauauaaguuguuucacgauuuaaaaaaaugacuuaugaagaauagcaucugaaguuaugcuuuguuacagcggugcugaaaaaccacugucuucugggccagcuucacccaugauucaaaucugcacccugcugcuccuuuaacaagaccagucucuucacaguauuacauuuauaaccauggcugucaucuguugagaauugacuacauaguagacaacauguuagacauuuuacaaaucaucugaacccuucacaauaauauuggcaggcacauacuauuauucuuguuuuauuaauaaugaaacagggcaguggugugcuaguaaaccagcucuauuaaaaguaucuugcuuuacaggguuugucaauuucccuagcauaaauucuuccacuguggucugguucaagcuaccaagguuuacaccaaaguucugcuucaagcuaccaagguuuaccaagguuaaacaaucaauucaaaauuuuuugaauauuuaacaauuaguucuguuucucuacagaacucugaaaggaacuuagcucagaguuccguuccugcuugaacgucuucccaaauaucuugguucauauuguuuuucucucauaucauacacacuugccuugauacuaguuggacacauaaauacauguuaccuucuuauaauguauuaaugcuuuuauuacuuauccugcuuuccuuuaaaacuaccuugucuacuucauaaggaaaauggcucucgucuaugcuuuuguauucacauagugugccacauacaaaagagaugcauaauauuguugaaugaguugaaacugugauuuaaagauaauccuguacaccaaguuucaaaagcuaaagacuugucauagaaacuuauuaacuaaugucaaaauggaaaccaaacacaguuugguuucagagaaguuaaaaaguaucaaaggagagacacauauuauuuuuuacucuaauucucuuuccuguuuucugagcagauauuaaccuuccugaagcuccguuccuuaucuucaaauuaaaguagacucuuucccuauaucauuuuuuuccuuaauucaaccugacaaaaguguuaaaauggguguuuucuauuccuuuuucucuucacucugaaccuuggauaaaacauacacugggauucaaacuacagggaguuuaaugaauaaugccaguucccucaagaccuagcacuggcauuuuauagcuucggagaaguucauaggaucacagcaugucuuuacagcacacugcuuuucaauaugcauuugcagaucaacuuuuuuuuuuuuuuuuuugccaagacucaaagagaaagacauauuuuugaaacuauugaaagagucuuugcaaaauugaaauuaaauccuuucuuucuauauuuaaucuuggucaucauuccgaagcaagaagggauuaauucaaaauuuggucugccuuagaaauguagagguccuugggcuguguuucuccaaaugaccuguacuauuuuaauccaguguaauuuauuugguuguggccaaaagauagaauggccuuuaaauccccuuccaacauuucuacccagguaguacuuucacagcucuuuccaucuuauuuucuguguaggugccagaugaauaugagaguaaaggagcugcugggaugauuguuuccuugugcaaaaagugauuucaggaagugacaucacuugccauuauuucccuuagcucccaaugcuuuaguccuggugagaaugcgagcuuuuccucuagagaauacauacagcugagcaagggcuuauuaacauuugacuugcauauauucuauugaaaaccauauucucuaccaagcaccaugcugaaguugcaucaccucacccugauuucucccuguccauaugguuagaaaaacaaacccagaaauaaagcaaacaaauccucugaauauacaaucugaaaaguuaaaauaauugcuuaaaacaaauaauuugugacaaaguauuaaaucauuuuuuuccccuaugugucuacauguauccauauuuuguaagcgugaaaaaugccaagcuagauucuaagagguaagaauacauagaauuuauuccuagaucacaauccuggugaaccagagauguggaaauaaggugauaagaacuuuuauuuuuaaugaaacuauacacauuuuuggagggggcuacauccuaguauuccugcccucucuacuucacacuccaguaucuauuccauguauggaauggagucagcucucaauauauugaugaaugaauaagugaugguagcacuauggguccuuaguguccugugguccugcaguuggaucccauagucacuccuuaauaacagggacacacugagcaucugacacagaucauggugugggaaugggauggaaaguaaauugaaggaauuugguaguugcucacuugauaacacagaagcacaaccugacuagauaauaccauaucucgauuagaaagaguagauguacuccaugcauauaaaucagcuaguguggcuauuauacuugcuaauaaaaaccuuuaucuuuucaaagagcauuuauugaaauacugagauauccuauggucuuuucauugagaaucacugauaugaaaauauggccuguguaccgaaugaagaguauacggaucaguagaugcgacuuacacucaaaguaaaauuugacuagcuguuuuucgaaacuuaguggcauaaguucuuuaaaaguaggacauuuucugaauuuaaaaagcacuuuuuuuuauuauacuuuaaguucugggguacauuaaaaaguacuuuaauaaacaauaucucauugaauuuucaaaaggaaacuuaaguuuagagacauuaaaugacgugucuaaaaacacaaaaccaagauagcacagaggagcgggggcggagagauggggaggaaagugauuaaaucugaaucauuccuauuuuauugcugucaguaaccuguggcauggacuggaaaagcugacuucaccuucuauaaguaugagugaaauccacacuuaaugcagcaagcguguuugaggaaacagagaauuuauaaaguauggagacagucauuuuucuggaacuuagacauguccaacugauggggaaguaaguuuggccacauagccuaaggaucugaugguuugacaucaggacaucuaauuucaaacccugaguguuuuccccucuccauaacuucccuguagcaaggauacacauauaauauuacaugauaaaucaaaagauuuuuauguucauguuauucaaauuuuauagaguuuaaaauaaacuucuugucauguacuagucaauauuuaaacauaucuguaucuauuuuagaauaacuccuauaguuagccaguauaguaauugaccacacucuaugauguaagggguccccaacccguuaguaacugggccucacagcaggaggcaggcauucccgccugagcuccgucuucugucagaucagcggcagcaauagauucucauaggauccugaaaccuauugugaacugugcaugugagggaucgagguugugcacuccuuaugagaauucaacuaaugccuggugaucugagguggaacaguuucaucuggaaccauccccuuacccacuucccccacccuggucuguagaaaaacugucuccuaugaaccuggccccuggugccaaaaacguuggagagugcugaucuaagauauuaucuuuguugcaacuuccuuugcuauuguuacuauaaugucauaguucucacaaauuucaguaaugaauggggcaucuuaacauggcacaauauuuuccuuaaagauaauuugaaauauguagauuuuuuuugcuaauauccuaaauuccuccauauaauuucuuagaauaauguuuaaugucuugugguaguuuuugguauuauuuuuaguacccugccuuccauuuacccauauuuuguuauuggacuugauucuauuuuucuuuuugcccuguaaguguacucucuccuuauagcuucacuaucuucauaaauuuacuguaaagagggcauugaauaaaauuuaaagaaaacacuguugcucuggauacucuuugacauucaagaaugcuuggaggcagugcauauucacugcgugcauagucugugcugggcgagccucagauuuaaacugguggaugaaauguggcaccaccuccugccagagaugcagagaccaguggaggagaaagauauuauuaaaucauuaugaauaauaagugcaaaaucauaaccauugcuagugcuaaaagacauauguguguuuuagaauaagaggauuugaucuaacuacagggccauggaaagcuuuucugagaugacugcugagcugaaaucugagggaggaguagaaauguacuagacaaagcagagagguagaugugcaaauguccugugguggggggucgugguauaggaggggcaaggguaugagagugcagggcaugcaucaaaaacugaaaggaggccagugcauugaaggggagaaugggaggagauguaggggaggaaaucagguuaaagacauggccauauuacguaggaccuggcaagccaggugaacuugccccaaaggauggauuccaauucccuaaggcuaaauaucuaaauuuuauuuuagauaccugcuaugguuuggcucuguguccccacccaaaucucaccuugaacuguaauccccacguguugagggagggaccuguaauucccacaugccaagggagggaggugauuggaucaugggcgaaguuccuccaugcuauucucaugacagcgggugaguucucacgagaugaugguuuuauaagggguucuucccccuucgcuugcaauucucucuccugccaccaugucaagaagggccuugcuuccccuucgccuuccaccaugaugguaaguuuccugaggccuccccggcuacauggaacugugagucaaaccccuuuucuuucuaaauuauccagucucugguauuacuuuauagcagugugagaacagacuaauaccauauccaacgcaauucuacccaaugcugcuuguuuuuguagcaaugcucaaacuccaaguuaucauugaugccuaaguuguagaaacuccaaauggacagagacaccaaguuucuucgugccaauaaaucuaggucuuuaugcucuauguuaguaugacuacagcaaauagaauucaauuuauuuugaaaauuauucuuugaauuauaucaauuauaggugaaauggauuaucaacaacaugguaugggcuguugaaauccacugcgccucucacgugugcuguaauaaggugcaacacaauuuacaguuuacacauuuaugaacccagaggaaaugcuccagcauacggaauguacaauuguuaccguuuacauuuaaauuuuucucuaacauuggcuagaaaaaauuuuacuuuugcuuuauuuggcaaugucaggaccuguuccuuacuaguauuucagaauuuuuaaaucucgugauuuuaaaauuaaaagagaauuauauaggucaucuaguuuauuccuccuguuuccccuggaaacauuacgucuauauauuugggcaacaugaaaaucucuccuuuaauaaaaagaucugcaaaaauauuuucugucagaaugcacaucugacauuuaauaaauuuccaaggcuaacauugcuuauuuuugucgaacacuaaaauacuauccuuuaaccucuugcauucauuaaauuagccaaaaguuuucauauuauugaggauauucuaaggaauuuuuagagcaguuccacacaaggaacuaguaguauauauaagaauguuuggccaggcaugguggcucaugccuguaaucccagcacuuugggaggccaaggcgggcagaucaugaggucaggagauccagaccauccuggcuaacgcagugaauccccauuuauacugaaaauacaaaaaauuagcugggcaugguggcacgugccuguagucccagcuacuugggaggcugaggcagcagaaucgcuugaaccugggagguggagguugcagugaaccgagaucaugccacugcacucaagccugggugacagagcaagacuccaucuccaagcaaaagauacauucuuacagugcuuuugggagacugaagcagggauaagucaauacaauaaacacaaacuguucaacaugaucauuuuagucccuuugucaugguuugguguucagauaugcuacuauucagaucuuaaaggauuuauggagaguggaaugccuguaugagaaaauuuuuucaaguuuaaaacuucaacaauuuaauguauuugcauuuuguaacaaacuugccucuuuuguucuuaaacgacaaaaacuggcuuucccuuuccugugaucugacuaucuucugugaucuuuggcuuugucugugggauugaguugucuacucaucccaaagggagacauccuggcuccucaggggagcaguucacaaaugacaguccucuaagcccuacauauaauuuacguaaaaacaaaguccccauguacacacaaacuaacaaaugaaaacaggagacauagguuuaggaggcauacucuucaauucuucuggagaaaaauacuauggaaaccagucauucacugcaguccaaaucugccauaaaagugauagcaaacaauguauggugacauuaaauuaagagacacauugugugauuugggcaauuauugguauagaaguucaaaggaaaaggacaauugcucugaaagugaugaaaugacaaaaauuuauugaguaccacauaagccaaaguuuuucucagcaucuuccguacaucauuucauuuaaucucacaauggcuugaagaggugagcacuguuaauuaucuauuccuacaggagaaaacugaagcucaaauaauuuaaauggccuaggguacaaguaagaaaaugguaaagucaaagucaacacaaggcagagugaccaagcaaaaaggccucucuguuccaucuugaacuagagcuucuagccuggaugaucacaggucacucauagcacugcugucucauccugaccaagcccgggcuaguguagaaggugugcuaaaauauuguagccuguaauguuugaaacucuaacaaauguucuauuauauuaaacuuuagcucuuaguuagcugcuuuuuuuaaaaaaaaauacuauuuaaaauaauuagcaugauuucuuuucaagaugaaugcuuggucuucugcaggaaauaaugaagcaaaauauuuuauguuacuuacacaguucaaacccacagaauacagaauaagcaacugcaaaucucagcucacuggcuuguagaauaccaagagacuucagucgaacaaagugcaagaaaagucaaaugauugaccacaaaggcacacggccugaugguuuuauagcuagcgucagacacaucagaaacuggggccuucgcacuucguucuucuugcuuugaauguggucauugauuucgcaaaaauguaaaauuguucauucugugucaaacugaauggcauacauuguaucuucuuacauuugugcugugugaaauuuuuaacuaauccauuuggauaaguaagacuguaucaagucuuucagguuauuaggaggcaaauggccuucaauaagcuacaauguauauuuuucgaaagaaaaagucaccagccaacccucucuugaauuauguaguauggucuuuucaccucuauuuaugcacacguuggauauucaaaauuuuggcuucauuuggagaagacaacaaaagaucaggcuuuuauuauuaaaaagaaugauucugcuuuuaaagauccaacaaaauggagcaaggaacaaguaggaaggagcagcagaacaaaagacaauuuuugucuuuuaccuuuggagcuggccacuagcaccaaaccuaaacacacuuaggacauuucuaauccuuggagucauuacccuuaaaaaacaaaacaaaccucagcuacucaaccaguagcauacauuuuaauuuuuuuuuuugccuuuuugcuguguauuuuaaggauggaaacaguuauaaaaaaagaauaaguugcuuuucaguucaauguaaaagccaucacugagauagaaaauccuugcaaccaccaccgauuucuugcucuugaccauugguuagcauuaucguauuucaggaacaagaucccguguaauuaaauaugguauuuauaacacacgauaaaaauuaugcuaguggagugaaggcacugaguuucaucaauguaauucuagcaucacguuauauuuaauaaaugucacauacuggagguuaauauuuugaugugauugguaaggaacaauuuuaguuauaacucuuugaauuaauuucaguaucaaucauuuuuguucuuuauucauuaaaauacuuucauauauguaaacacagauaaugaaucuaguaucaauuuugaccuucuugacaucuuucuauuguuaguuuugucaagauuuccuuugccucuuguuuuugaauaucuaccuaaacaaauaaaugugugcaacuuuguaagucaacauuuuacaauauauucaaaacacgauuucuucuugcacauuacuacaaauaacacaauggaaaggcuuagagagcuguaugacauuuuuacuguacacagggcucuacucugagauaguuugcuugucaccauuuccuaaaaguaaagugaaaucuguuuguauaaucggaggauuuagauauuagaguuucaguguuugggcauauugagagaagguugaaucucucuuuuucucuugcucuuccuucccuacacacacacacacacacacacacacaggcacauacguaugcacacacuaaccaacaguugacucucuucuuguaauuaugugauucaugccaaauauguuuucaaaagugcuuuguuuucaaaagcguucugcaaauggcgaugcauuauuggaaaauuaauauuauaauuauaagaguuagcauuaaauuuuuuaaguacagaaauuuauuuuuuauuuaaccuuuuggaauaaagcuauuuauauaaaccaaggcacauauguguuuuccuagucauuuuugcauguuacuuuuuauuuuugccauuuuaaaauauuuuuacccucuuaugucuucauuuuauuaccuucuuauguauuuuaucuauuggcuuuuagauauuccauuucggacucauuucuuugaucuaaaaaaagguagucaaauaguugggcuaaagcaugaggcagccaucauccagaaacuaaauguuccaauuacccugugucucccucucggauuaauuaauaaaugaggguccagucagagacaucacacuaacacgauuucccaaacaaucgacccaacagauguggguuagacacagagaggcgaauccaaguuuggacuuccaaucucaacuauguguuuauggaacagaggaaaugcugguccuucuuuuugaguccuuugccaccagagaacauauuuuaacaaguagaauaguguauuuuauuuuuuuuuuuuuggagaaaugacaauuggaaucuugguuuuucagauucgagugauguauuauguggauuauucagguugcugagcuucaaagcacagcucaagacuugagauucucaugcaauuacaagauuaaagugagauaaauuggcacucacaguuguggcagguggccccacuguauccugucucaucacaagugcauuugaagcugucccauguuugcgagcacuuuccaccaugcucacagugauugggcacacaucugucagagagagagacaaacagaaauaaaccaacaaacaaaugagauuuaugaguggccaaauuccaagcugucugggcaauauaucauuucaaugccagguugccuuaccaaggcaauuaauccuuguuaguuuaagcagauuaauaugauucaugaaagaaggugccaagcgcaacaaagaugauguaucaccgaccuggagcuucccauuuuugaguaaacaguagacacuaacaaacaacugagggauuuacuugaauaucacagauucauuuuauuuuucuuuuaccccaaaacaaagacagcagcuaaguucccuccuggugaaagaucgaagauaagcugucuuauuucuuguuuuauucuauucuuugucaagccaaaaacugacguaaagagggguaucaucaaguuuuucauagcaauuugaguuuuugaaauaacgucaugauaacagcaaugaaaauauacuaacuuagaaagaaaagauuucuaagucucccaaacaccuauuucccacuggauaacuaaagcagccugcugaaagaggcagcaagcauaauacagaaggaaagauacagguuuuguguucaaaucuauaucuuuuuauuaagaugacuaauuguagcuacuuaacugaaccuuucugaaccuuaguuuucaccuuugaaaaauaggauaauucuaucuuacaaauaauuuuaagguuugaggauaauguucaugaaguauuaacagacaacuaauaggcaggaaauagugggccaauaaacggaagcuuuagauuucugaaacacagccuccagggcacagcuuuacuguaccucagaaauugugaggcugaaauuuguccugaaacaccccuguuucaauggcacaaacccuuucuccugguuccauccacucaucccucccaucaauuccugucuccaucuaccccacaaccugauuuuuguuauaauccugcugaagaugcucacagauaacaaagguauucauugugauguaccaguauucacaaaggacaucuagacuuuaguagggaacucucaaaaacaggaaaacuuucccagauuaaaauagcagaaucuauaaucaugggucacuggcaaaggacagauaaagagccaccccuuuaucauaaugcccuagcagcucccugcuacaaaaucugauagagcuggccucagaaauagcauucuccaacuccuguucucaauuuaccacuagccaugccuaaaaccaccuguagcugggcuuggcucaguuuggcauggagccccuggcucugaguagcuugcuguucuuccacaacuuuuuacaaacuuuuacuccugaaacaaacauugauugagcaccugcuauaugcacagcacuacggaaaauagaagaugacuacgacuguauucacagccuugcagaagagcucauaguucauauagaaguagauacaguauguaugaaaacuacagugcaaggaagaaaugaaaaacagcauaauucagggacaaauaaaguacuacgggauuucacaugaggaaucauguacauuuugggcacaauuaaaagcuuuuagguugagacucaaugaauggacaggacuacaagagaagaaaaugagaggaagaacauuggggaaaaauacaauauaaacaaaagcaucuuguugaauuaucaugagggauggaaaauucacccuaaauuuaauagacacuuacuuuuuuauaaaauuugggcucaguguuaucaaggcuacaaagauguuucaucuccaaauuugaguggaggugggguggggaucugauucaugaaaaaugcaaacccagaagaauuugaugagucauaaaagauacacgaaaugcuauagaaauuuggauacuagaggaguuacaaguggaugauaaacaaaggcuucauaaaguucagaacauuucacccgggccugaaaagaagaguuguauguuuaugauuaaaauguugaaaaucauuccuagcagaauaggcgagaaaagcacugauaaggagguggaagagugaaagcagugggaggugcaggguugugaggguccuuuccuauagccacuauucuguacaggcccugaggcgugggaacacacacagcagaagguguuuacauccagagcaggugguucugcauaugauggaaggaagcaaugggcuagacacuucaaaauuacaugaaacuaaaacauccuugauacuuaauuuuggaauucaguacguauaugguguuguaugguauauuuacuuucuaaauuauugcggguuaauauuagcucagccuaauauugaaaguaauuuacaucagcucauuauaucaauuaauucgggggaaguagugcagaaggguacuaaguagcagaggaaaaccaggcuggaaucuaaaugugguguaaauaaugggcagaguagaaaaucaucucgaugauagaaaagauuacuguguucuuacacgcaugcaaaaaggauauauccaucaagugagauuaaugaauacaagucaucccucucuaucugugaggggauuguuccacaccaauccccacccaccccauagauacccaaauccacgcauuuucaagucccuguuauaaaaugguguaguauuugcauauaaccuaugcacagccucccacauaauuuaaaucaucucuagauuacuuagauuuaucaucguauuauuuuuaauuuuuuucuauuugccauugguuggauccacugauggauucacaaauacagagguccaacuguacuucaaaaauucaguauuaaggauuucuuuaaaaguauuuuuuauuuagauacaauuuuaauauuuuucuuucuuauaauucuuauuuuuauuauuuauuaauuuauuuacugauuuauuuuugagacagagucacccaggcuggagugcaguggcaccaucucggcucacugcaaccuccgccuccuggguucaaaugauuccccugccucagccacccaaguagcugggauuacagguguguaccacgacauccagcuaauuuguguauuuuuauuagagacaggguuucaccauguuggucaggcuggugccgaacuccggaccucaagugauucacccaccucagccucccagagugcugggauuacaggcaugagccacagcccccggccgauuauuuauuuauuuauuuauuuauuuauuuauuuauuuauugagacggaaucucgcucagucgcccaggcuggagugcaguggcgcgaucucggcucacugcaagcucugccuccuggguucacgccauucuccugccucagccucccgagcagcugggaccacaggcacccgccaccacgcccggcuaauauuuuuuuguauuuuuuguagggacgggguuucacuguguuagccagcauggucucgaucuccugaccucgugauccaccugccucggacucccaaagugcugggauuacaggcgugagccaccacacgggccugauucuuauuuugaaaauugacauucucccugugaugauuauagguauucuaauucuuaaugguggaaaauguuuuauuuccuaaccaacuuguucaaauauaauugcaaacccuaucgccauauauauauauuuuaaaaguuaggaccaguuaccaagcaaaacaaaauacuaauuaaccuagcuaccccuuuccuauuauuucuucuguauuuccacagaacuaguaaccuauguccaauacaccauuauuacauugcuuagcaaugguuuguugagcaccugucucuucugaacugagauuccuacaauuagggguuuuuaucuuauaauucuuuacauaacuaggugcaugcucaguaacugccuauugacacauugacugaaagaauggaugaaugcaaugcuagaauguuacaccaccaagaaacaaguaauuucagaagaaauaucucuuuuacugugagaaauauagauuauuuguaucuaugauuuuauucucaaauccagacucuugcgcuaauaaacuaauuuuuuuaguagccacaaggaauguguaauuuguuucauggcaaguccuagcuugaaaguuugguucacaucaaaaaugaauaaaaaugacucgacugcuucuacuugagaaugacuugaccgggaucaggaagguacaggggagaaguuggcaggugucaauuuguugugaucaagugacuccagaagaagugaugcauccaauuaacucgggcuccagacagcccugccuucuccaucgaacucauacuuaguuccagcuuucaaaaugcuuuagaaucaaaugcauuuuauucaaauaaaauucauuuagacuccaauacauaagacaaaugaaagcuauauuuuggaaggucaaaugggcugcaauuacuuaaagcaaaauaaaucaacauggacagaguggcugguuagauggauguugcaauucaauccagggcuguggaugacaguugcacuuuuauuuuacccauagcaucucuuuuauuucugaacuugauuuuaauugcaaagcauugggaauuuugggaaucacaaauagaagaagcugcaaaugguaccagauuuguuuguuuguaguagcuuacuugguaguuuauggacauuguuuaauuaagcagggauaguggaagaacuuuuauuucaaaucuaaaaaauguuagccugacagcauaacuguaugccuugguaaucaucaacgcacguugaaggcuuuuuaucuacagugcuuaaaguuaaaauagacauuuuaaaauaaaaugucuuuguguuaccuuuaaaaccauauuuggucuuguaaaaccugaaaugaaaaccauagucauagcaccaugacuccagaaauccacauggaaauauguucuggugguaccaagcgcaaugaacagugccguguguaucagaauaacugcuguucuguauaaaccgaauccuuggcacucaaaaguaguguuucucaaaccuuugugugcauaggaaucucuugaaaaucuuaaagauucugauucuugcggucaggauuggagucugggauucugagauccuaacaaggucccaggugaugcucauguggucgggcagagaaccacgguuggaauagcaaggcucuagcgcaucgcacuucucugcagcgggggcucaaaggagaaugcaguugcugaguaggaggagaaacagcccaggaagggagcacaaggagagaagacagccugcagccagggcuaacacgaucuguucagucauuucuccuaagacugcuuuuccauagguccuccugccauguuuuaaucugaucuacucagagugacauauaauaaucuuuguaaucucauuuagcaaguuaaaucauuucugcaccugacuguagacuucauauaauucauagaaagugaucacugacuauaaaggcaguuucacuucuucauaaaaucaaguucagcauucucaaucucagggucagcuaagacuuuccccaugcuuagaccacauacauauaacagugcuaggauauuuaauuugcuuuuagacuaaugccaacuuuacaccuggacauuaaauaugccuuguucuaaacuuuagaaaagacugcuucuagguuacugauagcuuauuuuuguaaaugauuggcccauuauuuaaaacaauuuauaaguuauuauuccaguauaaauugccuccuuaauuuaugaguuguucccuucaucucagcaugaaauuuuauuuuugcuuauuaagacaagaaauauauuuagaauucuugcuuccuugaauacuguuuuucauacucgugacucucagagcuguuuccauaaucauaguauuuucuucugcauuaccuucuauguugaucucaacaauauuugaguacuuuuauuucuauacuaacuagauuuugauuucaguugaaaggauauucucuauggagugucuucuauuuauuuuauccugccuucuauuuauuuuauucaaauagaaauuauuuagaaaaauaaucacaauuccaguaacuaauuuaaaauguuguuauuacauaacauuauagugguaaaacuagaaacacuauuguaauauugauggagcuccuucaacaagcauuuauuuauagaaauguuuaaaugcuaagauauuuacuguaccucugacauuaugcccaaacuuuucauuaaaaaaaaagcaagcauauuuggucuacaucuauuaaucauuaauuuugcuaugaugagauaagcaacuuaacuuggguuuucugccuuuuaaaucuuuuuuauuauaaugaacuagaguucacuuuaucucauuuugcuaauuuacuuagaguuauacuuuuacaauauauuucucacuguuuuguaaauaaaaugucuuuugaaagauugcuggcccacaggaaaagaaccugcaaaaccaucugucuauucaucugucuccagguugaacuguauuaaaccuaaauaaacaacccuaaguucuuucaaaucagucagucgccuguuccacauaagacacucuaaaacaaacucugagaaacaaagaauaaagaaaguuucauucuaaagaaauugucuuuauucaugcaaacauaauuagcaaaugaguucuauauacauaugccagauauuagaaaaacugguacagaaugaagaucauaggccauuguuuuaugcguguauggaaguuuuauggaauaacaaaucuuugaaagaaaguuuagacuugaguagccuggaaggaggaggaauccccuucuacguggagggaagacaagggccugcauguuuaguuaagcacagaaugugguugugaaguaauaaaucagugaguuuagcuagagaagaaagucugcacacaggaaugaggaucacagcagacaguuguggaugcccaugccacagcccuuuccccuuucuuccugucgucacccugcucuugcucaaguaucuagccuccuucacguggccugugccuuuuagaaggggauacuauuucagucuccaaggaucaagaaggaaagagucaggcauccuaacaaagucauuaagcuguugcacauuguuaugcaaaauuuacaguccucuucuauagcaauagaauuuaugucuugacauagaaccccaccaguuacagacaauauuuuccaggcuuucuuuaaguuacauggcccuguggcuaaguugaaggcaauggaagugccaugugcaaugucuggaugaagcuccuaaaggggaaggauaugaacuauuucuccuuuuuuguccuucccaaucuucuuccagaaaugaaccugugauagugagaacuuucauucagugaaugaaaggaaaauaucuaaguaaucugagcuuuggguagcauacuagccccgggccaccuacccaaagguuuucaugacagagaaauauaauucuggauguuuuaagccacuguuauuuugggucuuuauuauaacaacaaauaggccaggcacuguggcucacaccuguaaucacagcacuuugggaggccgaggcagauggaucaccugaggucaggaguucaagaccagccugaccaacauggugaaaccucgucucuaauaaaaauacaaaaauuagcuggcugugguggugggugccuguagucccagcuacuugggagggugaggcaggagaaucacuugaacccgggaggcagagguugcagugagccgagaucaugucauugaaccccagccugggcaacagagcgaaacucccucccccaccacccaaaaaaaaagaaagaaagaaaaagaaaaaaacaacaaauauacauauccuaacuaaaauaggacugcaguuccucuacuuugauguggaccuauaucuugccuucuuauuaugacauaauacauuugguggcugcuauuauuuaagucauuuauguguugcguuauaugcagcugaaaaaacugaacugauagauguuaaauguacaaccauagguuggguucagauugcaaaauguauuaauuauuacauuagggauuuucuuggagaauguagcuuuguuuguucauucgacuuauauuuauugaguaccuacgguguaaacucugccauuugauuaugguuucuuaucaagaaguuaaauagcaggaaacaauauuucugggagauugugugaugauauacaguccauucacuguucaagggauuuuugaacuuuauccagaggcaaaauaaagccagccaucaagagaugcaccacggagauauauucucuucaccccuaauugaaugguuuuaacuagcuuuggcauuuagaacauuuuuuacuaggcauggaaagcacugaaagucuucaaaaaugaacuuacuugauaacuacauauuuaaaauauuaagguaguaauaggugcaggauagacaggaaagggaaaaacuaaaggcaaaauaaacucaacagcuauuuuaaugcuccaaguagaaaaucuuaaaaaccuggaguagaaugagaccacaagaaacccaaaaggauuaaagggguuacauuauuaauugauuacuuggagguaaauuaauuaagaugccucagauauucuguguguagaaaccagugauaaucaguggcauuuucaguuugagguuauacuuuuucuuauauaacaaggaaguuucaaaccugauagguuuugauagaaacucuuaaaaaaguaaauuuuaaauuuaaauucauaauuuguuuucucaaaauggguuaaauuuagaauaauuguaaacuauauuucuccccaaaaaaauauuuagccuuauuuccaucucaucucuuuuacuggaggaaaaaagaugacgauaacaaaaagauacaagaaauauugugccccaaaguaaauuuucugaaaugcacaggaauauguaacauacuuguuuuaaguaucaaguuugaguuaucugcuucacguccauagauacauuuuauuucaccacaaccugcuguaucuuuuuuuuuuuuuuuuuuuuaaaugacagagucucgcucugucacccaggccggagagcagugggaugaucucagcucaccgcaaccuccgccuccuagguucaagugauucuccugucucagccuccugaguagcugggauuacaggugccugccaccacaccuggcuaauuuuuguauuuuuaguagaaaacagauuuuugccauguuggccaggcuggucucgaacuccugacuucaagugauccaccagccuuggccucccaaagugcugggauuacaggcgugagccaccgcgccugaccaaccugguguaucuuugauuacacacugcaggggcagacuaggaaaaguuuauggguagccaugaacuaggagagagaguauauagugagauguagguagaaggaagaugagagauagagagaggaagcgagaaagacauccaagguaccuagauguugggagaauauaaccacaaacacuacuaacgggaaacuuaaaaagucaugaugaaaucuaaaauugauauaaaaaauaaacagaggugggcgcgguggcucacaccuguaaucccagcacuuugggaggcugaggugggcggaucaugaggucagcagauugagaccauccugguuaacacggugaaaccccaucucuacuaaaaauacaaaaaaguagcugggcaugguggcgggcgccuguagucccagcuacucgggaggcugaggcaggagaauggugugaacccaggaggaggagauugcagugagccgagaucgugccacugcacuccagccugggugacagagcgagacuccgucucaaaauaaauaaauaaauaaauaaaaauaaaaaauaaaaauaaacagaggcggggauauuauauucugaaauuaaagcuuaacagguaagauuaucgauaguagauaaaauauuuacuagacccacaguaaauauaaacuaauauugguguauuaaaauauagauagaucaauagaauagaauuaaaaauccagaaauaaauacaaagacuuauacaaauuagguuaacaguguuaagucaguggagaaagugcuuuacuuaguaaaugauguaagacaaucagcuaucaugugagaaaaagagugagaccuccuucuuccuuugccaaaauaaauuccagauagaugaaagauuuaaacguauguggcaauaaaacauaauaagguaugguggaauacuuuuuauaaacaacuaauauagagggccuuucuaaugaagacacaaauccaggaaccauuaauaaauuugacuacauauuuuuuuuuuaaaucuugagugaccaaacauagccaaauacaaagacaaauugguaagcauauuuuaauaugguagacaaaggaccauuuucuuuauccuaugaagaauacucaggaacuaauaagaaacaauauaauugaaauaugaguaaaggguuugaacagggcaguucacagaaaaaaaaacacauaacuuuuaaacauauagaaaauguucaacaucauucauaaucaaagcagcccaaauuaaauuucaaugagauucauugaacaucucucugauauuuaaugggaaaagccuucucaugcacuuuugaucagagugcacacuggagaacaauuugauaaagucuauuaauuucaaaugugcauauauugagaccuagucauuucaugucuaagaauuuaucuuauacacgcacuaguguacuuuccccaaaucauauuuaaaaauguuuauugcaucauuguuugugucagccaaaaaaucuagggaaaaauauuuauugguuagaaacuuaguaauaaauuaagggagucuguacaauguaaccccugacagccauuaaaaagacaacgcagaucuauguguacugauaagacacaaucucaaaaauauauugccaggggaagaaagcaagagggacagaacagcguuuauaauaugcuuccauuuguuuuaaaugacgauuguucuagcuguugugugaauagugaauugauuguggugaugcaugaaggucagaaaucuccauuuuccccuccaagaaucacucuucagcuuuccccucccugcccucagcuccauaaggcagaguacacugagagauccuaaacuucuccuugauugagcuuacccuaucagcagauuagaguggggagaagauuuaggucagguuaugcauuuuccugguucuuucuugugagacugccucagucagccuucaguaagaaagucacuucucuugucugcucugugcuacacuauauuauaaugauuuguuuuuauuuucaguguuuuugguugucacaagaaugucacuuguuuuucuuguuuuuuuuuucagacaaaaucucacucuuguuccccaggcuggagugcaauggugcgaucucagcucacugcaaccuccaccuccuggguucaagcaguucuccugccucagccuccugaguagcugggauuacagaugcccaacuaauuuuuauauuuuaaguagagacgggguuucaccauguuggccaggcuggucuugaacuccuugaccucaggugaucugcccaccuuggccucccaaaguguugggauuacaggcgugagccaccgugcccggccaagaaugucacacuuuuuaaaaaacuguggcucauuucaguucucaaacacaucugagcucucuaaucucugcaaccccaucauauccuugggcccaggguggugugagcucuauagcugccagcccuggauuccugcauuaucuguguaggucccuuuaucccuuguaauucaaccauuuguaaaaacaaaacuuuauuuuuuauuuuuuauuuuuauuuauuuuuuuuuagagacggaguuucguacuugucucccaggcugcagugcaguggugcgaucucggcucaccacaaccuccgccuccaagguucaaguaauucuccugccucagccucccuaguagcugggauuacaggcaugugccaccacgcccggcugauuuugaauuuuuaguagagacaggguuucuccauguuugucaggcuggucucaaacuccugaccucaggugaucugcccgccuuggccucccaaagugcugggauuacaggugugaaccaccgcacccgaauuuaaguggaucaguucuguccucuucagaaugugacugauaccacagaaauguagaaucaccuauauccauaucuaucuaucuacauaggcauaaauauucuuaucugugaauagaauauuucugaaaggaagacacuggaugcuguuacagugguuuccuuggagaggaccugaggugcagggaaaacuuauauuugaccauauucccuuucguauuauuaaaaauaaauuaaaccaaagguauucauuaucuugucaauuaaaacaaauuacuuacauuaaaaaaaaauucaggaagguaauuggacccucgacacaauuacacaaccagaacagaggaaacucucccggugcugccgcuauuugaaaggagcgucucugugggcaugagcucuguguccuaucuccucuggcuuugucaacccauucaacuuacacuuuuccagaauuaucaacuuuucuucugcauuacuucucucaauauguggucauuaauguuaccuaaaacaaaugacaaaacucucccuuucggccccauaacccucuccaguuccuaauuucccuaaucccuuucauagacaaacuccuugaaagauucacugaagcaagcucuuaacacuucagucaacuccaaccugaaauccacucucaucuguccacaaaagcuccuuuucucacaggcauucacaaccuccguuuucucagucuaugaacguauuugaacucacauuauugcccugaguugaucccuguuucuuccuggccccuccuuaacugccucaacucugaguucuggcauccuuagggcucagcccuuagcuuucucuaagaaggcucuaaacuuguaucucuaguugagacuuugagagccugaaacuuggacacuccaccugcuucuugauauaaucacuuagagguaucagaggcauugcugggugaauaugaucaaacauaucuuuggauguuauucucuaauuuugcuacuccucugcucacccucaucacaguucauggcaccaugaaaccagaagucauucuucacauuccuuucacuucugcaucaaucauuaacaaagcuuuguaaacagaaguuuggaaacuggcuccaaucuguccacuuuucugugucucugccacuccaguucaaccuccuaaccccacccaccccauuuugcagcuucuugacuagacugccccuuccaaaucuugccuugcuuuaauucauucucaauaaaauggcagacugaucuuucacaugucacgcuacuuuaaaaaucguuguugggcugagugugguggcucacgccuguaaucccagaacuuugggagguggaggucggugaaucacuugaagucaggaguuugagaccagccuggccaauguugugaaaccccaucucuacuaaaaauacaaaaauuagccaggcgugguggggcaugccuguaaucccagcuacacaggaggcuuacgcaggagaaucgcaugaaccugggaggcaaagguugcagugagccgagaucaugccacugcacuccagccugggcaacugagugagacucagucucaaaaaaaaaaaaaaaaaaaaaaaaaaggaaaaaaagaaaaacuucaauggauucuccuuucauuuaggaagaaaugagcucuuguauguuuuugcaugaucugcuaccugcuucuccacugcugccucaugcuccucuucuauagcauaacccacgaagaagcaaaacaagggcaggugucaacugaacacugagcagaaaagugugaggcugccuuugcacacaugcuucuuuuuuucaaauacacucuuuuccucaaucuuuacaaaaagaucuguauuuuuugguucuucccuuaaaugcaauuucccaaacguuucuccucugucuucccaaucugagguagucaccaccuucaucuacauuaccauuuguuguucucuuuaauuuaucaaacuuuuuaguucuauaccucucggguucauugucagucuuauucacugaccuguaauuuccaugagaguagggaacaugucuguuuccucaacacacuuuaucccuugccuagaauacugucuggcauugaguagguucucaagaaguaaugguugaagaaguucugaguaagugaauaucaauuaguuugaauaguuggaaauggcugucagaaccacuuuucuuuuuuuaaaauauuuuggcauauuugcuuuacaugaaauauuucaaggaaagucguagacacgacaauacuuaaacauacaucugcuaagaacaugauucuauauaauauucucaauaccacugccccacuuaaaauacuucccuaauuuaacaucaaguucuuauuucagauuuuuccaugugucucuuuuguaaauagcuacccucaucccccaaacaggauucauuuaagauucucacuuucuggaaauacuaggccuguugucuuguagaguuuuccuuuguagugucauuaauuuaacuucuaauaucccuuugaacuuccuguaaacugaaaggucuaaauuuuuuaaguuucagguuaaacuuuguaugcaagagugcaaggugaugcuauggucuccauauugcaucauacaguuauggcuuuuucaggcuguuaaguuuggacacuugguuaggucaucugacaggugauuaggcuuugucuccacuccucuacuccuaguaaaacucaccaaagauuuccacauuguuaaaucuaaucagcagccagcauuuaaccuugaagcacucuucaguuggcuugcaaauuucuacacuugcuugacauuucuccuuuacuggcugcuccuucucagucugucuuuugcugccggcucaaucuucauuucccugaauuuugauaaaacaucggugugcccccgagcucgaccuugggcugcuugccuccucucuuaguacucaucuuggugaucucaucucauuauaaggacaucagauuauauuaaccucuaaauuaccugcccuccaccccaccucaucugcaguuagguaucuacuagacaccucaaaauaaauaaauaaagcauauuuuugccucugaaauuuuucuucucagucguccucaaucacuuaauggccacuccauucuucuggcuuuucaggcagaaaugaucuuggacuccucacauccuucaucuaaucuuaccuaaaaucuuaccaucucuacugcuauuaccccaauccaagacacuaucauagcuaccaucucuacugcuguuacccuaauccaagacacuaucauagcuaccaucucuacugcuauuacccuaauccaagacgcuaucauagcuaccaucucuacugcuauuaccauaauccaagacgcuauuguagcuaccaucucuacugcuauuacucucauccaagacacuaucauagcuaccaucucuacugcuauuacccuaauccaagacacgaucauagcuaccaucucuacugcuauuacccuaauccaagacacuaccauagcuaccaucucuacugcuauuauucucauccaagacacuaucauagcaugcuuggauuauuucugugguuucccggcugguguuuauuuugccucaucugugucucuucucacccaaccuauucuacucucauagcaaccaggcugauccuuuaaaagucuaagucuuguuuagauggcuuccuaccugaguaaaagaaagcuuacaauggucuauggagcccuaaauuacaugcacuccaccccaccucauucaauuccuauugaauuccuccugcucacucugccuuguccacaacggccaucuuugcuauucuuccaguguagcuggccaugggaucuuugugacugcuagugucugccuagaaugcuuuucucccacaaaacuucauggauaauuuuuucaucacuuuugacuuugugcacaaaugccaucccaaugaggccugcucuaaucgcucuguuuaaaauugcagccugggccgggcucaguggcucacgccuguaaucccagcacuuugggaggccgaggagggcggaucacgaggucaggagaucgagaucauccuggcuaacacgaugaaaccccgucuccacuaaaaacacaaaaaauuagccaggcgugguggcgggcgccuguagucccagcuacucgggaggcugaggcaggagaaucgcuugaacccgggaggcggagcuugcagugagccgagaucgcgccacugcacuccagccugggcggcagagcgagacuuugucucacagaaaaaaaaaaaaaaaaaaaaaaaaaauugcagccugacauccuggugcucugcccugccguuucuuuguuuuacucccucugcuaaaaugcagugaaggcaugcaucuuuguucacuggcauacagugccuggcacaugcuugauauuuuuugaaugaauuucauccuacuucaauuagggguuuucagaucaguauuucauuaaaggaaagauuuaguaaagcagaauacuuccuuuguaagauacuuuuguagaguuuuuccugaauuacagaacggacacggaauugaacuggcauuucauaggcuggcuugaggguuuugugcuccauuaaugauuacugcaaaggagcuucauguuuuaauuuuauagcucuuuuguguauucacugugaaaauagggcaguuuuuggcugucacggcagcucaugccuguaaccccagcacuuugggaggcugagguggguggaucacuugagccugggaguucaagaccaaucuguccaacauggugaaaccccaucucuacuaaaaauacaaaaaucagccuggcgugauggcgcacuugggaagcugaggcuugcgaauggcuugaacccaggaggcggagguugcagugagcucagauugugucacugcauuccagccugggugaaagagugacacucugucuggggggaaaaaaaaaaaagaagaagaagaagaagaaaaaagaaaauaauaaggcaguuuccauccugcuacuuucuuacauaaucuuuaaguagugaggaaugucaaaguguuucagaaccauuuuucuaacauauuuguacacagaaacagagaaugucucaggcugcugacuuucaagugaguuuuagauuauuuaucccuuuucucucaaaucugucauacaauuugaggcuacuauaugaucucaugucuaaaauauaauuaugcaguaagucuaaucgucugacuaaaggauuuacauaaucucaucuaucagaaugcuauuucauuuauagaugaagaaaagacaauauuuaacauaagucccguuaccugcaaaauuacugaaggcuuuauauauagauacaacacuuagaaaagcaagaccaaacuuggagaaacccaauaguuaagcaaagauauauuuucacaaguuaaucaauauacaaguaauaucaaaaguauacaagaauaccaaagcuauacaagaaugaaaacaccauaaauuuguaaguauucuauuuuguuuucuuuuuuuugagacagggucuuucucagacuggacuguagugguucaaucauagcucacugaagccuuacacuccuagggucaagcaauccugccucagccucuuauauagcugaaacuauaggcacgugccacuacacccaacuaauuauauuuuuaaauuuuuuuuuuguagagauggggucucuauguugcccaggcuggccuugaacuccuggccucaagaaauccucccgccuuggccucccacaguucugggauuacagaugugaguucuguugcucaggcuggagugcagugcugugaucauagcauacuguaaccucaaacaccugggcucaagcaauccucccucuucagccuccugagaagcuaggacuacaggcaugcaucaccaugccuggcugauuuuuaaaauuuuuuuuagagacacauucuuacuauguuucccaggcuggugucaaacuucuggccuaaagcaauucucccaccuuggccucccagaguauuggguaacagguguagccacaaugcccagccacagcuguucuuucuuaaagaaauuacuaguaugaguaauuguuauuggauaauauaauaucgugucagucauuuacuuauuuguauuuaguggguauaagugcagaugucucacauccauauauggugaagucugagcuuuuaauguauccgucgcccaaauggugagcauuguacgcaacaggugaccuuucaauacuuccuccccgcaacauuuuggaggcucuaguaucuauuauuucacucugaguguccauguguacccgucauuuagcucuaacuuauaagugaguucaugugguauuugauuuucuguuuauuucacugacauuguauuuucuuaugagaauaauugaugaaaugauuuaaaggaagugacguuuucaauaaaaucaccaugaaagcaauaaauuauuuuaagguuuauucuuccgaaugccuacaaguaguuacaguuacuuaaauauagaacuguuuuaaguuuaacaaaauaggacaauuuacaaauauaacuauaucauuugaagugggaugucucuuuuaauggcuucaccauuuuuuacagcccugaaaucaaacugaaacauccccuuagauaagcaucauugcauucugcucucccaaauauucacuaaugaagaacaguugaaaugucuuauuuucagugugauuuugcuuaaaaaguaucaaacaugcugcaaucaguauucugaaaaauaaggagacacaaauggcuucuaaaagccuauauaagauacauuaacuuaaauaaaagauauucucccaaggcagaaguguguaauuaguaaauuauuauuauuauuauuuuugagauggaguuucacucuugucacccaggcuggagagcaauggcaugaucuuggcucacugcaaccucugccuccugggguucaagugauucuccugccucagccuccccaguagcugggauuacaggcacccgccaccaugcccagcuaauuuuuguauuuuuaguagagacggggguaucaccauguuggccaggcuggucucaaacucccgaccucaggcgaucagcccaccuuggccucccaaagugcugggauuacaggaaugagccacugcauaaauuuuuauuuucuaggaugcucagauguuggggaucagaaaacaauaucccaaaugaaggccucaguggcagucucagaagcaaaagauuuucucuguacuuuuccugcucuccugugucuagauccuauuaucccccaagguuagucauaaaaacuagaaucccucuuccccaaagugggucauagaaaccagaaccccuuuuccccaaagccagccauaaaaccuaaaaacaucacucuaauuuucccuccaccauucuguguaaaaacuggccauaagaaauuaucaauauacaauugauauauuguauauuguuugacuguaggucauaaaaccuccauuccagagaggguccuuccauacccugaaagaaggaaugcuguagagagaggccaagaagaacuuaggccuuguuggguuuccccacuaaaucuauuagcauuagaucaggcccuuuuuuccuucaaucauguuucuagauggcuguccacacuugguugaacguagacauuaaaaauggacaauuuccucuguaucuuuggccuuuauucuacaggcucccauguauaugcauuaaauacauuuguaugcuuuuucuccaauaugcuuuuugcaaguugauuuuucagugagcuuugagagggcccuuggcuccuauaguagauauaaauauggcaauguuuacauugagcuacacacacauuagauacaauuaacuuauuuaaaacguccauugaauauugacuuguauucagaagauaccauaagguuugccccaacucuuaaaaaggaaagguaaaaauaguaaccagggaagaacugcaccagggaagacauucaauuagcauaugauuugcugaauuaagucucccaugacuuuggggcacuggaugccuagaacuguccaaagacacauagacacguggaccaagauuuuaaaaacuggaauugaccccaucaagccagcggaucuaauaacuuuuuaaaugauacgggaaaaagaauuagcgucugcugaaauauuggugauacauuuguugauuuaugcuuaaauugagcaauuugccauuuagacauauaaaaaauguuucuaugucaguagccaagauaugaagucaaaucucccuaugagaacacaauuuaugcgcauaauauaaaaaauguuucuaugucaguagccaagauaugaagucaaaucucccuaugagaacacaauuuaugcgcauaaaaucuucagcaaagaccacugacaucacugcaauuuauaagagcuguagaugaugggaaaucucaaaugaaauauacauuuuuuccuuuuuaagcaaaauuuuagauucaaguuaugcaugugaagauuguuacauggguauauuguguaaugcugagguuugagcuucuauugaacccaucacccaaauaauaaauaaaguuuuccguagguaguuuuucaaccauguccucuugucucucugccccuccucccacucuuggaguccccagugucuacucuuucuaucuuuguguccacguauacccacuguuuagauuccaauuauaaaugagaacgugauauuuuucuguuucugcaugaauucacuuaggauaauaccuuccagcugcauccauguugcugcaaaggacaugauuuuacucuuuuuauggcugcauaguuuuucaugguguauauguaucacaucaaaugaaauacauaucaggagagaaucauuauaauugagccucuuggccaugaagauuguuuacacagucuuagacaucuaauguuauauucacuccuaugaauaugguugaagaucuuuuuauuuuuguuucagaccuuaagguaacagccuguuaaaaucacacugcuaugaaauugucaugaugcauguguguaugcuuuucuguugcuuuaaauuuuuaaauuguaaaauccacaucuguucacuucuccuggguucaaagaaaauucaaaccacugaaauggagugguaaaauuuagagcuagaaaaauuacagaacuccuuauuuaaugccuuuauuuuacagaugaagaaacuaaaaauuguggcaauuccaugauauuaagagugcucaaggucacauagcacauuugugacacagucaggacuugggcacaaacacgcacuuuuuuuuuuuuuuuuuuuuuuuuuagauggagucucacucugucacccaggcuggagugcaguggcgcgaucuuggcccacuguaaccuccaccucccggguucaagcaauucuccugccucagccucccguguagcugggaauacaggcaugcgucaccaggcccagcuaauuuuuuguauuuuuaguagagacaggguuucaccauguuagccuggauggucuugaucuccugaccuagugauccaccagccucagccucucaaagugcuggaauuacaagugugagccaccacacccugcccuaguacuuuuuaaugccacagaauugucauaaguuacaguggagaaucauagcugccaaucagagauccuuggaaagcacacaauauauacuuaaauaauucuuauucaccaauaaacaaacaagcacacacauauguauugucuuuaaacaauugggaugucuuuuggccagacacauucucucuaaugucuggcucuagcucuuuuuuuuuuuuuuuuuuuuuuaguaguggggccaaauagguauacuguguuuaugcagauuuuuaguauuuguagacugaagaaacugaaaugaaguuucugacauuacuuuuguagcugauccaaaauaaauauugugguaaacuauuuaaacaauuacuacuguuuuguuaugguccuugcuauuuuaccuaauuuccuggaaaaccugcuauuccguuuggaaggcaauguuuguuguaaauugagcuagcuagaaaucucucugugagaggccauuugugacagauacgguuugcaaaaaggcuguugauuuugccaaaaagugaagaaaagagaucuauguuacuggaguuggaggauuugaacauguuugaaagaaggcagggaguuaaguuuucugauccuucagaaggccaagagauauuggauuaauagguacaugacacaggguuuuguuuuaucucuauuuuacucucucuccaauuagauucuaaauuucugggggaggguuauugcuauaagaccugggucugcacgugagauauaguagaagcucaauaaauguguuuuaaugacugaguugaagaaaacaguuuaaggaacuucuccucaucuauuuuagauguucaagcccaaaaagaaucaaaaaaguucaagguuguaacauuuuuuuaaagcaucuguuuuuaauaguuccuucagagaugcacuuaauuauggccaaauauauuaaacagcuuuccaaaggucucacagcuugcuauugccauacaauucuaagauuaauauccuuaauccuugccuucuagccuucuucacacuuguuucuuuuucuguuaaaaaaugauagaggacccagggcacaaaucucaucucauaaaugucaacaaguagugggagauagaacuggugacuuacacgcuuacucuuucaucauaaucucaugcuuuguuuuaguaaagauggaacauaacccauuuaauaauguguuaauucaaauaaaacaguuuuaccauuuuguuauuuacagcacauucaaaacaaguguguucauaacuguuacuucucgauacacuuguuagaauauaguaucccacgugaacccgggaggcggagcuugcagugagccaagauugcgccacugcacuccagccugggugacagagcaagacuccaucucaaaaaaaccaacaaacaaacaaacaaaaaaucccauugauuacacaauauugucacuauuuaugugaauacucaacuaagcaagacuuuauagaaauaaaucauuucaaauguauucucguuuaaaggucuuaacucguuuauggaaguucugguuacuaugguauaugacaacugccuuuuucaucuguuuaugucccaacgucaauugcuaaacacuguuuuauuuguuuuuauauggaauuaaauguacugauaucuuuagggcuccauuugagaacauacauucaaaucaaaacaugaaauugacuguauaaguaaauuggcuaacguuaauaggggcuggaaaaugaaaugcuuucuagagaagguaucuuuaaggucuauugaagaaaccacuagugagaaguaagcaguacuuuacauucuuguuuauaaaugaaaaggguauuuauuggcugccuauuauguuucaugcacuguaugaagcacuggggacucuaagcaaauuuggcaaauuccgugcaaugcaggaaguguuuucguagacgcaugggcaggauacuguggggcauacaggguugcuauauauaugaugcuaucuaugguggugauggggaggcuuguccuucuggaaucucuuuagauguggugcuugagcugaguuugcaggguggaugaggguuaagaauaugaaaaggaacucugggucacgagagcagugugggcaaaauuagguauaaaggcuuuuagcagcaugguaaauuguguaugcagggaaucgacuauugcugaaacuuugaaaguaaaacugggagaggaaagagauguuuuaauuauuuuuauauaugacaaaugauaacauuaaauauuggaaagauauuguauuguucacauucuuauaaguuaacucuacauucacuuaaaugcugcuauuuucgaaugaggcacucaaucccuaauuuuaguuuuaaguuaagaaaucaagacugcaccaaugauucuacuguaguuccuguucuaugauagauaugcauauuauaaaauuguuacuauaaacucauuauucaauuauucuucaguucacuagaaacaaacaaacaaaaaacaugguaagucaaaacguagcuuuuuuucaagcccaggauaauuaaauuucagaaugcccccaaagcuggacuacuuucaagaaaagaauucaucucacaugaaaauaauuuuaaagaaaguaauaacaaugaaaaucgguuuuguuaacaagcacuugacuuuauaaauggucaugaaaugaugugccauguuuaauuacaaacaguucacuucuacagauuuauuaucuuacauaaaaaucgucugauugcccuucagaaaaauggauaggcaauaauuugauccugguuagaggaucuugauccuacuuuuauucucuucaaauuauuacagcauuagcauuuuuugaaaccauuuuuuuucucagcauuucauacaaccaaugaacuguuuguuuuuagggguuugugucucaguagcaaagaugcauuuccaaaccuaauuacugaaaucuaaacuugaguuuauuggcaaauauuuuguuauguauuuauuuauuuauguuagugucuauuguuuuugucauuacugugaagcaggccucacuuauaaauguuuucuuuucaagugucgugacagauuuccauauugcauauuauauauuaaaaagcaauugagagucuuuaacauuuuccuucucugugcaucuaggaaaucauucugguuugucaugauugagguuaacucaaaauauaccaucacgacacaacuucuucuccaccaaaaaaaguucuacucucccaaauaagucaauguauucggccaaacaauugacuaaguagaaagaucaaaauuacugcuugacuucccuaacuagaugcagaauacuauggucaacauucaauuccacagccccaugcacauccaaugucacugacagcugcaucagaugguaucuaaugguuaaugccaaggaaagucuuccacacaugugaauacucagcuauuaguauaggcaccaauuuccuuuaaaugaaacucacauagggaaauaaacugcaaaaaacaaagcaaaacugaagaaucuuuuugagaauaaugcaaacauaaacucuccucugauguggcaaaucugaccuaggugcauucaaagcccaauuuaaaaaugauuaacuucaaaauuaaaguuggcugagggggaagucuaaaccagaugguaaaacaaaaccaauuacggccaaauauauuaaacagcuuuccaaagcuguuuaagcaaagcaggauuucuuuauaaagucaauuuaugcagccacagauuugaugggagguaggggggcgagguagcacuucugcuuagacucagggaagagaugccuuuuacacaccuaauacaguuguguuaguagauaccagaacauguuugaauaggaaaaauggcagggaugauuuacccacaagcaccguacuguuuaagaggcauaguucuuaaaaggcauaauggacuccagcaauacgagucugcguauacauuuucuuuuggcagaugaaaugggguccuggccgcucucuguggagcagcaccgcagaccuauuuuuccucuucuuucuuuuuuuuuaaguucugggauacacgugcagaaagugcagguuuguuacauagguauacacaugccauggugguuugcuacacccaucaaccugucaucuacauuagguauuucuccuaaugcuauuccgccccuagcccaccauccccugacaggcccuggugugugauguuccccucccuguguccauguguucucaucguucaacucccacuuaugaaugagaacaugcgguguuugguuuccuguuucagaccuaccuauuucaucacagaucaguguccugggaacaagugauuuuccaggacagaaugcuaguuuccgacuguuucuguaacaaauuuccacaaacuuaguggcuuaccacaacacaauuuuauugucuuaaaauucuggaggccagaaguuucaaauguggaaguucuuguuggagagaaacuguuuccuugccuuuccaaccucgaaaggcagucugcauuccuuggcucauggcccauuuccucuauauucaagccagcaacguagcaucuucuuuccucucuauccuguuuugguccugguagucuuuucaucuccucuucauuucuaaccuuacugccucccucugaaaagugaucauauugagcucacccacauuuccaagauaaucucuaaaccucaagauccuuaauuuagucacaucugcaaagucucugcugucaugucaggugacauauucauagguuuggggauuaguacauucuggaaaccaccauucugucauagguaaagggcuacuuuucuagcaguauccagagugaaaucauagaacuggagguacaaggcagcuuucucagcuuucaagcagaauguggagagaggauaaaagaaaugcagaaauggaaugaccuacccgauggcugggcugucccacuaaccaaaugcaaauauuaaaaccaaaauuaaaauuaacuaaaauuaaauacaauuaaaauguaguuccuuaguuaguugcauuagccauauuuuaaguguucaacaaucauguguggcuagaggcuaccauauuggacagugcagauacagaauaucuccaucacugcugaaaauucuguuggguagcacuauuuagaguaauauucuggagauaauaaaccauaauauaguggcacagugguaaaaaaaaaaucaauuuccuuggcugaaugccaauggaauuucuuucucucuugauuucaugcaugugaaauacauaugagaaaugaagucaaaguguuuauauucaguucacaaaauauuuaugccagcuccauacuuuuaaaauucuguuugaauucauuuuggagaaaaauuuauguucguaaaaugaccuucauuucaagaaaaaguuaagcuauauugauacuaggaaaucuguuuucugggauaaaugagauuccgauuucucaaucuacauauuuuacaaaauauuauaagcucauucucuugacacugggcacagcaggagggagacuaucaggcagugcuuugcaaagguugccaugccaaggggaucuuccugcauguccgcuucucaucccucagcucauaacuagaggagcccuucaggucaagucugauaucaaagcccugguguaucuguaguagaacuuucuuaagugauaguucuucauuuucauuuucacugaugaaaggacaacaaguucauaaguuagagagaagcaacaugaaaguuauaucauguuaucaacacaguaucucaauaaguagacuuuugcuugugagucuaugcaucaagagcuugcaauuugauuaauuuugcaugaauuugggaugaaauuggacauaaggacaagugccaagagagauccacguuucuauuuauaacaccaaaaaauggaauaaaauuuacuguucaacacuaaacagguagauaaauaaaucacagcacauuugauauauuaugcagauuuucaaaacauuagaauucuugaugcacauaguaaccugaaaugcuuauguuuguuuuuucugauaguaccaauagagacaauauaucaauuauuauugauuaucaccauuauuuaauguuuaauaaagugaugaccucuuuccuagagugaaaaauccauaauaaaccauggagugcuuugaagcuuaacaaaugugagucugaaugaaaaggagaaauacccuaauacaaagagaaagagcuggaaacaggcaggaggagauguggccacccaaaacuaaucacugccucccuuuugaaaaaacuggucaacuucaagaauucaagaaagaucagauuuuuuuuuuguugauucauugaaaauaaacuauguagcauagauauugcuuaguauuuuuuaaagggaaaaugcucuaauuguuuuuucuuucuugaaauugucuugauuacaaaauaaaauauaauuguaagaacuuuguagaauacuguuucuagggcuugcucauucauuaauuuguucauucauuuauuuaaccaauaucucguggaugccuaucauauggcagauaacaguuucaggcucucagaaugcaacagcgaagggaauauaagaaaaacaggaaaaaaaaccucucauaucuugaacuuuguagucucacgacaggagauaaauuaugaacuaaauauacaguaagcgcuacagugggaaauacagcaagguucaggggauacagaacagugggagaugggcuuuucuggugauguggcauuugaccaagugaucagcgauguaggauauggcggaagaagaauuuccggcugagcguuacaacugcaaagaacccaaaauggaagcacauugagucgaaggaaaaugacauucuugaugucuggugagcuuuaauuuucaccuuccaacuuguaagugaugggaaaaaagcccagagaacuccuuuacaacuuccaacauuacuuuuucaucuguucuuuuucuuuguucucgcccuuuucaucuugccuuucucagcaugacacagugaaaugaaaggcauuuauauuuggcuuuuuggaauagacauaugagaacaaaggaaaauaucagaaaaaaaggaaaaguacugguccaguuaguuuugaauucauaucgaaggccugacuacuuuguaacuuuuaaaugauuuucaucaagagaugugaacuaguagaaacucuuaguggaauaguuauugaccacaauuucuauagcacuccuuuuacugguguuucuacacuuaucaccaaaugauuauacagaccuccugguuaacauucugucccugccuuaauugauuuacuucuuucuacaaauguuugauuccagccauuaauaugguugauccuuuuaaaugucuccuauuaucccguccauuccauuaacacugcugcuucaccuuuucagguucucaucgcauccugauuguauuuuuuuuccugugauuaauuuuucuaaaguaucuaguuguauuuuuuucugugauuaauuuuucuaaaguacugcuucacagcaacaaauuucccucuuccccaugcaagguucucuacugagauguuuccucuuuccuuucuucugagucacaaaaucucauuguucuaggcacacaucacacuugccccaccucuccaaugaaagaaaaaaaauugaaaaacuauuauuuggaauuaagguuaaaagguuuucugcucaccuucauaauaucuucaaaacuguuuguaauuacauguaggcuagugauuucuguauguuaaaguuaugcuugccaucuucuuaaauucucucuuucuauauacuaguuguuucauugauacuuuucaguuuucaaguaacuaauaauaucaucuguaagcagagguaguucuagcucugucuccccaaguuguaggccucuaauugcuuucuuugucauagaucuccaauauaauauuaaaucacaguaaaaacaguggguagcaccaucuuguucuaguggaaaggucucuaguguuuguccuuuaaggaagaugcuggcuaaauacugcuuuugauggagauauaaauggcuuuugaugaagauauaaacaaaacuauauauacaaauauagucauauacauacauacaaguacacucucauguuuacaaaggagucaucaauucaucaauucuuauguuacagaauguuuuuguuuuuguuaaauuacuaguauugaauuuugucugaugccuuuucaacaucucuggagauuaugauauugcuuuacucauuggcucuauuauuaugaugugaauuauacuauuagacuuccuaguguugaacggccuuggcuugcuagaagaaucuucacuugauggugugauaucauuuauaaugugguauucaauuuuauuuaguguuauuuuauugaagacuuucgauuggcacucuggugagaguggucugaguuguuguuauuguuguuguuuuguuuuuguuuuugcuuucuuuugguaaauucuuugccagauuuuucauugaugaaauuacuucacaaaaagaauggggaaaguuucccucuauuucuauucucuggaauaguuuacaucaagauuuuacuuuuuacucauaauguuauucuagcuuccaaagaguuauuuguuaauuuaauuuaaacugagaugaugaagacagaaauguagauguacaucuuagagaauggaaauuguaugagguuuugaaacugagugaucugaaaacaguaaauucuggcauuguuauuuauuaccuauguuaacucgagcaacuuacugaaguuuuuaaagucuuuguuuaccccuuauuaaauuggaguuauaauaacaaauauauuuuuaguaauaauuguaccuuuguucugcuagugaaaacauagauguggaaauuacuguuguauaucacuaauuccugauuucagaguuauucaaucuauaaaaagcugaagagagauuaaggaacgaaaaugaaaauaaaugaaauagaagcuuuggugaaucaagucuacuucuucaauauuaaauuccuucuacuuucagauaugguguacuuaguauuaaugaaaugggugaucagaaagucaaaguugaagacggggaagcauuucuaucacuagagaaaauuauuucccaagguccucagaagcauacaaaaugcaaguuuccauggggcauaccgccagcucuuacacaccaaaaguaagauuaaagaccaugauccugucaaaugggggagucaguuucucaaauggaauuuuaaaauacagauccucuacaaugagcacuggcagaccuaguguuauuaaaggucgucgggaucucuuuucuuaaaguugcagugcuggcagcuuuaucaugagcccugaccuuucaggaauaucugcugcaggacuuuuauuaaaauccuguucacuuuacucaugucagaaaaaaaaaaagagaaaggcuaaggcgucuugaagguuaaugggcucugggagacgccuucuuuuagacauuuucauguucaguuuauaaaccauucaaugcauugccugaugaaacagcaccaguucugcuuagauuuuaagcccuuaaguuaaauuuuauuguauccuugaaguuauagggcaaauacucggaaaucauagcucuguuggaaaacugucuuagcaauauuaauagauuugugauuuuggucaaauauaaaaugauauacugaauauauaucccaaacuguaauuauaagacaaaauaaagaaaaucacaaaauacuguauaauacaguagaaaagagcaaagucuuguaugaauaaugacaauuuauaaaacaagaggaaugcauaaccuuggcugaacacauaguuuacuuaaacucgacguccuauugcaaaauaaacaaaauauaagauuggaaaaccaacaaaaagccaccaaagaaaauuaauuccauguuugaacuagaaauguauggcaugggaaaauauuuuaacaaguguaaacuaaaguaagauuaaacagagagucagugcuuacuuagcauauaugggcaggaaacauuuauugaauuaauauaugaaagaacacaccaaaaauucacaaaucuuuaguugauguaaaacucuaugucuaaaacaaaugcaaaugcuuucaguuguagaauuuuuauuuuauuuuugccccaguuuuauaagccaguuccuauaaauaacaaauaagagaacauggcgcaucuuagguuucuguuucauaaauuaacacaaauuuucccuuucucauauagauacgugggaagaauacaauucucaaaaauucacaaugaaacagccacaauuuggccuuauuuccacuuaucauuuaaaaauacauuaaagaacuuuugguggcauuuucuuuuuuuuagcuuuuaaguuuggaguacaagugcagguuuguuacuuggauaaacuugugucaugggaguuuguuguacuuuaauucuuagaacuuauuauuucaauucuagaucucaucagugaaaacaaaagaauuauuuucaggcucacuuacacgaguguuacuguacaagucacuuaaauaaucugaauugagguuuauucucuuuugaaauguagaauauaacgccuaauucacaugguuaguugugagaacugaaugugauaauuuauagaauuauugaauaauuccugugaaccaagcccugugcaagaaucuaggaauacaaagugcugagaccauuuccugacucaaggagaucacaccguaauggggagaccaccuaucacuacagcaacagguacacaauaaugagaaaaguaucuaaugguaacuucacuugacucucugagacagcagaagucauagggaagcaggaaggccggugucucugauucuuccugaagcaccuggacuaggggaggcacuacuguuugaauguuuaacaaugaggagaaguuuaccaggaggaaaaggguugguauaaauaggcagcuaugagaccugcagaacauggcaugcuuaagacaacaaaucuuucaucuggcugaggagcaggcuuugccagcaggagaaagggaaaaagagggcaaggaguaugccugccuuccauuucucucccuuuucuacuuucucacaucuuccuucuuucccuuucucucuuuuucccuuucucuuuuuucuuccuuucucccuuucuguuucuacuucuucccuuccuccuuuccuucccccucccucccuuucuucucccucccucccauucuauuuuuucuaguuucucauuccuuuauauucuuugucugucuucuuuauuuucucccuucacucuguccccuuccuuuccacauuacucuacguuugucuuucuuuaccuucuaucuccauucuguaacauuucuugcauacuuacauaucaggcaguaagcuagggagaccugauccccaccauaaucuagcaauaucaauguaauguaaugacugauauauauauuagguuacaccaaaaggugaauucuuugcauaaauuauguuuaguaacacauccaauuagcagguacaacugccuuuuguaaaauuuagcaugaacuucuuuucauauguaaauauuaaaauauuuucuccuuauuacuuuuuauuaguacuacaccaggcugauuuauaggaaacauuuugaucugcuuguuuugaaauugugcuuuuaauuagauuuaaagaaaugcccuaggugguuuuagaaaucauuuacuaacaauguacauuauaugaaggucauuucucaucuauaaaacaagcaucaaaguucuaauuuuaaucacaguagaaccauaaacugugaaccugauuauacucugucaaggccagcuacuuuuugauauaaaauaaugauuucucuaagaugcaaucugaaaauacuaaggaguggcauguauaggacuuggacagaggaaguuugaaugucuaucugucugauauguguauucauauaaagauaguucuauguaauccuuuuuaggguuugucucuaauauuuguagucgaaagccuaucucaaaacacucaugucauuucauuauuuuucuacccaugaauuauacacuaucuuaguccauuucugcugcuauaacagaauaccugauucgggguaauuuguaauagauggaacuguauaggcucucagcucuggaaucugagaagugcaagaucaaggggccagcaucuggcaagggccuucuuguugccucuuccccuugcagaugguggaagagcaagagacggcaagaggucaccaaacuugcccugugucauagcacauauccuacccagcgggguggagcucuaaugacccagucacuuuuuaaagguuccaccuuuuaauauucuuacaauggcaauuaaauuucaaugugaguuuuuuuuuuuuuuuuggaagaaacaaacauucaaaucauagcaaccucuuuguaggaauacaaaggauucuuauccuagacuguuagggacugggaguuggguggggauaggcaagaaggugugggaguuaugaugggcagagcuguggcgucagaaaccacagguuucaauccuggguccaguauguuucuagcuacgugaucuugagaaaguuuucucugggcccuaguuguauuauuacucccacuguuucucccauccagcuucaguuugguaagucaaggcagggagggaguuugaauuaaagaaauagugacaaagugagcaguaagauaacuacaccaguugcuauguugucugaaauuugugaagcuuaagugcaaauuugguuccuuaagcauauauucuaugccaacgagauauuauuagugguauccaaaaaauagaaaaugugguucuuuuacucaagaaauucauagacuuguuaagaaauugacaaacauauccccgaagggcuguauccuuucagugucaaggagacucuauggcuccagacuagugggcucuuguuucuaugcagauuuuuuaguuguguucugcaaucauguaaggagacauuaauccagaguaguuuuuugccucaacaaaggacccguauauugacugucuuauauugacucuucccucagcacguugguagauaguggaagaaaugagauauuccagcugagggaagcauauuagccaaggcaaagaggcaggagcucugcauggccuggucaaagaacaguaagggucuggccuggauuuaauguggaguuguuucauccaugagugggauuacagaucuacugaugccaagugauguccuagguacugagaauauaaggaauuaauguccaguuuaauggaggugacagacaaauacauagaaaauuauaacaugacaaaugggagaacaaaugcaacaaaguauuagaggagcaucuuuauacaagaauaguaaaaauuuugguaggauaagaaacuuuggcuuauuaauuuacuggcaucuuaaagucaaaauaaagguuuugaauuuggucugaaacauugagaagacuuguagauuuuuacauagucaaauguuaagaugaauggagucauuuauaaaggcugaucugaugaauauggcuaggugggaagguaucuucuuuugcuauugcuguauaacaaauugccacaaacucaucagcuuaaaaccacacaaauuuauuaugucacaguuucuauaggucaggaguccaugugagcuuggcugaguucucagcuuagggucucauaaggcugaaaucaagguugguuaggguggguucucauuugaaggcacuggggaaaaacucucuugcaagguaauucagguugcuggaaaaauucaguucuuuauugcuguagcaugaggauaauguuuccuggcugaaugugagccagacagggccacuuucucuccuagaggcuccucauauugcaucucacauggauaucuccaacuucaagucaggaauggcauuugagugcuucucauauuucuaaucucuaugacuuucucuucuuccaccagugggaaaaaaacguucuuugcuuuuauagagugaugugauuacauucggcugauuuggauaaucugaaagucaguugugccauauacuauaacaugaucaugggagugauaucuugucauaaauacagguuuuggggaucaggacaggacacccuugguugggggauuuacaaauuuuugccuaccacagaagaauggggauugaagugagaaggaugucccgaagugguaaccacagaaaauaaagcaggcauaugggaaaucaauuggacauagaguuaaugugauuggcugacaaauugaauauugaggaaucaaagcuacaagggagaaaaaagcagagaauguuuguauuuucacaucugaauuucuaaaacaacuuuagaaucaaaaacaagaaacaugucaagucacuuguguagggaagaagaguuuccacugauaucccuagcuccauucuaagaauuagauucuuuuuuuuccaccuuaaaucaaacugacuggauguuuauaucuuagccuuuucaaccuuaaacaaauauuuuccuuauauaaagcuuuauugucuauguccuuaaucugagacuuccucugagaaauggcauuacugaauuugauuucuccaguccuugaaguguaagcugucuuccacuuuuaacuuuuagcuggauaauaucuuaucgucuacuucugagagaggaucagcuccgucuugccaggauaaccauuauagucaacucacugagcccaaggcaaagacacguugguuguagguugcccacggggauaaccuuggcagauuugcauagugaggccccacacuagaugagaacguugcuuguagccauucugaggaaucaaggaaugcaugaaaugacuccucagucaugcuuuugcauuuuauguucacauuucucuuugaaggaauugggcuaguuacagauagacugcaaaugucuaucacauuuugcacuuugcuaagauuucuuuuuguagguaauuuaaauagccagagaacauuugaugugguuacccuuucaauagguauaugaguguuuuacacaguaaaugauuuaucuugccuguccauuaggauucucugcuuugugaaaaccaaaggaaaagugccuuugguuaaagauauuucugguucauuagcuucuuagagcauuauaaaauauuaguguuuucaugauuuagaacuauuugcaaaaagaugcuuaggguucuuuuuuauucaaagaguuuauuuauugaggccuuauguauauaaaaauuauacaaguagcaauaggggaaauuaacauaacaauagauuacaauaaaauaagucacccaagguugccaacuauguagacagagagcuaaacccuaaagcaauuuuaaaaaagcaauuuaacuuuauuuuuauaacauaaauuuucauaaguauaaauuuucagauaguauacuaccuugaguuauuucaugaugccucuccccgucccuauuauguuguguauauguauaugaccuaaaauaugaaaauauuuccucuauuauuagaacacuuuuuauuuagcaucauagauacuauuuaaaaggagaucaggaaccaauauuuuugucaauugcuugccauauacuuguucaguauuucuaguaaaauuuacugauacuaaacaaugggggugcauauauauauauauauauauacacacacacacauauuugguuuguuuuuacuuagcacugauuaauguuuauguagcacccaacucuaaagcaagaagaaugucucagaauucucuagaaucuuaugcagauagauaaucuggggaaaaaauacugcuaacauuuuaaaaaucucucuaguuauaaauuuaaaaauuuaauuuggaaaucuuaauugacucuaaucuagcacucuccagauaauuccucuucaacauuguguuuuuaagauuaaaaacuacaaacauuaaaagaauauuuuuacauuuucagaaacagagggaagaugaggaaaauauaaauacuauauaucacuuuucauuugcaaggucaccaccauuaauuuaauuguuaaucaguugugucauugaauucuagugugauuuaauggcaaagggcaucgauugaaauccauuguauuauaaauuguuaccuucuuauauuuuaggagcuaugcaugaucaugaaccaauugagagggccuccaacacaauaauuugccuauaaaaauuguuuauguuaaaagugcuuuaucauauuugaguagugggaaacaauuuuuguaaugaaacuugaauuaggacuuucuugauacuagccauauuuauaauuuaauuuccauaaugccucauuaacacaaguguguacauauacuauauauacuauauauauuuauuuacauauauucauuguagaauauuaagaaaagaaaaauuguaaagaaggcagcaaaaauuaccccaaauaggcugggugcaguggcucaugccuguaaucccagcacuuugggagcccaaggcaggcagaucacgugagguccagaguuugaggccagccuggccaacauguugaaaccucgucucuacuaaaauuacagaaaaaauuagcugggcuugguggcgcgcgccuguaguccuagcuacuuggggaggcugagacaggagaauugcuugaacccaggaggcggagguugcagugagccacgauugugccaccgcacuccagccugggugacagagggagacuccaucucaaaacaaaccagcaaguaaacauaaccccaaauacuauaaccuuaaauauugaagucacuguaaauauuuugguguguuuuucuaucuucuuuucuaaguauguuccuaaacaaauacauaucuauauacaaacauacauauguauauguaaguagaucuauauauucacauguagagcauguacacaagagcaugcagguggaagcuauuuacgcaugcauucucuaaaacuuucugaaaucuguccacuugugugcaucuacuagcuccaucaugguugaaauaagcgccccuuaucuaguucacagcugaaucugucucuucugaaucucuucuucauauagaagucauaguaauuaaaaaaaauaaaaaucugauuguacuacuuuccuucuuuaaugccuuuucuuggcauucuaaugcacuuggaauaaaauggaaaauauuaccauagucugcaaggcuuugugaaaugcagccucugccaucucuucauccauaaaccauccuaguccucucuuuaacucuucuuuagucacacugaccuugauuuucuuaucagacacccuaaaauucuuuuaaccuaacaugcuacuucuuuauguggaaagcauaagauguaucuucuauuauaauuaauguccagagaaaauauaacauuuuaaacuuugcccauagcugauuuuguacucaccauaagucccuaccagcugaugugaagagaaauaauuuaacugaauacucacuguauguuaaagcuuagucuaauucaauaauguaaacagucucuugaggugguguucuugggaaaaguugugucucuucuaauuguaaggaagauacaacaguuagguccucucgcagucgugguuguaaacaguggaaaacuuggauaugggucucaggucuucaacuucuugaaccucagucuacuacuaacuccauuauugaugauguggacaaaucaaaugucauuacuuauggccccagauaacccaaaaauauuguuucaaaccagcaaccacuuucagugauacacuuaaggacucucccagcuaaaagcaagaagaaauugauccuauuucauuucgauucauuucauuugcaggaaaccuuaacauaagcaauggcauaaguggaauuaaaaaggauguuaggaaggaagagugccaccuuggaaucuaggaaacaaaacaugauagcucaaaaguuagugagggguggggggaggagagaggaggccgacagugagagcaacagcaagagagagacauacagagacucacagguuaaaaaaaaaaaaaaaaaagaaagaaacaaagagcaagugugucuugcccugauccuugugcaacugacaucuuguggacuguucugugaugguaugcagguguagggugguaggcgauuuaucagagucuucagaucccaaauaaaacaucuccuacaaccacucagaaccuuugaucacucuuuaaauuuucuccauaguagaaucaucuuaaaauuaaugaggaggcugagccaggaugaucacuugagcccacgaagucaaggcuacccugagccauguucaugccacugcacucuagccugagugacagagcaagaccccgucuccaaaaagaaagaagaaagagaaagaaagaagaaaaagagagaaagaaggaaagaaacauagauagacuaaugcagcuucucaguuauuuugguaucaugaacagaguauucugaaaggagaauaaaauaauucuggacccacuuaaauguauuuuucauaagcuaauaaaucagcauaugccuguugagaauguuaauaaaacuaagaaugacaacuaacauuuguuaaguacuuugugucaagcaguguucuaacaccuuuauccucaaaacagugcuaaguacauuuauuuuuguccacaacaaccaacaaggaaacugaggcaggguauucuaauaugucuaacccacauaaaauaccaugugaaaauaaaauuucuagauccacaauuuugggaucaaaucuguaauguggcgcccuaaccaagugaauccuaccuguaaaggcucuuuaugaaccacuagaauguucuagcauuauugucucacuguuucauaggaaauauuuuuuaaauuaaugcuaaaauuccaaaguaaaagaugaaaggaagcaccaccaucuguuauaauaacuuuaaaucauccauaaagcaggagggcaccugucccugcugagaggacagaucagguuaacauucggcuagucaucugauaugguuugacuuuguguccuugcccaaaucucauguugaauuuuaaucccauaguugggggagggauguggugggaggugauuggaucaugggggcggauucuucucuugcuguuccccugauagaguucucaagagaucugguuguuugaaagcauguagcacaucccccuucacucuuucucucuccuuccaccaugugaagacgugcuuguuucccuuuuacccuuccaccaugauuauaaguuuccugaggccucccagcuaugcuuccuguacagccuguggaacugugagucaauuaaaccucuucauaaauuacccagucucaaguaguucuuuauagcagugugauaacggacuaauacaucauccuuuacuuucacucacuuuccauaccugugcuuuccuccugcacuugcuaucucccugguuccucuuuggcucuugcccaauaauuccucucaucucauuggcauggaguuuuuuggaacauauuuauugucaauaaucuaugcagagcaaccccuucagagaaccuguaauuccaacaaccuaaaaaaauaaaauuuagugguuuuaauuucacucuuagugacuaaggggaaugaugcuaguaaaaaaaaaaaaaaaaagaaaauuuaauuagacuaaaagaaauacguuaugaaauuucuaaagcaaacaaaauuuuucuuauauaaaauacuaaagaauauaauguaagcuuuagaauucucuagccauuuuaugaaauauuuucacugauuuccauuuuugaggauagguguuuacagaaaauuauuuuaaaccuaugccaaaaggcuggcaacuuguuuuaucucaucuugggcuucauuuuguugaucucuuguguucucaaauugccacgggcuuuggccaguuguuacacaguuuuucuuuguuggaaaagcgauaagguuaaugacugcuauguuuuccuaaccauguuccuaaucuagcaauuuugccccuuaaaggguaaaauagauucacuaucaacauauaaauaauaauuucccagggaccuucaaacagaugauuaaugcccuugccuuugggugucuguucuuuuaagugacugauaggaacaaaaccaagaccauacaaaaaccuuuuuacugggaauagaaaaugugaauggugcauaggagacugagauccaaagaagaaugaaagcaaaccaaacucaggaaucaguagcaaacaaauguagcuggcaaauuucuacgucuuggaggagauaaucuuccugaaauagaaucacagccaguugcuuugcuaacaaauaacugcaguguuuauuugaacacuguauuuggauuaugcucuuuuuaauguuuuaggauugguaaaugugaaauugcauauuaaaggaaacauaaagucacaaacauaucucuacacacacuuacccaugucuggaaggccuauacagaaauuuaaugcuuaaaauguugccauaugcuggaaugcuagaaucuaaaaagagcuaaaaaaauguuacaaauuagagggcagagcaagaagccucuaccgaucaucccccuacuaggacaccgauuuaacaacuaucuacagagagaagcacuuuccuaaggaccaaaaaccaaaugaacacucgcagugcuggauuuuaacuuccuauuauugaaagagucacucagaaggagaaaaaaaaauaguccuuacuugccuauucaggacuauugccacuaauugccaugacgacaccccuccaccaccugcaggcaguggcagcaugggugaggagagcauuuccaugugcugaggagagagacagcgugcagcaauuucagucauuggacucagugguguccuguuauagcagaaaggaaaaccagaucaaacuccgcugacacccacccauggagggaccauuuaaaccagcauuagccagaggggaaucacugaucccaguggucagugcuugaguucccacaagccucacuacugcuggcuaaagugcccugaggcccggcccuaaauaaucuugaaaggcaguauaggccaugaagaccgcaacuccuaaguccuagugcugaacugggcccaaacccagcugacugggggugaggguggggcacacaaccuccugagaugcuauccaggguggcuaaaggagugcuugcaccaccucuccccuaauuccaggcuguacaacuaacugcuccaaaagagaccccuuuucucugcuugaggacaggagacagaagacuggagaagauuucguuuugccucuuggauagcagcucuucuauagcaggauagggcagcagucagagucaugaggcccccuuuccaggcccuaccugcaagauaacauuucuagacauacccugggccagagagcaaccuucucauucgaaggaaaugacccaguccugacaggauuuauucacccugguaacugaaguguccuugggcucaaauaaccagcagcaauaccugguacuacacugagggccuugggugagauucacacuugcuggcuucaggugagacucagcacuuuuccagcuaugauggcuauggggugagacuucugcuuaagaaaggcagagggaaaagcaaaggggauuucaucuugcaucuuagguaccagcucagccacaggagaguagggcacaaaaugggcucuuggagucccuaauuccagcacuuggcuccuggaugaaauuucuaaacauuuccagggucagaggggagcccacuucccugaaggaugagucccaaaccaggcagcauucaccacaagcugacuuaagaguccuuggaccucaauggaacauuuuugguaggcuggaaguauucacugaggaccuguaguggcaguggccaugagcugaggcuccuuugccuuuggaaaggggagagaagagugggaaggacuguaucuugugguuugagugccagcucagcugcaggacaaaagaggacaaaguagacauuuaaguuuguugacucuagucccuggcucacagacagcacaucugaacccacccagggccuaggggaacuugcaacccugaagugaaggacacaguccuagaugguuuugcccccugcugagucccagggccuugaggaaacauaggcaguagccagagagugauuacaacagaugcugcguaggacccagugcugugcuggcuucagguccaccuaguggugguugccauaggggugcuuacgucauuccacucccagcuccacguggcucagaacagagagagacggagggagggagggagggagggagggagggagagagagagagagagagagagagagagagagagagaaagagacuacauuugguuggaagaaaguaagggaagagaacaagaguguccaucugauaauccagagaauucgcccaggucuucuuuaagacgaucaagaugaaucuguaugagucugcaagaaccauaguguuacuggggugcucccuaaauaaggaacagcuuagaucacagcacccaaguaauuucaaauaccuggaaagccuucccaagaaggacggguacaaacaagccaauacugcaaaaacuacaauaaauaccuaauuccucaaugcccagacacaaaugaacaucuacagguaucaagacaauccagaaaaagaugaccucaccaaaugaacuaaacaaggaaucaggaaccaacccuggagaaacagagauaugugaccuuucagacagauaauucacaaauagccguuuugaggaaacucaaagaaauucaagauaacacagagaaggaauucagaauucuaucagauaaauuuaacaacaagauugagauaauuaaaaaguuaagcagaaauucuggagcugaaaaaugcaacugacauacugaagaaugcaucagaguccuuuaauagcugaauugaucaagcagaagaaagaaugagcuuaaaaacaggcuguuugaaaauacacggaggagacaaaagaaaacaaaaagaauaaagcaugcauauagaaucuagaaaguagccucaaaagggcaaaucuaagacuuauuggccuuaaauacaagguagagaaauagacagggguagaggguuuauucaaagacacaauaaaagaaaaauuuccaagccuaaagaaagauauuaauauccaaguacaagaagauuaucgaacaacaagcagauuuaaccuaaagaagacuacuucaaggcuuuuaauaaucaaacuccaaaagcucaaggauaaagaaaggauccuaaaagcagcaagagaaaagaaacaaauaacaugcaacggagcuccaauaccuuugagagcagacauuuuauuggaaaacuuacaggccagaagagagucguaugacauauuugaagugcuaaaggaaaaaaccuucacucuagaaugguauaucuggugaaaauauccuucgaacgugaagaagaaauaaagauuuuucccagacaaacaaaagcugagggauuucaucaauaccagaucuguccugcaagaaaugcuaaagggaguucuucaaucagaaagaaaagaauguuaaugagcaauaagaaaucaccaagagguacaaaacucacuaguaaguacacagaaaaauagaauauaacaugguaaccaugauguauaaacuacuuuuaucuuaacuagaaagacuaaaugauaaaccaaucaaaaauaauaacuacaacuacuuuugaagacauaugguacagugugauauaaauagaaacaacaaauaguuaaaaaccaggggacgaaauuaggguguagagcuuuuauuaguuuuccuuuugcuugcuuguuuaugcaaaugauguuaaguuguuaucagcuuaaaauaaugggcuauaagauaguauuugcaagucucauuauaaccagaaguaaaaaaacacacaacagauacacagaaaauaaaaaacaagaaacuaaauuauauaaucagagaaaaucacccucacuaaaaggaagacaggaaggaaacaaggaagagaagaccacaaaacaacaacaaaaaagaaagaacaaaauggcaggaguaagucuuuacuuaccaauaauaacauugaauauaaauguacuaaacucuccaaugaaaagaaguggcugaauggaugaaaaaagaggacccaaugaucuguugccacauuucaccuauaaagacacauguagacugaaaaugaagggauggaaaaagauauuccacgccacuggaaaccaaaacaaaaguaggaguuacgauucuuauaccagacaacauagauuucaagauuaaaacuauaagaaacaaaggucauucuauaaugauaaaggggucaauucagcaagaggauauaacaauuuuaaauauauaugcacccaacauuggagcacccagauauauaaagcaaauauuauuagagcuaaagagagagguaguccccaguacaauaacagcuggagauuucaacaccccacguucagaauuggacagaucuuucagagagaaaaucaacaaaggaacaucagacuuaauauauacuauagaccaaauggaucuaauaaauauuuacagaacauuucauccaacggcuacagaauguacauucuuuuuuucagaccaugaauaauucucaaggauugaccauauguuaggucacaaaacaaggcucacaacauuaaaaaaauugaaauaauauccagcaucuuuucuaaccacaauggaauaaaacuagaaauuaaugacaagagcaauuuuggaaacuauacaaaugcaugguuaaacaauaugcuccugaauaaccagugggucaauaaaaaaauuaagaaaauuggaauuuuucugaagcaaaugaugauggaaacacaacauaccaaaaccuaugguauaugacaaaagcaguacuaagaggaaaguucauagcuauaagugccuacaucaaaaaauaagaaaaacuucaaauaaacaaccuaacaaugcaucuuaaagaacuggaaaagcaggaacaaaccaaacacaagauuaguaguagaaaaucaaugguaaaaaucaaagcagaaauaaauaagauugaaaugaagaaaacaauacaaaagaccaaugaaauaaaaaguugguuuuuugaaaaguuaaacaaaauuggcaaacuuuuagccagacuacagaaaaagagagaagaugcaaauaaauaaaaucaggaugaaaaaggagacauuauaacuaauaccacagaaauucaaaggauuaucaguggcuacuaugagcaacuauaugucaauaaauuggaaaaaucuagggaaaaaaauggacaaauucccagacacauacaaccuacugagauugaaccacaaauaaauucaaaaccugaacagacuaguaacaaguaaugaaacugaagcauaauaaaaagucucccaguaaaaaaagcccgggacuugauggcuucacugcugaauucuaccaaauauguaaugaagaacuaguagcaguccuacucaaacuauucuaaaaaauagaggaagagagaaauaguuccaaaaucacuguaucaugccaguauuacccugauuccaaaaccagacaaagacacaugaaaaaaauaaaacuacaggccaauaucacucauaaaaauugaugcaaaaauccugaauaauagcaaaccaaaaaaaaaauaauucaccaugacuaagggggauuuaucccugagaugcagggaugauucaacauaugcaaaucaaugugauacaucauaucaacagaaugaaggccaaaaccguauaaucauuucaacugaugcugaaaaauuaucugauacaauucagcauuccuuuuaugauaaaaacucucaaaaacuggggauagaaggaacauaucucagcauaaugaaagccauauaugacaaacccacagcuagcaucauauugaauggggaaaaacugaaagccuuuccucugagaucuguaacaugacgaaguugcucauuuucaccacuauuauuuaauguaguaauggaaguccuagauaaaacaaucagacaaaagaaagagauaaacggcauucaaauuggaauggaagaagucaaauuauccuuguuuucagauaguaugaucuuauauuuggaaaaaccuaaagacugcacacaaaaaaacuauuagaacugauaaauuauguaaaguugcaggaaacaaaaucaacauuaaaaauuaguaccauuucuauaugccaacaaugaucaaucuuaaggaaaugaaagaucucuauaaugaaaaguauaaaacacgaaagaaauugaauaggacaccauaaaauggaaaguauucaauuuuuauggauuggaagaaucaauauuguuaaaauguccauacuacccaaagcaaucuacagauucaaugcaauucuuaucaaaacaucaauggcauucuuuacagaaauagaaaaauaucuuaacauuuguauggaaccacaaaaauacccagaauagccagagcuauccugagcaagauaacaaaauuggaggaaucaccugacuuuaaauuauacuacagagcuauaguaaccaaaauggccugguacuggcauucaaguggacaaacagaucaauggaauagaauucagaaaccaaaaacaaauuuauacaccuacuaugaaauguuggacaaagaugccaagaaccuacacuggaaaaaagacauucuggaauauuagaaucuaaaaagagcugaaaggaauguuacaaauaaagaaaauucccuaaaauaaaauaaagcaaaagucauuuggcccauaugguuaaaggacaggguuuagcuagauggacuuucagaaaaagcucuaugcagcccagugucauaaauugggccucacaguauacuugcaaguaacaucaaacuacauacuuuccaauuucacacugucuccucuuuauuucauuccaccucauuaucauaaauguaggaauuagauauucacaguauaucagcaaucccucugguguuggcuucuuuccaaguguguccaggccacauacuaguuccgugauuaaaacuaugugaaaaccaaguguucaccgagaccaagauggccuuagcaguucccucagcuggacuaaacuuuauacaggcuuccuccugacucuaggucccuaacuucccuuucuuaaagcauuuacuuuagaaaacaaguaauugaaacucuuucuuugcccgauugagauguaaaccuuuuuuuaaagcuucuugucaguuuuaaaacccuggaauguuuuccuuaagcacccaggagccaucacuuugaaauaaaagcauuaaagggauacagucuacaccugagugugggugggagccuaacuucaaagagccuugcucuaaguuguaaaacuaccuccugucaugaagauaggagaaaauuuacuucaucuguggguaaagccaauuagcaagcacaaauggccuacacagauucucccaucccagcucuuaaaaacucuucaucccuuuguuucaguggaguugagcucaggcugaguuacagccucucucuucuguuacaauaguuuugaauaaagccucucuugccuauguaacuuugcccaguguaauguuugcuuugaccagguguauucugaguuuaucuuguaauuuucacacucaucugcuuuuuguuuucuuauuguuuuuuagucuguuuauucccuuuugaaauaaguggauuuucucaggccauauuauaguuagccaugauuuucauaacucugauauaacaucaaauuaaaaauuuuuaacugaaauuuaaaauuucuggaauaaauuuauuuaauuauauuucuugaaccaaacaagaaugacaaaaauaacaacaaaaacuucuuguugauguuuuucaagagagaagguucccuggcuaguuaauaaggguaucuaaccuaauugguauaugugauguugcuuuaggaagaauaaacuauucagcggcuuaauuaaauaaugaaauaagaccucuuuauucuucuaguagcuuauaaucuuauuucaguugcccagguggggcuccucuguaggaugaagcuggagagggccccaugacuacucuggcaccauuguuguuuacguuuaaaugauaaauugggauauuugaauggucacaugaaacuuuuaaauccuuauaagguuuaacuauccaaaaaauaaaagaaaugaaaaacaaaaccacuguaauaagaaauaaggaguaaaaagagagauaaguuuuauuacauacuuauaauuugccaggcacuuucuccaaugcauuauguguguuauuuugaaaauccuaauagcaauacuagcaauaggugcuauuauuccuauucuacagaugaagacaccauggcccuaagaauauaaauaccugccucaaaaugacacaauuaauaaauggcagagcuuggauuugauaaccuaggaaggagcucggcaccacacccaacguguuuaacuguuucacaacaguagcgucuaggcuugcagccuauaaacauuagaaauuagaacauuggauggaauaaggcaaauuauacaaaacuaccuaaaauggccaggucuccaauaacagccuugcuaagucacaaacauucuuguguaugaagaaauguuuuugucugcuucuugcugcaauccauggauauauagucucagauccuaaugccuaaggcagugauucuccaaguguggucaguaucaccugguuauauguaagacggggaaaauucuccuacucuagcaaucaagcccuccuggugagucuaggcuugcucaaguuccagaaucaccggucuaaggugaaucuuggcagagauccuuaccucugcugcugugauggcucucgugcaguuauuaucuuaauaauacccugcaaugauuuguagauuuccaaccugcagugggcucuacucauuuauugugacaaaacuuauagggacucugccuuuucugagcacaauuuggucuucaagaccaagaaaguuacauuucaaaaucuuggcauuuccuguguuacccagagcaggguuuguacaaaaugcuuccuucagaucucuguguuguaugaaucaauauaacgaucgccauuuuucacuguccuguugccucaaauucagaaaauaaagcuacugaggaaaucuguaugaauuuggugcacccccaccucaacccucacacacaaauaccugaaccacaggaaagacaaaagaugauguguggcaugagaguugaaacagaggccaagucuuuuagguuacugccacagucuaaagaggaggaagaggagucugggcagcauagucugcacagcuuagucugcgcagcauagcagaccauggcgaacuuacuuaaagugcugugacuuccaagaggagcaggugcuccauguacaacuaaagcuacagaacacuaaagaaaccacuuaacuuacuuuuaguccacucuuuuagauaagcaaaaccagcuuucauaccugguugucagcaucucaucaacauaggcaaaucaauuauaugcagaacaagacuauccuuaauuguauuuguuuaaaguccauauacaauuaauacauguagacggaagauauuaugagccuuuaaauauuauucuugauuucuuuuuccuucggaaaagugcuagacaauucuaucucucuauauacaaauuagaagggaguguucaaacaguaaaaugaaauagauacauaauuaauucaauaucuugguagacaauauuucaauuuugauuuugaaauaauccuggagaggccuuuagaaauacacuacaaacgugaggaaaauaggguuuuugaguggucacacacuagguccuauuuucauauaucuacuuuaaacugaagaauagaaaucaacauaauuauuaacuggaaugguacaauauuuucucaagauauuaaucucagcaauugugguacagaauacuacaacuauuagcaaauagagugcauaaccuugaacaggaaacccaguugaauaggcaucaagaacauauuucuucacuuucuaugcucaguucuaaccuugcaggcucugugacauucaguaagccucaacaaagcuccuucauuuuuuuuccuauuaagcuuggauuauuuuagaggacugauaagguauuuauacaaaguagaaaaagcuucugaauacuuuaaaaugcauguauuauuuaaaaggacaacaaagcacugcuauuuuaauauauacuaauuucauuguucuaagacaucugaacaugucaaaauuuugucauuguuccuaccaaggucauacaacaagacauaucaaagaaaauaaguuccuuuucgauuuugauauuuugacuuucuuuuagacauucacagaguuccagguaguaacauagcucugucuacccacaggcaguuugaaaacacccacaggcacucauuuuuuuguaguucguaggacacggaggagaaaccuuguucacaacaaauuuugauugaucugaaaauaugaaaauccuaaaauagguggaaaauuucauagguaacauuacauuccaauauaaaauucacaacuuguccuccucagucaucaacacuuuugccugaaaggucucuuuuuuauugauuuacaaagcaaauaugagucuucacucuuaucaccaagaaguugucccagagugcccugcagauaacaguccuuucuucucaagauccaaaaguaaagcaaacacgcugugaccaaaugaacuacuauagauugucuacaacuuuaucccaacuccaaucaguuucaggcagaauuuucaauugaaaauccaugucauauugugagguagagaaaaauaauaaugcauuuaucgccuaaacaaauuugucuuaaaaugaaugcaaauuauucgcccacggaacuuaacaacucugaaaaaauaguauuuuagaggaugaugguugaagauuuaaaaauuaugauauaaaagaggcgucacgacacaggggaaagauucagcacucugcggauggccacuauaacaaggacauuuuuuagugcaaugcugauuucaaauguccugugcugcuggugagccagguagcaguccuugugccugauuaucuaccuuucuguuuugaaaugaaucauacaugucacugccaggcaccaguguuuuagagcuuauguguuacauccuuguuaaaggcuauugggugugauaaauauucaaauaaccaugcgaaugcauauuuaaucauaaacuuagguaagugccagugaaggaaagcagcacagcucuaagagugcaugaaaaccuaaagggcuuugggguuuaggaaaggccucuguagggaggugaugucugggcuguguuugcaggaugaagggggguuaagugaaaugggcaggauguuccagaaagaacacugggugacacuggaugacaggaggagcauaugauuucaaaaaacacugugacugugguugggagauuaggaggaugagaggagagaaauuguguggaaauaugcuggaacuaucagcaagguccaaaugggguuucuuggugcucacuggacaaaucuuugcugggcaaauuuugugaagcauauuuuagauaaccaaugagacucacaacauguagcuaaugugggaaguagugauauugauaaauaauacuuaaugucauacacuuugggcauacaacugaacuaauaauuuccuugguagaaaacuucagcaugauuucuauuuuuuaaaaaacacagcuuugucucuuaucuuccuucuaaagcugcgauucucaguaagggcugauuuggccuccuuaucccucccaagagcuauuuggcaaugucuggacacaauuugcuugucacaacuggagggggugcuaugccaucuaguggguauaggccaggaaugcucaccaaacaucucacaaugcacagagacccccacagcaggaaauuauguagcucaaaaugucaauagggcugagguuaagaaacucgguucuaaaguguuuuaacaauuuaaagaguuuuccauggucucuugaccuaaugcacaagauagauauuugugaauuuuccuacacagaaaacaaggggcgcaggucagauuucaggauauaagaaaugggaaaugcauuugagaugcauguuaaacaaacccagauauacugaaaggcaagucuucacugggaauuaaauuugggaguuuuuagaguacucagaaaucaaauccauggaagaaguuaaagaacaaagagaaagugcuuagugcagagccuucaggaacuucuaauugccaacuagguaaaggagaauaagccuagaaaaggaaauuagcaggggcaggcagaacucaaaaagauagagaaaaacaagagugggaugucauggaaaccaacauaagaaauuguuucaagaaagauaaacugauuuacagugccaaacauaucccagagaaaaaaacaaggagaggacugaaaagucuauuuuauuaagagacauggcggucauuagugaccuuuguggagggcugucuugguugagugauggaggugaaagccagauuggagcgguccaggauuaaguggcaguguggagcuagagacaacucuuguacaagucuuuauuguaaagagaagcagagguuguaggggcacaugugugaaaucaagauuaauaugggacagacucaaguauguuuaaaggcugauggcagugauuugguuugaagcuagcagugcaauauacagggaaaaguuuauaguuuaaaguuucucagaagcuauuaaagggacagguuccaaaagagauagagagacaccaucucuauugucacaggagggaaagaauaagaaaauuuauugauuguuuuacauggaauucauuaaagguuugugaccagauauguaagaagaaauauuuaucaaauaaaagaaaaaugagaagugguugacauuaaucacuuuucaauugcucaaaccaaccuaaucaugaauucaacaagccagucauaccauaugaccugcgcuucuccuaaccuucuguugcccaugcuguucccuucaucccauguaucuuuuuuuuuuuuuuugagauggagucucacucugucgcccagccuggagugcaggaggggcgugaucucggcuuacugcaagcuccgccucucagguucacgccauucuccugccucagccucccgaguagcugagacuaggcccggcuaauuuuuuguauuuucaguagagacggugucucacuguguuagccaggauggucucgaucuccugaccucgugauccacccacuuuggccucccaaagugcugcgguuacaggugugagccacugugcccggcuccuucaacccauguaucuuaccuacucugaguucucugggaauguuucucugcacccuauaaugcucccuccuccucuguguccuaguuggacucaucauaauguacuguaauuauuucuuuacuguuuaauugcugcacuagacuaugaucuccuucagggcaugcucacaucacauguagagcacugguggguggugccuggcaaagacaguugauaaacacuugcugaggggauuaguuuuccucuuuauuuuucagguaaacaucuucccauuggauugcuagcuuguacuggcaaaagauauaugcacauguaccucugagaauacuuuugaauaaccucuuagaauacagguuucucuaaguaucuucacugaacagauggguuaauccugagaugguuagaaaaaccaguuaaauaggaauucugcuaacuaaaagccaaaauuuuguaaucaagccaauuaacugggucauuaucaaaucucuuucuuccuaggcugugaccucauagaaggcagaaacuucuucuagcuaaauauauaaugcauuugucaaaauguuuacuuagaaaauaauuguauuuggcucauggugaguugagagggaaaaugggaugagaacacaagaauaaauagauucauguuucugacaccaaauaucuauuuccugcuuugacaucuagcauauacaacuaagucaaacaauccuaaaauuaauaugaaaccaaaaaagaccccacauagccaaagcaagacuaagcaaaaagaacaaauauggaagcaucacauuacccaacuucaaacuauacuacaaggcuauaguuaccaaaacagcaagguacugguauaaaaacaaggauguacaccaauggaacagaauagagaacccagaaaaaaagccaaauauuuacagccaacugaucuuugaccaagcugacaaaaacauaaaguggggagaggauaccuuauuaaacaaauggugcuggaaaaauugguaagccauauauagaaaaaugaaacuggauccucaucucucacuuuauacaaaaaucaacucaagauggaucaaagacuuuaagaugugaaacgauaaaaauucuagaagauaacaucagaaaaaacucuucuagacauagcuuaggcaaaaagaucaugaccaagaaccaaaagcaaaugcaacaaaaacaaagauaaacaaaugggaucuaauuaaacuaaaaagcuuuugcacagcaaaagaaauuaucagcagaguaaauagacaacccacagagugggagaaaagcuucacaaacaaugcaucugacagaaccuacaaggaacucaaaucaacaagaaaaaaacaaauaaucucaucaaaaaguggacuaaggacaugaauacacaauucucaaaagaagauauacaaauggccaacaaauauaugaaaacuugcucaauaucacuaauuaucagggaaaugcauaccaaaaccacaauaauauaccaccuuacuccugcaagaauggccauaauuuaaaaaaaucaaaaaaugacaaucugcaauugcaaaaauaaggaagacuaaauauccauugaccaacaaguggauaaacaaaaugugguguauauauauauauauauauacacaaacacacaccauggaauacuacucagacauacaaaugaaugaaauaauggcauucacagaaaucuggauggagauggaggccaacauucuaaguaaaguaauucuggaauagaaaaaucaaacauuguauauucucacuuauaaacaggagcuaagcuaugaggaugcaaagacuuaagaauauuauaaugggcuuuggagaaucgggaaagagugggagggggaugagagagaaaaaacuacacacuggguguacuguacucugcucaggugauaggugcacauaaaugucagaaauuaccccuaaauaucuuuuccauguaaccaaacaccaccuguucccaaaaaacuacugaaauaaaacaacagcaacaaaaucacaaccuuagaagagcagguauuacaaaaguaggacauaaaacacagggggauucuuccucuugucuccuuaucuuucuaaagcaugaaucuguuuuaagugaauaauggaaguuccaaaagcagagaauccaacuuauaaauacacucuaaauccuauguaaaagaaagugguaacuuccguagaacaaacugaauaauaaacaacaauuaagcuucagaagaaaggucaacuauaaauugaauccuccauucuaggguagaagacaguagcaaucuaauucaaugcaauuuauguaacgcuaauuguauugccaauuuuaaucauuaaaugagaaguaugagaugaaagaaaagugugagagagggccuucaucuuacacugucuagaugaaaaaugaagauaucaaauaacaauacaaaguaguuuuauuacuaacugaaaaaaaaggcugcaaaguuaguaagggcaaagucauuuagcaaauauuuauugaguagguuauaaggcucaagccuuaggcaaagugcugaggauucauuguagguuugaguauucugagaagucuucaugaggagguaaacugaagcuagacuauuugugauugccucaauuuccccaguucaucauucauccaaugacaaaucaagcuguacuguuacugauuaguauuucuuuuaauaugagccaacuaaaucuacauuuacuuugauuuauuuguacuauucuuugcaacugaaauuuucacguuugaaagauaauguuacuauuuuuuuaauuuaacugaaaccuaaaauuuaaaaauuugccagauuuuccuugccuuauacccuuucuuuuagcauucuuuucuaagauuuacauauuuagguuugcauauaaacaguaaaagccaucauaaacaaacaguugggguaugucuaaugcagcuuuaacauuguccucuuuugaagucccaaaaaagauaaagguugauugccuggagcccucuuggaaaaugaauaacaggcagagagugcauguaccugcauuuguaaaugguaaaagcaucucugaaaaauaucuauuuuuaguuaguacuucucuucauguacuucauuguggcugccguucaauucucucaguuuucaaugugaauaugauguaguuuauguacuccuuguuguguucccuauugguuaucuacccacuaaaacacccaaucucugacuuaacauucaaaaacucuccaugacgggggccuccugguuuuauuucuacauuuuauccaaacuauuguuaaacuuucucacauaucuccaugcucagucaccguugccucuguuugcucugauaagaaucauauuguucaaugaccuuaucuuaucucuaucuguugaaagaacccauauucaauaaagccauuccacauacuuccagguaagacugauuucuguuuugcagugguuugaaugaugguggcuucuccaaaauucauguugaaacuuaauccccaaugcaacuguauuaagaagugugacuuuugggaagugauuacagcaugagggcccugaaugggacuaacauccuuauaaaaggguucaagaauacauggaacacucucuuucuccaggccauccuuuucaccaugugaggagacugcauucuucuccucugaaggauguagcaaugaggcaccaucuuggaagaagagcaauccccaucagacaccaauccugcuggugccucgauuuuggacuucccauccuccagaaccaugauaaauauauuucuauuguuuauaaauuaccuagucugugguauuuuguuauaacaacacaaauggacugagacaguugauuaucaaaaaccaccuggcaauacaucuauuugugaugauuuuuaugucacuuauauuuacaggaugaguauaagaguauucauccauccauccauccauccauccaacaaaaacuaauuuauucccuaaaaaucuaucacaaacuuuuccccaggugagacacugaagacauagugguaaacaaagcagauucauucccagaucuuuuaaaaccugacagauuaaugagggaggcagacauucugugaacaagaaaaaucacagauguuuuagauuaaaaugcuaugccuuuggagccaucacuuuuuaacauauuuucuguucuauucaugacauuaagcacagaaauuuaucuugauggaccuaguugugcaggauacauuagaaaaaguacaaacuccuagaauagaaauugaaagaaaucuuugcucgguggaaaggaauuauuaaacauuuugacugccagcugauuugaaacuucaaguacagcuccugagauccacggucagagaagucauguucaagaguuuuauaaugaucauauccaaugacaaauguucuggauauccaugauacaaacaaacacacacaccaaagaagcacuuaguuggucugugacuugaaguuuuaauaaugaaaucacaacugaguaagguaaaagcaacucuauaaaagauaauuaggaccaaugaauauuuacagauaagauuucuauuuaggcucuuuuuuauuuaaaaaaauaaaaaagcacauuuggccagcuuaaagguaaaguacacccucccuguguacacaucgucacauauucagcccuauuacugacugauacagaaucuugguuuacaggcauagaauucugcucaagauaaaauuaccauuuacaaauuacugauuuuuuaaucucuaaaucuuaaauucaugggaaaugacauagaacuauacaacauauccuuauaagauuucuacaauaaaaugaauuuauagauuagcauuuucagucaauuaacauugaaguuuuugagcuuuaaaauucuguuuaacguuagaauaaaugaaguaugcaucagaagcuucagauggaaauaccguguuaaacugagaaucagaacaaaaucaaguaacacaugaucaaaucaauaggaaaauacaucuucaauuaacaaugcugacaagaaguucaaaaaaauucaucucuucgauauuuuccauuuacccuuccuuggguauauggacgaaggauucaguagaagcauucuuuaucaacagauacaaaaaugagaauuguuaucagagaaagauccagaaguuagguagccauauuaaauuccacauggcuugguuugacaaugggguggagagcaaauagaugauugugagguugggcuggaugcuagaucagggaguuucuaaagauauuuauggaauauuuugucucugcacuuugggguuuuucaggagaguugagugaguuuucuuacaggauuuaaaaaaaauaauuacauauaaaccagcuguaacaugaaggagcagucuuucuuuaccacaaugagagaggcuguaaguaaagcaccaugguaauauugcaaauacaacuuaaauccucucuauuuuucauaccuaccuagcuaauuccaauccugaacagugauuuuuuuuuuuuuaaaggcaauggucauuguguggaacaagaaggagaauaacaauuuuuuuuuuuugucguuuagaaacacuucuauugaacaugcauuauucucaucaucugaaaacgaaaacaauuucuaaaaaaaaaaaaaauuccacuugcaaaaccuuuggcuuuuacauugaaugggauggggaugaaaacaucucauugaaauguaucacucuggcugcugugcuaaaauuagaccauggggacagggcaugggugaaagcaggaagaucaacuggaagguuauugcagcaguccauccaacagguggccuagaaguggauacaauggagaugaagauaaaugacuggauucuggguauaaauugaggguagagccauuccugauagguuggacuggaugugaaggucaaaaggaagagugaaagaugaagcuaagguuuuugguuugagugaauagaugaauggaguugacauuuacuugcauggagaaaacugagagagaaacauuuauuuuuaaugguaguuugguauuagaaacaaagaguuugagauguuuguuagacugugcugacugggagcaggcaguuguguguaaggucuaaaacucaauagaggauauagcuagagagauaagucaacauacagauggaauauggaacuugaaugagaucuccuagggaguagguguagacaggaagcaguauaaguccaaggacugaaaccuggggcucuccacuguuuggaaaugagaaaaucgaggagacaucuaaaugagaaggaacaguagguuuaguaggaggagaagcaagagagagagagaaauacuaagaaaacuacaagaaaauguuucaagaaagacggaaugauuuguaucaaaugcugcugaagguaaggauugggaauuuuccacuagauuuagcagcaugcagauugcugaugacuugacagggacugauaugguggggaugaaagucuuuuugaaauagguucaaaaagaaugaggcaaaagaaagugaaagcaaugaugauuguuacuuuaaaagagaacaagaaaauaaguagguauuuuaaacaacuaggaaauguaauuggcugaagaagaaauggguagauugaagguauugggggagaggaggaaauggagcagcggaaugaaguaggauugcaacaccagggucccacugaagguuaggagcuaugaauuuaaagugagaccaaucagcauaggugugugguuuuccccagccacauucuuccauucuuccccccagggagaugcugaagcacaaguuucacuuaaucagcauugcuguuuuucugagcaaguguuaggaaagagagaggagcaaagaaaucaaaggugauugcaagggagucauaaugauagaaugugggacuaaagcuaaguggaagggaagugagcacaugagugaacaagacauagauguaacuuuuguuaacagugaauuuagagagcugcaggaaaugagaagcacaauuauggaguaguuguaguuaaugauuauguugaguuccaggagaugaucuuggaacugagugauuaagacaugcuggaggaugguaucaauggaggagggccaauauuucagagauagguucauugaaagaauggucuacauggauauugaaaacuccaaagaauacuacaagaggguuauuggaucauggagcagugaaccaggcauuaaaaucugcaaggaugaggaggugaugggccaagggucuauacauuuccauagagaggagguuuagugaauuguuuauuccuugaagauacacacaguggacaaaugguuuuggaaccacuucaaaaauguaaguaguguguacucuauaauuaugaagauuauucaaggucuguucaucauauuaagcauuuuaaucagguuuuucuuugggcauauaaauuacugcauggccgauuccaugauccuugaaacaaacaucagcuagcuaaccuaacuuaauuaagagacaccuauaaauuaaauucuaugacuuucauaacaacuacagguauuucacaagaaccuaauuuagggaauuagggaaagaacuuuaaggguggacagaaugugccuuuuauuuuucaucaugugucuugcaauuaaaagaaguccuuauaucuccaccuguuguauaggacacuuagagccuggugguggucggccugcaaagucuuagcaacugcuauucaguuccagcaucuguucacacuucuugacuggucagaaaaguagcucgaucauucauuaucuacaauugauuucuuacaaagaaguuaaaauuuuguuguuguuuuuuucuuuugccaacuuguaugcaguaaaguuauauauaaaaaauuaucauuagauauuugcaauuggaaaauuuggcuccaaagcaauaauaacaaaguauuuugugagcuuaaaaauauguucaaguauuuaaaggguuuugaaaaacuacauuuacuacaaauauaaugccacaggagguaacucugauauguuuaccacauccauuucagugaacuuaaaauugauccucgauguaaagaagguauccauacuaaaguacgauuaaguuuaguuaauuaucugugacuauuuucugcuuagaugguaucaguauuaaugauccuccugaacuaucccuucaguguguaaaagaacuuaauugaagacauugcaucugucaggaucuaaacagggucuaaacaccccaggaaugaggcauaggcuuauuugcuucauuauggaaugauuauaaauuuaggauaauagcagaguaaaaaauugcauaagggaauuuaaauauuaugaauuauauaaucaguaguuacacauauaucagauuacauauauaguauguauauauacauacacaauguauauaccguauauauacacauacauaguguauaaauucaggguagagccauggcugagaggacuggauguguggaugaauauaugcucaguguguguguauauauacaguauauauuguguguaugaguauacuauauacacacuauauauacaguauauauauuguguauauauacauacuauauaguguauauauacauacuauauauauacuguauauauacauacuauauauauauacuguauauauacauacuauauauauauauacuguauauauacuguaguuacacacacacacacuauuaggccauucucgaauugcuauaaagaaaugccuaagacuugguaauuuauucagaaaagagauuuaauuggcucacggucuauaggcuguacaagaaacauguugacggcaucugcucaacuucuggggagguuucaaggagcuuuacuuauggaaaaaggccaagagggagcaagcaucucacagggcaagaaugggagcaggagagagaguugagggggcagugccacacaccucuaaaugaccaggucucaagugaacacagagugagagcucauucauuaccaagggaauggcccuagccauugacaagggauccacccccgugacccaaacaccuccuaccaggccccauugauaacauuuuaacaugagauuuggguggggaaaaauauccaaacuauaucaauaucuauagauguauauaucuuuauguauauauaucucagcauacacacacacacacacacacacacacacagauuagauagacauaccaggacauaucagaucccuagauauuuuaauaauauuaaauauauauuuuauuuguguaauuuagauaauguggauaaauacauuaguuaauuguauuuguauuuuaacauuuuaaaauagaauggaugcugugacuauuuugaaugaauaaaagugcuguuaauccuccaauguaacauuucuacauggaaagaaacucuacaaugucuaccaucuauuaauauuuuucuaucaaauuauaucacagcaguaguuucuauuucucuaauuucaauauuuuuauauauauauggcugaguuacuagcagaaacgugguuauuagaaaauccucucaguggaaaugaacuuuuaaaauaacauuuuacaugaugcuaaacacugcuuuucagaacaccuacucauuuguuagcugcuaaaauaacaaugagacaguaauagcuuaauucaaaacagugauaauauguaaugcauaaaggucaaacccaaacucuuugaauagagauuucaucuauguuccuuuuaaguguguuucuguacuucagggauaagcuuuuuuugugaagacugcauugcaauacuuuucaagaauuacuucuuuaugauccuccuuuggaggugaacaucaaaaagaaaacacuccuuaaccuccuucuuugucaaaaauuuuguauucuccgaggacuagauuacaaacauugacacaauuucagaguccuccccuagaaacucauguccacagcuggguucugcaguuagaaugguugguuacuuucagaaauuauuaauauaacauuaauacagaguaaaauuaaugacaaguauuuuuuaaugucaauccuacaccauauaaaaucacuaacugaaugcaacguuaguauuucauaauuucuuuaaaaaaaucuauuuauuuaaaugaauuuuuugagggaguaacuuucaaauaugcaacccugccuuggugcuggcaaggggaugcuaccuguugcagaaagugacagaaugaaaucauaaaugugaucuuuugcuguaucaaauaccauggcacuuuuucugacccucaauaaauaucauucaaugaauacauuaauuauuuggaaauacuuggggagcaauguugaacacaucccaucucuaaccucauuuugcucuucuguuucauuccucaugacagcacugcaauauuuaaugaaaauaauuaacuuuaaugucaccaauugugguacucaagauguacuuuuuugguauucagaacaccaaauaauacuuuaaaaauuauaccuaauaccuuagaaugacugggugcugcuggaggaaauauuuuuuaugacaccucaauagagauggcauuucaacauaugacccucuccguaugcuggacuuacaguaagugcaaauuauugcucucauuucuaacaguauacauuuggcaaauggugcaauuuauaaucuuagaaaguguauuccauuagcaaguuucuguuuuuguuuuuuguaccuugucccaauaguuaacaaugaaauuauucacaaagauuaacucguggcccugugugucuaguggaaucucugccucuaagcuuuauuugauaagaugucugggucgggaaggaaauuugacugcugcuagugauccacccagcacagcaaguggcauagcaaagacucaagaaauaccuaaugacacccagauuagagaguuuuggagagaucacaaucuauaacuauucuagaacuuugagucugaauacauccugcagacucaugugcuucuuggaucaaaucugggaccagaucaagaagaauuauuuucaaauuugaugcaguaauguugguaauauacuaagccaacaccuacaaaaacacugguagauaaucuaaaugggaaacuccagcugagauguaugcuaacccuguaagaaagcuuccaagaaacuggaagccaaaauuuaagcucaggcacaggaaauauuguaacuucugccuucuuuuucccuuggucucagucuucaaucauaauuguaaagaggcaauuuauaaaugaaauuauuaaauaaaaauaaggcaucuugcuagacaguaugaugugauguagaacauagagcucauuuuuuuguucuuuuuaauauuccaaauaaauaucaagaacauaauuucuccuauacuccuagccauauaucuucaucuuuguuguugaauauaaggcccacacagcuaaaaaugcugccaggaggcuuugguggugggaaugagagggcaagcagggacuccuguggugccaagcuccagcuugaaagcaacagggaacuugccugcaggcuggaagacagcagggcaggcagggcauagagagaagagaggaaggccuggauucuccucccugggaaacaaacauucacucugaaaccguacacuucaguggcucuuacugacuugcuuauaucauauuucaugugguggcuauggauucaaccuuugaaugcucauugaaauuuuuuuggcauuggaaaucuuucuucauagauuauauugguuuuauuuuuaggaagcaugcuuugaaccacaguauuucugaguccguuuaauaaugaguacguucaccacugaguucagcagaauuuucauucuuuaucagacacaguggucaugaaaguuucuuuagacuuuguuccccggugagaauaaagcuggugcuucgaggcuugaagacauuaccuaaagcuuuuuacuuaccucuagauucuauccuaacuugcaguaaaguagaccguuguuaaauuugucccacuuucuuuuauagagaaagugacuuuuguccuuugaauaagcuguauugauuauuaauagauggcaugggauaagcccauuugccagucaauuguuugaaaaucagaccauauuuuuccuuuugccauagcaacaugcuauaauauaagugaacuuguuucccaagccuaauccuaauuacgacucacugucccucauuuuuagacuaucauuacucuggggaaacacauuugcaauuuuacauuagggugcaggaaaauuuuuccccacuaagugauagccucaaaaauaauaaauuguguaagaugaacaagcccagacauucuuggugugacuuuauuuguucucuucauaucgaugucuauauaauaaaagggauaccguggcuuauguguucugaaauggagaauaaaggucaauuucagaagucagaaucagaacuuucccaguccuguugacacagaucauucuuccauuaagggcucacacaccaggaaccaccugcucaguaaaagcugugcuuucauuuccuuuaugaacaacaaaaaccaccagaaaucaaacuuuuugacuuuccaucaaugaaucuuuuauuguagaaauuuucaggauggguuuaagaagaauauuauucacuuagaaaauaaguaaguaccauagaacuaugcuuuccaucgcuuuguaaaacaguggguauuggcauauaauuguuauuguaugauuguacuauuauguaguuauaaaugacuuuuacagaacaaaggaaagaaauuaccuagagaaacaugaauuaacucuuauuucacuauguuacuaauugacuucccuuauucaucaaaccaguuugauagcaaauguuuuauaauaauugcgugaacuuuuaugcaaacuuuaaauggaacucuuaaaaaacuuucucuagauuuuaauuaaucucaaauauuuaauacacuuuugcauaacuuaagcaauggcuuaucuuucuuucuugccuggggcuccuugagcuuuaauuaguaugcagcauaucuuauaaaauuuugguguugcuuuuaaggaacaauaauuuugauccauuuaaacucaccaucaucagauacggguuccauacaauaauaauuacauugcuaaaggaaagaauaaaaaugagaaaaggaaaggaaguuuuccaaaacuaaaauuuaacguuuucuuuguagacguucucuaaugugcaaaaggugaauguuagagacugaauguuuauguccccgccaaaauucauauauugaaacccaauccccagugugaugguauuaggagauggggcuuuuaggagggccccacuuucacgaauaggauuaaugcuguuauuuaaaaaaagaaauuccagagagcuccuuugccugccuagcaugugagaacacugcaagaagauggccauccaugaccugggaagcaagccuucaccagaugccagaucugccagcgcuuucaacucaggcuucccagccuccacaacugcgagaaauaaauuucuaucguuuaugagcuagucuaugguauucuguuauagcagccuggauaaacuaaaacaaugaguuauaauauucuaagccucugugauacauaaccgugguugagaugauacagucaaaaggcaaagaugauaaugaauaugcagcauaaaauugaaucuuuuuuuuuuuuuuuuugagaccagagucuugcucugucgcuuaggcuggagugcaguggcgcaaucucggcucacugcaaccucugccucuuggguucaagcaauucugcugccucagccuccugaguagcugggauuauaggugcacaccacuaugccaggcuaauuuuuguauuuuuaguagagaugggguuucaccauguuggccagucuggucucaaacuccugaacucaggugaucugccugccuuggccucccaaagugcuaggauuacugagccacugcacacggccucuaaaauuaaaucuuaugcagauguccuaauacugguccuacugguaucugcaaggcaggaaaauggauacaggucuucagagaagaacagcagcccucccauccagccccagaggcugguuuauggcugggcacuugaccuagcagccgaaccauauguugaugagcaacauauuacuagauucuggagauaaaagauaaaucgagccaacgaauuuccuuucuuaaauuugaaauaagauaugaaaacaguuggccauucugaaacaaaggggacuguggagggaucucaggacaaaauauggggcacugugaacacuggaguuguauugguucugaugguuucggcuguaaaccaaaaacccaacuaagucugcacucacaaaaaaaggaacuuuauuggcucaauguggaguuggguguagacuugauccaguggcuugacagccaccaagauugugguuuauuucucuuucugauuguguucuccacuuugucuucaguccaaggccaagcugcucaugaucacgcaugaguuucaggcuguguggccuuaaucaugggaauguucuugaaauagucccuguggccacagguugagaaacugauuguaauugaagacaaaucaacuucucugaacccaaacagaaaacagaggcugauggaaagaaauagggugugaaucacccacaggaagucauugcugagaaaguaagcaacauaugcccaucacagaauuuauaagacugcaaaaacuauaagcagagaaauucaguugguuugggauuaaaggaaacagauaagugcaauacagcucagauauuuuaaugcagggcguuuggguggagauccaugaaugcauaccuuuaaagcucuauugaaucaagaaguuucucuaguauaagccacaggagggcucacacuuauuagguaaggugaccaugcaccuuggccuguccgguguagaaucaguucacacuuguuacacuccuuccaugauuaaaaaaggcccgguuuaacggcaaaugauauggucauucaaugguuaugcucccuuguuaugaauuuucacauuuuuuuuccuaaucauuccauguguagcuuuacaaguuguucuuacuugguguauugguccauuuuuuuacugcuauaaaaaacuaccugagacuggguaauuuauaaaggaaagagguguaauugacucacaguucagcauggcuagggagaccucaggaaacacaaucauggccgaaggugaaggggaagcaaggcacuuucuucagaaggcggcaggaaggagaagugaugagugaaagaagaagagccgcuuaaaaagucaucagaucucgugagagcucacuaucaagaacagcaugggggaaaccaugcccaugauucaauuaccuccaccuggucucucccuugacacguggggauuauggggaugacaauucaagaugagauuuggguagggacacaaagccuaaccuuaucaauuggacuagcuugaacugaucucuguagaagacaugucuauuagaaagaaauuucaaauuaaguggaaggcagggcagcacccuuuaauaagacagaccaaggugggagaauaagggugagagcucugaaagaggugucagcauaagcaauuguaugcucccaccugaaaccacauuuugagggagguauacaaagguguagggcuuuagggauuauucuguauggcugaggggagucuagaacauuguguucuggugacaggugauagagccuugacuuugucuugcccucuuuggguucuguuuucuaucaguucucagauagagaauccauuucuuuuuuuucuuuucuuuuuuuuuuuuuuuuuuuuuugagaaggagucucucucuuucacccaggcuggagugcaguggcgcgaucucggcucacugcaggcuccaccccccaagguucacgccauucuccugccucagccucccgcguagcugggacuacaggcgcccaccaccucgcccagcuaauuuuuuguauuuuuaguagagacgggguuucaccuuguuagccaggauagucucgaucuccugaccucgugauccgcccaccuuggccucccaaagugcugggauuacaggcgugagccaccgcaccugggagaauccauuucuuaaauucauuugaauuuuauugcaucugucuuuuuaguuuguuuauucauaacuaagaacucugacuuacaguuccuugcaaugaaagagccaaauuaagaaaaagcugcugauagugaaucaaaaaauaagucagucaauaaguaucaaacaacuacacauuuagauauuuuguuauauuauauuguuggcauccuuuuuuuuuuuuuuuuuuuaauguuuuugagacagacucuugcucuguugcccagacuggagugcaauaccacagucucagcucauugcagccccugccucccagguacaagcaauucuccugccucagccuccugaguagcugggaucacagucaccugccacagagcccagcuaaucuuuauauuuuuagcagacacggguuucagcauguuggccaagcuggucucgaacuccugaucgcaagcgaucggccugccuuggccucccaaagugcugggauuacaggugugagccacugcgcccagccuuucuaugcauagacacagugagugauugaaaaaccauuuucuguuuccauugcuaauauguaacguaaaacaugacacuccaaagauaacaggugauacaagugagaaacagaaguacauaaagcuuugagcaaacuucaguugguuccuacagccuugcaagcacugugccagacuauuucaggugauuucuacaucauccccauuacuuuauuuucccuggaaaugguaagggaaaagaaaauaggcuuuucuguuuuauaaaccauaacacaccaaaggcccacaucacugaucuuuuuugucacuaccugagcugcauuuuucauguaucugggggcccagaugcagaggcuggagcucugcuguguucaagauguggcccacaagcagcugcagcaacagcauuuugaagcuuguuagaaaagcagaaucccaguguucucuucaaucacacugagccaaaccuguuuugacaagaucccagaugaucuguaugcaccuaaaauauugagaaguacugaacuaaaauacucauucucaaaaaaauauugauuuauucuucauacauuuuuuuuucucugcaccccacgcucaccugccugagcuuccaucuccagccaacugcucucucacuaaucccuguuauugagaguacuccucuuggcacagauguuuaccauguaaauaacuuuuggacuuucauuuccuuacugaucuguaucaaccgcccuaccacauucucauuuuccuuuccaggacuucuuuagagaguguugucuuaggggaaagccuguuguguuggaacaagcuacuguuuuaccuugaauacuuuucuccaacgcuuccauucccucgugacauccaaaaucuaguuucuccaugaagaaaacacucuacaguaaauuuuucgauagaaaccagcuguuuucuuacucaauucacuggcaaaguagaaggguguagagcauuccuugacucuaagccauuauuuuaaaacuauuuccaguaaacucuuuuccgauguaugcacuucuagaauuuucugaccauugacucgaagaggauaggugggaagacacugguaggagaguuuuaagaaugaaugaguugacacgaguuuccauucuaacaggcaaaaugugaugacagugucucuggaauguguacacuuaaccacaaacauguaugcacauuccaaaaguuuaugaauuccuuggacuacagacuaaagcauaaauucuuagaauguuuucucaggcauucugagaauuuugggcaacuucuuauuucagcugugucacaugccuuaguuuauauaguccauuuuuccaagacagccuugcccuauauuaucugauaugagccuuucuguccuggaaggaccaguuuuaauucuauuucacucauaaagcauugcuaaaucccuccauuuagaauuguucuuuuccuucuuuauaauuucauaguccuuuuuuaugcuacuauuauauuuuuccauucauucuauaaaaaauguauuuagaacauauugcguaucaagcacuguguuaggcacagagacacaguggggcaugagcucaggccuguuucccauucuugggaagcucaaagucuagaagaagaaaagauguaauuacagucuugaaugugugauuauaaacagguuaaaaagugccuaacccagucuuacagauccugagauggcuccccuaauggaguuuaucuaugaauugagauaugaaggauaagaaagcaagagacagagacagagaugggugguggggugaagcaauucuagacccagagaucaguacaggcaggggccccacugaaagaacaucugaggcacugagcacaggccagcguggcuagaggggauggaggagagugaugugagaugaagcugcaaaggaagacaaaggccagaccacaagaggcuaauacacugcuuuuaaggaucugggucuuuuucuuaagggcaauaagaaguuacugaugaauuucgaguaggaggucagaauaagaacuagauaccucugccacucucuuaugaaauccuugaagggaggcuggaucaucuucacucuugaauacccuaaaaugucgauugucuaagccugaaguuugauaacuauauuuuaaauuuuuggaggaaaaauauaaaauauaugguuugaauaagauaaaugcugcaucaaauauuuuuuucuggaagcaugcacuuuuuuacuauuuauauuuuauaaucuuucgaaacaucaacugggcagagagugcuaucuaucucauuacagauuuuccucuuccuuccuagugauaauccucaaaguuuuagcaggcauauuaccaccuagaaugaaacuguaauucucagucuaucuugcaacucugugguugugauuaaaucuggcuaaugagauaugauugaaaauguugcacggaacuucuggaauggcuuuuuaaaacggaagguggacccuccuacuuucuuuaugaaaaucagaugaaauuucuggaguucuagcagcaaucuuaaucacugggaaaauagaaaccaugagcuaaggaaacuggagcagaauguuugagucugggucucggaucgcuuucuagauauauuauacaaagccugaauugucuauuucagacaucuuacaugugcagaaauaaacuucagauuugccuggaaaacugauugggucucuguuccuaacagcugaaagcacuuucuuacugagacccaaacuuucacuucaaggaugaugaauuauacacaguuguguaacugacagauacuuuacuagaaaaaauuaaucuuugagccaggaaaguucuaacuugugcucaauuaaaauaccaucuuaauuuaggccacauuuuuuuucccauugaauacuucuuauuuuauuuuuaaugaacagggaauuaauauucugggagaaaaccaacacaucuggcuucuaagucuguaaagauauucucuggagaugguauugcaaauacacuuaggcuuaagaaaacuucuaacuaaugaaaagggacugugauuucagaaugaugccaguuucacagacauucuggggaucugcauugucucugagauaaaacaguuauaaaggacaacuuguugaguccuaucagaaguugcgaggaucucuuuacucaucuguggacaagaccaacaaagaagcuagggcacucauucuugcaauacagcauccagcuggaacuaccuagagaaagauuccagaacagcacuaauauuaauaacuugugagccacaugccauauguagcuuaaaaucuuauggaggugacaauaauauuaauauuuuauuuaacacaaaauaaaaugaauacaaaaaugaucaaugagcugucuuauauuccuguguguguaugaaguauucacaaucuguugugcauuuuacacuaacaucacgucucaguuagaacagcugcuuuuuaagugugaaauagccacauauggcuaguggcugcaguauuagagaguauagcucugcacaucuucugcuuuccuuuuuaauccaguaucucacuaccugcauuucuuugugguuguuuuuguuuuguuuuaacuuuaaguucaggugcucaugugcagguuuguuacacagguaaacuagugucauggguguuuguuguacagauuauuucaucaccuagguaaugagccuaguacccauuaguuauuuuuccugauccucucccuccucccauccuucacucucugacaggccccagugugugguuuuccccucuauguguccauguguucucauuaguuagcucccacuuauaagugagaacaugugacauuugguuuucuguuccuguguuaguuugcuaaggauaauggccuccagcuccauucauguucccacaagagauauaaucuuauuauuuguuauggcugcauaguauuccaugguguauauguaccacauuuuaucacugaugggcauuuagguugauuccaugucuuugcuauugugaauagggcugcaaugaaugucugcauggauugucuuucuaauagaaugauuuauauucuuugguuacauacccaguaaugggauggcugaaucaaacgguauuucugucuuuagaucuuugaggaauuaccacauuguauuccacaaugguugaacuaauuuacauuuccaccgguaguguauaagcauuccuuuuuuucccaaagcauugccaguauuuguuauuuucugacguuuuaauaauagccauuuugacuagccugagaugguaucuuauugugguuuugauuugcauuucucuaaugaucagugauguugagguuuuuuuuuuuuucaugaugguucaucucaaguaugucuucuugugaaaagugucuguucacguccuuugcccacuuuuuagugggauuguguuucuucuuguaaauuuguuucaguuccuauuagaugcuggauauuagacuuuugucagaugcauaguuugcaaaaauuuucucccauucuguagcuugucuguucacucugaugauaguuucuuuugcugugcagaggauccuuaguuuaauuucaucauguuugucaaauuuugcuuguguugcaauugcuuuugugucuucgucaugaaaccuuugcccaugccuauguccugaaugguacugcauauguuguauugcaaaguguuuauaguuuuggguuuuacauuuaauucuuuaaucuaucuugaguuaauuuuuguauauuguguaaggaagggguccaguuuuaauuuucugcauauggcuagccaguuaucccagcaccauuuauugaauagggauuccuuuuuccauugcuuauauuugucagcuuugucaaagaucagaucguucuaaguguaccugcacuucuaucucaauucugccucuauuuuaauuuucucuuuuaccacucucuauugcucaauugcugcuacugguuuucaccaucuuccagaucccaguaaaaucuuacccuaaccgguagacccacuacuaaacaaauagucaguuaagacauuguuuggggagacuagugaauauaacaaucuuucauuaaagccuuuucuuacucugaaaccaguuucucuuucuagccaauaccuuuuccgguuuccacaucuaaugagcccucucuccucaguccaacuccuaaauaccuuggauauuuccuuuuucaccugguucuacugcaguaauucauuucucaucaccucugcccagguaaucagaacaaguguuagucaugcaaaacuugauuuuccugaaaaucccucaauggcugcguauugcucaaaggauaaauuacagucuuucuaguaaugcaacguccucuuuuuuuuauuauuauugagauggagucucgcucugucgcccaggcuggagugcaguggcacaaucuucgcucacugcaagcuccgccucccggguucacaccauucuccugccucagccucccgaguagcugggacuacaggcgcccgccaccacgccuggcuaauuuuuuauauuuuuuagagacaggguuucaccguguuagccaggauggucucgaucuccugaccucgugauccgcccgcgucagccucccaaagugccgggauuagaggcgugagccaccacacccggccgcaagguccucuuucauuaggaucccccuaaauuccuagcuucaaaucuucccucacuaguagcugccagucugugaaagaaccuacuguaaauccuugaguuuacugcacguacucaagucauucacacccauguacuuuccagcucccuggaaugccuauagcaugugccuugaacugcuccucugccaucuccaucccaaccuagaucccagggagaauuaggcacaagaucccuugugcauacuuugauuuuggcguuuguguguuuuuuuccaacaauuccaugggguaugugugugugugugcuuuuucugaugucuaacucuuucauaaaucaguaagaaaguagaauccauaaguuuacaaauuauucuucaaggcuaaaacuguccuuggacacaugguaugcaaucaaugaaacauuguagaaugaauggauaaaugaauaaaugaaaaauagaucuuuucaacuuuuccaugacucuccuauacaaacauguugcuguaguuuaaaugaucucuugacuguuucagaaaugggacaugguuaucugugccuccacacuucugcucaugccucugauuuugccuggcauguuccugccuuucuuucucaucauccgaggcuaaugcuccucugaaguucaaccuacuucuuuuaugcgguuuucauuaaccacgcagcugauagugguuuuauuccucuuauuaauuuucuauagaaaucauuaucuguaacaauuaagaagcaaaugcuuacaugcuucuuaacauaguuuuaacauuucuugugaauguuuacugucucuaggcuacaucaguaccuguucugggagaagagauccuauccuguaacuuuugguuuucucauuguguaguuuaguaccaguggccuugaccuucauaggagauuaacaaguguccuauaauaacuaugugagagaaacuugccuucauguguaugguauuucuuuuuuuuuuuuuuuuuuuuuuuuuuuuuuuuuuuuugagagggagucucgcucuguugcccaggcuggagugcaguggcaugaucucggcucacugcaaccuccaccucccggguucacgccauucuucugccucagccucccgaguagcugggacuacaggcgcccgccaccacgcccggcuaauuuuuuguauuuuuaggagagacgggguuucaccauguuagccaggauggucucgaucuccugaccucgugaucugcccgccucggccucccaaagugcugggaucacaggcgugagccacugcacccggccuuauguguaugguauuucuaacuuaggaagugccacuugaaaauuucucuuguaauuuucaaaugccugaaguguuuuaaaaaagcaaugcacuuuuaugucaugucuaauuucccagaggggggggucuucacugaaguguguucaugaagauaaguuucuuguugaugaagccugucugggacuaugccaaagaagcaaaaaucaugaaacuaucacaguaaaaguauaacagcugcgacucguugaaggcaaacaaaguuaaugcuauacacaaauguuguaugguacuuagugguuuuacccugaucacaauuguagauaauggucuauuuaaaucaaccuguuuacugauuaagacacccuuuucagauaccguaauuuguuaaaauuuauuacagacucauuuuucaaaaccauuucaaauaaacacacacauacuccucaccccuuccaucugcauuccuuucuuacucauguaacauucuuuuugauguaagcaggauuugguaaacaaaacaagauucagacucuaauauuccucaaugaauucauaggcaaagacaacaaaguacuuaucucuaauauagcaaugggugccaugagaauuuuagacaaugcuaucugaaaaacuaagcuuguugcccucuuaaaacuaguuuuugggcaguauagauacaacaauacaaagaggaaauggaaauauguguuuuuaaucaaacaaaaugaaaaugacaacuucaucuuuuuaaaacuguuuuuuucuuggcauagaaaaaucuaugacuccucuucuuuucagcuuauagaucauuuaaauaccaaagaaaaaaauucaaacaaaauguuauuuucaaaugcuauaauaaauaccauuguaaauuuuuacuccugacauuuaaugaaaguaaaagagucuuauacuaauaaaccagauaacaaugugauguaacagauuguccuuccuccccuccucuccucuccuuuccuuuucuuuuuucucuguauuuggaaugcaaagacuccucaaaaagagaaagcaaaaagaaauaaugaacucuccuuuuauucagauuggggaaugauacaagucuucaauauguuggguuuaaugaaauccaguaaagaaaugucauuaaaaagauacacaccuuaaccauuuuaauuuaacugaaaaccuacauuaugucaccucaaugacucguuguuagagggaauuacucuggggccuuugggugugaguucacccaaagacuuuuuugaagacuuauuugaagucuguaguucaauccaccggccuuuuuaucaaaccauuuccauauaguaucaccuucauuuuucaguuuugguuucaagugcagcgaaaacuaaaaucgccaaugaauuucagugaguucaccuugggcuuuaugaaucucugcaaauguuuacaguugucuaggcccacacauaaacuuaugguuuuguguuuguuuugagccacuugucuuucuaaaacuuuuacauuugauuuuaccagaaacuuuuuucugucucugcucauuugaaaauguacuuaguacuuaauuaaaccauguuauuacaguaacaaguaugacuugcauaugcauuuucaggaaugaacaacugacucccacacagcauguuagggagcauauagcaaaugaaggauaguguccuacaagcuccaacuuccccuucauuaaguuguaucagucccaauauuuuacaaaaagaaugguacauguccaugagucuguaaucuugguuuaggggagagcaguuaaaugaauucuuagugugaaaucguaacugcaauguauucaaguaauugacaaaaacaauuauuuuaagaagaaagcacuuguuaagaaagauauuuuaaauguuuuaaaaucaauugcucuuauuuuuauuuugcagguaauaugauaucaaaagcaagaaauaaaaucgauuggcuuauuuaaaucucuccguaguugauuuagcuacauguuaaaacuauuuaucuauuuccuuucugcuuaucuucaaacauauaacuguuuuucugacauuacuuuaaugcacuaagccuuccuugggauuuaaaugucaaagcacagcuauaugccaugccaaaagcaaauauaguuuucuuuuguccuaauacaugcaaugcaucaaagaagaauacagcugcuguugaaucuuaaaauggcuaauucaacuuuuuucuuuuccuuuauuucuuaggagaguuaucuccucuggcauuucacuaccuuuuuuuaaaaaagaauauguuuuugucacucuaguauucuauuuguacuuaaaauaaaaucacuuugaaaucacuucagagaggcaacugacuugaacauggguucgccuggguaugugauacuuuuaggucauugagcugauguuuuugugcuagaaagaugcccauggcuuaaauguuuauguauaaacaggaagcuccucccuucuaaaagaaaccaaaggaagcuaaagaucaaaugaaagacuggaguuagcauggaaggccaauaaaguuuaaauaaagagucacacaucuaauauuaugaauaagucagauuuagcaugaugaaaugggacuucucagaaauugccaguaguuucauuuaucagaaacuaagauagagcauagcgauuugcaacauaaaaaucaguggaauccaauaugggaaauaaaccgaguuaaggugaagggacaagaugaacguaucuaccugaaagaaucacaauaggaugaccccaugagaaaacugacguuuuucuauauguuuaaguuggggauuagguuuuaggacgcaagagcuuuuguccgaagcacagucucuaaaaggaaauccaguuucacuuaugaaaaauugcuuguuggcucaaguucuuucagaauuagcuucagccaaccuguucuuugauuauuuguaguuugaugggaucacagucacaacgaugucaggauugagcaaauguagaguuuugaauaacgugaauuuaucugggagacuuucugcccccuuuaccucuuaucaauaauuaucaugaaugaaaguaagguauuuccagaagccuacaguaugcguaaugaaauaagcaccuaaugguaaaagacaaaauauuucccaaaguaagagaaaugccugcacaguuugacgccagcuuaaaugaugacauuaacauuucuaaagaaaaaaagagaaggagauggucaaccuggaaauguaugaaaaaaggagguguccgaccuagaggguagcaguuuggagucagcaagauucaggugaaagagaaaggaaaucugucauaaaaaccaucacuaaagaaacacuaauaaaauuuuuuuuuucuuacucuauggcugucuuaccaguggaucaaugguuauacaauuaucauauaaaguagguucugggauaauucaccucuagagucuggacugaaacagaaaauuaagaaacauguggauuuaauuuuggaaaaguagucuaaaaccaaguagcuuuugauuggaaaaagcuauauuuuugagagcaaaacagaggcauuguaaguguuaagacauaaaagccaaacaaccauuaaaacaguguagagucugaucaaucacccucccuucgucaccucagcauucagucccaggagguacugucugcugguuggugugaucuucaagaaguauuuguugacugaauaaaucucaacccuaagccaaaaaagaaucugagagaagucucaaucaauuuaguuuauuuugcugagguuaaggacauucccaugacacauccucaggaagaucugaggacauguggccaaggugguuggggugugacuugguuuuauacauuuuagggagacaugagacaacagucaauauauguaagauguauguugguuccaucuggaaaggugggacaacucaaagcaggggcucccaggugauagguagauuuaaauauuuuccgauuggcaauugguugaaagaguuauuauuuaaagacauggaauuaauagaaaggaaugucuggguuaggauaagcagucauggggacccaacuuugaucauccagaugaagccuccagguagcagucuucagagagaauggauuguagauguuucuuaucagacuuaaagagacuauucuaucagucuuaaggucucuguguugauguuugugaggcaugucugaccuaaacuaguuuuuuuuuuuuuuuuuuucaggauuauuuggaaugucuuuggcuaaggggaggguucaucagucaguaugauggcuuagaauuuuauauuugguuuauacagcagagacuuaggaauccuaugauggccuuugagggucuaauguguagagggccucaugucagccugaguggcuguguagagcagauagggagggauggcaugcugaaguaaagggggcguagccuaaggaagcugucccuaaugccuaaccucuccccaacaacacauaugccaugauuuauuucagcuuuauguagucuccaaaagauauagaaaucacugugugucccuauagggccuauaaaaugcuuagauggcugguagaucagacgaagguauuaggagaaagaagaccuaguguguauagucaccaaccauccuaauuuacccagaacugagggguuucuccagaagcaggacucucaaugcuaaaaccaaaugggacucagacaugcugggaauagcugucaccuuaaacacagaucccagaaccuaaguccagcaauacccaugacauaucugaaggccagaaggagcaguugucaugacaguggguggcagggacagaagugggacccugaaggccgaccaggcuggggacucucagggagcucagagggaaccuugguggagcaggugggacagaucccaccccuguggugauaacguauugcauaagcugacucugacccaagccaugcuagggcaucuagaacucuugaaaugguaguacaaccacaaaaggaaguuuaccuuugacugagaucaacucccauguugaccgaauauacacggaaaggaggagugauuacaguaccaaaauguauguguucaaguauuuaucuuuucugcuacugacuagaaauagggaauuagcgaaugaagacaaauuuuagaaaaugauaaauguuacauguuuucuucaucuaaguuaugaacgcaaaauuuaagccugcuuuuguagaaacucaugaccucuuuuguuuuaguccauuuucacguugcuauaacgaacugcuugagacuggauaauuuauaaagaaaagaguuuuaauugacucacagucccacacagcuggagaggcuucaggaaacuuauaaucauggcagaaggcaaaggggaagcaaggcacaucuuacauggcagcaggagagagagugagugaaggggaaagugccauacuuuuaaacuaucagaucucaugagaacucacucacuaucaugagaacgguaagggggaaauccacccccaugauccaaucaccucccaccaguccccuucccugauacauggugauuacaaaucaacuugagauuuggguggggauacagagccaaaccauaucauccuucuugacugcuuucauucgccuuuccaacagagucaauuuaguuuugagauauuuuucauguaucuaccuaauccucauuuaaauguucuuaugaaaauucauuuacuuauucuuuucuuugaaagaaaaaaaucaaacuggauauucuugaaaauaaagcauugaauuaaaaaaaaacugggucugugauuauguacuucauccaaaaauauaaugaagacuuaauuacuaacucuggaauaggaucuagucuauucauaauuucucaagugguaauuuuguaggcuauguuuaaguugggcaauuugcauuuccuuuuccgcucucuguguuaucugggauguuuacugauuuuguuucuaaauguauuuuuuaauauauuuucaauggaguuagacaggaaagagcagaggagauucuaauucuaaugagucacuuuuuacuagugcuggcucuaacaauaugaauuugcuuuggccucuaaacagcuauuuaguccccagauuucaaccucuaggggacaucacuaaaaugcaacuuaauacacuccaaaaaguauuaucuuuucuuucaaagucauuuccauauuuaggaauuuguucuucuguauucugguaaaaugaugguacugguuaauuuuagaaguggggacuagggaaagggcaggugcuuuuggcuccaagaaaaauaaaacuuaauucauaauuacuuagauaagugauaguugauauuuuucacauacaaguuaguaucaguggcugcucgaucuaugguuuucuugacccuacagcucuagacaucaguucuacauuuuaccaaggaugguggagagcaagaggggcaacuguaucaggagaacaaaagcuuucccaagaacaccacagcuaacuucugcuuagcucuuagcagccagaacugugucucaucucugcuucugccuagcauaaaguaaaaaacauuccucuggcagcugagcugugaagagugcucuuaggacugaaacagaaaccacaguugcaaaauggacuucacuauuacucacaaaacagaaaaaaaaauugucaaaccaagcaugaucaccacuuaauuaagcucaaaauauguuaacaucagcuucuuccuaaccauguguccuggcuacaaccacagaaaaacaggucaaacaauaauucuacaacaauucacaaguucugaggccaacuaucagaucuguuguagcgagucuccgaguuuaggaauucuagccaauaccaacaaggacugacucacuccauccccuaauacccucccugacucucccucaauguccgucccuccccaagcacccccucuccccaacuuugagaugcccuaugguucuccuugugauucucucuugaaggaagaagugaguggaccuaacuguggcuaaaggaguguuucugaagguuugggcucucagguuuucacaccuggaaagaggcuggagagaaaaagauugagaauaagaguugagucaggcaucuuaagauguuugccacaagcagucaauaaugcaaggguucuagaaaugaguaaaagagaguaacaaugcaagaagaaacaaaaauguuaucucuggguauuuuaccuuucucagagaauguuuuggaaacugaagguugaugacaauccuccucucuaagagcagauuaucacuaagggaaucaagcuagcagcuuccauuguuagagagcaauuucugcccauuauccaccaccuccccuuccaguucuaugauugcuuauaaaauguaacuaaagacaccaaagacccucaagaguuaaacaaaagggauucugucaaucacaaagguuuauuguguaaaccugcagacacaggcuuguuacauacauauauccaacucucuuccugacauuucuacuuagacguccaguagacauuucaauucauguccaaccuugaauuucugacuuuuucuuuagccccuuugacuaauuuucucuacaacuagucuucccagucugaagagauggcaucuccuuucuuccugcuguucuuagcaaaucauuuggauuuaucccuauuuccuccauuucucucauaccccacaucuaauuuguaaagaaacccuacugacucugccuccaaaauauauucagaauuggccacaucucacuacuucuugugcuagcacccuggucuaggguacacgcgucucucaccuggauuauaauggcauaauuuuaguuagccuccugcuucuaccuuucuugcucccacagcccagauucauccuuuuaagacgugaguacaucauguugcucuauuuagaacgcugcaaauggcuccuguauucauucaaaguaaaagccacacccugacaauaaccuacaagucuggagggcuuguucuggcgucuauuccuucaacuauucuugaccucccgaaacuugccaccauggcuuccauacugauccuggaucaugcaagugccucuuucguugccugugcucucugggucaaauguucuuucccugcauuaguacauucaguuaccucuuucaagucuugcaguaauauuaucuuuucaacggaggcuuauccuggucaaccuauuuaaacuacaacucaacaccuugaucuacugacaugccaggcuuccuuguuuuguucuaguauuuuuacccauaaaauuuauuccuucucacuugcuagauuauuuacuuuuuaauuagaguuugucaucucuccuuccuccccucccucuaccaugucagcuuagaauuuucaauaaucuuuaucuguccuguucaaggauuuauuccaagugccuagaauagcaugacaucuaguaugcacucagaaaauaaauacugaaugcauaauucuguagcuuggcaagcuugcuuuuuccuugauucaaagcugcguucagaaaauaagcacgugaacaaaauaagccacaugcaaaucuacacacaaagcaaaaaaaaaaaaaaaaaaaguucaaaucguaggguauuccaauacaacacacagaaaaacaccuucagacaaauuguuucccuaaguucuacucaucaaaucauugcagcugugacuauuaucuccaaacauucuauaaaagucaggcuuguguagcucuuuuauuuuuuuuacccuauguucucauuuauacuuuuuuuuuucucccucucaaaaauaacucucaaaucgaucaagcuggaacugggaaggagaaaagaaaagccacuguaggcuuccuuugggagaauuuggguaaucugaaaagaaaguuguagauacggggcaguugcaaagucucagcgaggagaaagaagcagagaugugcuagggguguaucauuaaaggauuaucuggauacaucacugcucuaugaggacagacuaaaaccacugguacuuuuaccuggaaagacacagauuaagggugauaucaucaauacacucuucagugguuuaaguaaaauaguccugucucauaccuaugaaaguacaacacuucaugcuuaagauuuugaacugggaacauuuuaggugacuaaaggaaucugcuguuucacacauugguauuuaauguacagauguuguugccuuaaaaaaaaaguguaagcuaaaaauaggucccauaauggguuuagaaaaugcguggagaugugucacagguggcuacuucccugcagcuaaucuuuucauuugucauccuaaagaauaagaaaggugugaacuuuguucuuuuagcugcaggaaacuuggcaagaugaauauugggccugaccuauuuuggcaaaaaaaaaaaaaaauuuuguguaucucuguaucugugaaaaauugaaacuuguauuuucuuuucuauaccuucccuuguguuggucuccccaccaggaguaucaccuuccauuuuauuaauuuaccaaaaucccauucauucuuuugggaccaauuuaacuccugucucuaucagaguaaaacauuaauaucucaacauaucaccccucuuucuuuaguagcaaacaauuuauauauaaugccuagaaacacgauguuuagagagaaacagcaacauauuaccuagcccuuuuaccaagcugaaagagguaaugaaauuauuguaucaucacaauuacugaccugaaaaaaagaguagauacuaaaaaacuccauaacuauuaugaagaaaauauuuuuuucuguacaaaacaauauguagauaauuaucuaaaaucagaacaaaugaucuuuaaaacauucaucucagcuuuucugauuauugcugcuacuugcucuaggcagaaauaauagcugauacauuauuaauggcucaauaauuaggaguauauuuccauuaaaauuguucacuauucuauuuaaauauaaacuguuuaggcuacuaagaucaguacuugcauacaugaauagaaauaagcaguauacuaugucauaaagucuucuuauaaacaugugaaggcuuuauagaaguucuaucuuacagccaccacaaacuguaacuuaccauucacacgaacgccaucuuauucagauuuuaugaaagcaaacuuacuucaaaauagauuauuuuauauguuuguaaaauucauuuuugagugacuucuuaaaguauuuccucuugaauaaaauacauuuguuaaagacuuauggucuacauuuuguuguggguagacugagauaggauuaauaucuuaguucaaaauuuuaaaaaaauuuaaagaacuuucaucuucccuaaacacaaaauuaauaaaaugagcuuuuaggauaagacaguucuuccucaaaagacuucaauauaucuuagaaaaucauauaaauucacuagguuaacuucaaaucauauauaauuuguuuacagacaaagcaucucaaaaugaaacuuguucauaguggaaugacaggcccuaucuagaaguauauuaagguaguguaugcaguauaaucauaauauuucacagaaaaguugcaucuucccacugugugagaauacaauuaaaguuuuuauuaaaaauuucuccccagguuugcaaaaccaauaaagauuugauuuuugucauauuuuaauagguguauuuuguaagcugaaccaguuacucuaaauauucugcuucauaaauacccaucuugcacacugacacuuuuguaauauuccuuuucuuucagaagcggguuuuggaaggcacaugcugaggccaagucaugauugagacagaaagagaaggcacauuucugcuguaaacuaaaaaucaacugucagaguuucucugccacacugcuguugcuugcaaaacuacuuauugaaggcucagauucucugauuggagacuguugaacaaauauaacaccacaguguguuuuaucacauauauauauauauaugcuauauauauauaugauauaucucauauauauuuaucauauauaugcuauauauacaauauaucucauauaugcuauauauacauauauaugcuacauauauauguauauauguuauauaugauauaucucauauagcacauauaggauauaucucauauauagcauauauaugcuauauaugauauacaugauagauauaugauauauauauccacauaaaaacauaaacauaaucacugcuaauaucacaaguauacuacaauacguacuuugaaugguaauuuccaccuuaccuguuuuuaacuuuaauuuucuuuugggauguuucacuggucucacaacagaaacacagguuuggaaaguuuggacaacgugagguaggaugaaaagaucauuuaccugucuaugaucgcacacaugucaaugcugacauucgcgaaacuucccggcuuccuuugugccacuucguauaaauuuacaaguugaucguccacuugaaugagcugcaugcauccuuggaaugaaggcugaaggacagagugacuugaguuauucaucugguucagaaaaccugugaaacagaagaaaugggaauguaaaucugguguacaguauaaccuucacuaaaauucuuguggguauucuaccuggccacagccaucacauccaacuacuguuucuuuaauccuugcugauguuauauucaguguagaaaaaggaaguuuuuugagaaagugagauuauuacagaggaagaagucaggguugaauuguaauggguuaccagguaaauguuugccucuggggucuacugucacucaaauuuucucuuuugacaucaucuuucucacugucacaucuuucugucccucugcugucaaagacucacuguuauucuuucucugcugagccagcccucagagauuaggacacaaaacuuuagaacuuucccaacuauccaacuuucuucuucuuguuucuuugauauuuauuucuauuuucuuaauucccuauugccuguuauucagaugucaaauaagccaaacuuacuauuaugaaauaaaguagauuaguguguaacucauuacaaagagauauuugcauuauagaugccuuuuuuuaauuuauaaaaucuaagggaacauuagaagcaaauaaauuuaggcauaagggucagccacccuacuuugaauauacaucuucuacaaacuaucuaauaugguauaaauaaaauaccauaauaugguauauauaaaauaccauaauaugguauauauacuaguaaauaauaacagauagaacuaaaauuaaaagaguaaauaacaagaguaaacacacacacacacacacacacacacacacacacacacacaauacuguugauucuauuaggaaauagaaugcccacaccaaccuugaaaucagacauuaagaguuuauugcuaaauaacuuuaagagaucaccaccaaucaauuacuauuauaucuuuuuaagagaaacaugcauaauuggauagaaacacccauuauggauggaaaauuuguaggccauaagaaaaugauauuuuucaaucccauuaaguaucuccagaaaguccccagagcuucuacuuuucauaugguucaccauaccaaaucugccuacugggcaaauuuaaacuguacuaauuugucugcuugcaaaucugaaguuauugacacauucacuucaucuaauauuauaucuguaacaacaaacaauuuauauaaaaugggauggaaccaaaguuccauuaaauggauaaaagugaauuuucaauaaaaacaaaaaauggccauuauauuagucuguucucauguuguuaaaaaagacaugccaagacuggguaauuuauaaagaaaagagguuuaauugacucacaguugagaauaucuggggagggcucaggaaacuuauaaucaggguagaaaggaaagcaagcacauccuucuucacagggcagcagcaaggagaagugucaggcaaaguggggaaaaagacucuuauaaaaccaucagaucucaugagaacucacucacuauuaugaaaugauagaauuaccucccagugggucucucccaugacauacagggauuaugggaacuacaauucaagaugagauuuggguggagacacagccaaaccauaccaguuauuaagugacauuuucaaaauauccuauucuuuuugaccaaggauaguauuuuaguagagcagaaaucuucuuuuucucuucauuaauggauuacaauauuuaaaguccaauaacugucauuugaaucuccuauaaggauuaaucacaaagguauauauuauuuccuauuaacacaguacuguauaaaaauaagauuguauuugaauuaacuucuugacuuaaaaaaaauccauguaaggcucuacuuuaauguuaauauauggcucguguguguguguauguguauuuucuagucaaccacauuuuuuucauucgcauugacuuagucccuucagaaaaaugcugauauuagguaaaugaucuguuuauaccaguugcgugcacacaugauuuucaauuguuuaaucaagauaaaauugaauagaguguaaugucuaaacuuagcagagagaaaacacccaguuguaacuuacugaccacucuuaagaagacugucauuuguuucuguuuuuuuuuuuuuuuugaauaauugggagucucaccauauccacacuagcuuugaaagauuucaaaaugaauggauguaugugugaaaauaaaagcugcucugaagcacagcagcugcauaaauaccgauuacuacaaauuggguauaauuaagguuguaaaacaagaauucaucauucgcuuauaacaauguucuguuugaucuugguaauuuugaaguuugaagugguuaaguccuuuuauuuuccaauaggagauauauucuaggagaagauaauuauaggacaaaauacuacauauucauuaauuuuuuucucuccauaauauuccaagauggacaucguuaaucuuuggcuccugacuucacacccuuuuguuguccccuucuauaaucaauuaggccugacuucugugaacaauagaaaacucugcaacuuggucucugagaucacuuacuucguggcaagucaucaccaugucauacacugucuucuggaguggcccaggagagguaaugaauauucaucauuguuugaaauuaauuuuaaggugacacauaaugcaacaauagauaucaaauaaagaaugugaugucuggacaugccauccagguugcuguaaaugccauuaauucacuacuuuuuauggcugaguaguauuccauuguauauauaccauaguuuauccacucguugauugaugagcauuugagcugguuccacauuuuugcaauugugaauugugcugccaugaauauguggcuuuuuuauacauauacacaauggaauacuacucagucauaaaauuaaaugaauuaauggcauucacagcaauccagaugggacuagagacuauuauccuaagugaaguaacucaggaauagaaaaccaaacaucguauguucucacucauaagugggaguuaagcuaugagaaugcaaaggcauaaaaaugauacaauggacuuugcggacucagggaagaaaggugggagaggggugaaggauaaaagacaaauuggguucaguguauaccgcuaaggugaugggugcaccaaaaucucauaaaucaccacgaaagaacuuacucauguagccaaauaccaccuguucccccaaaaaccuauggaaauaaaaauuaaaaauaaaauaaaauagaauaaaauacuuuaguaccaaaaaaaaaaagaauuugauacuggcagagaauuauaacagaaaccugaaaauguggcaguaauuuagggacaggaauaugcaaguuagcgggacaggccuuaaaagaagcgugauggcucuugaggagcuguaaugacuuaaaggaaggugagaaaagugucaucagaaauuagagaaaauuagaucuuugcuauguucugguggaaaguuuagcaacauuguuucuugugauaauauggaaaagaaaaagauacaguuaaaugaaauuguauaaucuagcuaaggacauuuccagguagaguauugaaggagccaucgggcaucuucuguuuauaguaaaagaaaaagaaaaugggagagaaaaagcuaaagaagaacuauuacaaaugaagaagccaggcauuacugaauuuuaaaguaaaaugcucuuucaauuccaaucucuccagauggugaacaaugcaaacauuaagaaaucacauuucuaagcaaagaucaaauuccaggaaaacaugaucuaaggaugacaaggaagcgugacuauaaaaucuacauaaagacccaagaaaauuauuagguauuccucagggagacacuccaugagacagaagacccucuaaagagcuuauuuuuaugcuuuacaggucuuuucaguuaaacaauagggauucuaauuaucuuaaaagcauuuuccuucuguagaucuacagaagcucaagggguaagggggagcuuaucuuuauauaauuguggaugugccuuuuauuaaguggaguaaaccugaauaaaauucauagaaaacccauucauuuuuaagauaacuauauuggagguaacaccaccagcuuguacugaaagggacagaguugggacaaaauagaaacaggccuuugacuuccaaacuuuauggucaggagucuaugcagcuguaaacauagacaaccucuauauacauaaaaaaaggaugacuuacaguggcagaacuaacacagagggcagagccaagagccauggagaaucauguccgggaaacagcaugacugaguucuaaucaagaaugaccagcaugugccugacuggauugcaaaacugcuguggaccagugacuugucucucuuauuuucuccacuuuugaaccagagagucuaauuugguuucucugugcauaaucuaccauuguauauguggugugaggauggcacaaaacuuguuuacaggucuuaagauugacaacuguacuugggaagugguacuugagugacuauaccuaaacagcuucauuuucucuuggacucucugagauucauuuuggauugacuugacuuagacaaugagguccuggaauuugagcagauggccuaguggaaugagacuuuggauggcuuuuagaggagguuggguguacuucguguguggaaaaagauauguaucucugugggcuguagggugaacaccggcaaucaaucuccaagauggccauaaaucuucacauuauaauuauguuauuuuaaauaccuccuaauauuuacggccuguauaguucccucccacacaaucagugcugcuccgugugacacagaauguugcaguaguaacaaggugauaugauuuccaagguuaaguauaaaggcauuagaggcugcaccuuggucuuuugaucccuuacuccagggaagccagccuaaaagccauggaaacccucaaguaguaagauggagaggcaccuaggaggagaacuaaagccuauuaccaaguuccagcagcagcuugcuagccaugugagucugcuaucuugaaauggagccucuaauccuagucaagucaucagcugauuguggcucuaggaaacauguaucugcagccuuauaagaaauaucaagucagaacugcccagccaagcugcuccuaaauuacuggccucuuacagaaaaguaagagauaauaaauuauuacuacauugagccacugaguuuugaggcaaugcacuaugcagcaauauauaacuaauacaaaguauaacaaacacauccugcuauuauaaucucaaaucaguuuuaauaauuagaaccugaagauuacucacaccugugaaacauuauguaacugguggaauauugacaguucccuuagucaacaaugagcuaaagauguuggaucucugauacugaaccuccugcuguuuuaacucccuuagaaacagaggagaaccuauuauuuauuuucuguguuuguucucuuuaugaacaaaugaaauuucaguaaaaauacuaguguauuaguguuugugauaccuucagugacuacuccaaagcucaggauuuaaccuacuuagauuaacagugggauuuuuugguaauauaaauuugcagcuggcauuuugagggucagaaaugaauagcuauaaaauggaaauaaagugaauguaacgaauugucaaguuaguaaaaauauaaaguuaaaauuuuugcguauuuuuguuauaucuuugaauuucuaugaauuuggaauaaaaaauacaaugucuauacaugggucauuguaacugguuucuacaaucugacaauguguuaaaacacccacagugaauuguaaucuugucagucucaauugcaucuuacuuuccaugcacuggaaaccuuucuucuuuccaggaacauuguaauuauauuacuucacuggcaugucugaaauuucuguuucaagacuugcauauaaaaacuucauacuugauuugaaguccacucaguauauugcuauucuugcugacaaagaaaacacaagcauuuucaagguuuuaaaauuuuaauucagaaauacaucagugaaaaacuugcugauauuuguuuugacauuaaaauggcaaccuaaauuguuguaaguuauaauguucaucugaugggacagaaaaagcaaacgguggacaacaagguugaaaaauugacauguuuaaaaccaagugcauauaaagcuucucucugccuuuuuuaaaguugggaagguugggagguccaagggaggcugguggaaugcuuuaaggauguuuaaaaccaccuacugucuuccuuucaauuugaucuuggcagauugcacaaaauaucuacuagucucuacuguuuacucaaccuuccugaauaacaaaaugucuacuaaucucuacuguuuacucaaccuuccugaauaacuuagucaaaaacccauugagcaggggcaggaaaacagccucauaaaaacuagggucccagcaggcaggaagauagaguaguccaggggaagagagucuagugguguccaggaccugugcacagaggauguccacacaggaucuccaccccauguggcugggagauugguuacaguacagguugauugggcaaauaaguaaauacauggaggauagugagagucaaauucccaacgucaaagaaagaggguacacauaugaaacauaagaaagaauguucacgccuguaaucucagcacuuugggaugcugaggugggcagaucacgaaguuaggaguuugagaccagcuucgccaacauggugaaacuccaucucuacuaaagauacaaaaacuuagccaagugugguggugugcaccuguaaucccagcuacuugggagacugaggcaggagaaacgcuugaacuugggagguggagguugcagugagccaagauugcgccauugcacuccagccuggguuacagggcgagacuccaucucaaaaaagaaaagaaaaaaaaagacagaaugaacccaguggguuugcauuaggauuuaaucaauuaguguaaauuugugguuuucacuauauguagauagauacagaaauaaguaugaaugaaauuguauauuuggucaauauacagaugguuccuaucauccacugaagacagccuacguacagggucacucucaaagcaaugaauaguucuguuucccagauccugguuucuaugcugggcaaaaccaagacuccuuggagaaaugacugauucuaagcuguguuagggaaaguacaguaagaaucuggaacauuuugccacaccaaaaaguaaugaagugcccaaagaaugauggggucaugucagaaugacacaggagccagccugaaauggcaucugcuccucaaauuaagggcaauuugcauacaaaauaaauaauuugaguaucaaaaagagauuuugaauaucaaaauaaaaaagggaggagaaaaaaagaggaagcuacagaucauauccuacugaauaaaguaggaauccaagagucugccugucuaaaagugaauaaauacacagggaaaauagaaagcuccuccaauagcacuacacuaaguaauacauguaacaggaauguaggaagaagaaagucaccauuuggaaaccaucauguuaauaauuaauucaggcaaggcauaucaauaggugcucaaauaagugggugaaaguuggaagcagaacauagccucaaacuaucuccuuaaaaauauaguuuuuuaaaaaacucauaaaccacccccaucuaaugaacgagaccuacuauaugauagcacaauaggguaaauacagucaauaauaaucguauauuuuaaaauaacaaacaauguaauuggauuguuuguaacucacaggauaaauguuugagauggauaccccaauccccauuauugaaugcuuguaucaaaaccucuuauguaccucauaaauauauacaccaaguaccccaauuuuaaaaauauauauguuuauuaauuucaaaggggagagcagucacuuuacauuggagaaaccaggcagauaccuuuauaaucaagugaucaauguuaucaccaugaguaacaggaccaauugauacuggggggccaccugaugagauucaaugagaagaauaaagcaugguguguaagacaccugucaaaaauacaaggcuggguauaacaucaaacuaauccaauuucaggacaagcgacaaaugacugggauagaauauucaagaaugagaagguugugaaagugaagaaauuacuaaagugaagauauaauuaugauuguuagagacuggagaaucagaaaaacagggugugacaugugaucccagaguggguccuuuugcuguaaaggacugauaugguuuggcugugugcccauccaacucucaucuugaauuguaacucccacaauuuccaugugucaugggacaaaccgagugggagguaauugagucaugggggugggucuuuccugugcuauucccgugauggugaauacgucucacgagaucugaugguuuuaaaaaugggaguuucccugcacaaguucucucucuuugccugccaccauccacauaagaugugacuugcuccuccuugccuuccaccaugauugugagacuuaccuagccacauggaacuguaaguccauuaaaccucuuucuuugguaaauugcccagucucgaguauguuuuuaucagcagcaugaaaauagacuaauacaguaaacugguaccaguagagugaggugcugcugaaaagaauccugaaaauguggaagcaacauuggaacuggugacggcagagguuggaacaguuuggagggcucagaagaagauaggaaaaugugggaaaguucggaacuccuuagagacuuguugaauggcuuugaccaaaauguugauaaugauauggacaaugaaauccaggcugagguggucucagauggagaugaggaacuugcugggaacuggagcaaaggugacucuuguuauguuuuagcagagacggguggcauuuugccccugcccuagagauuugugaaacuucgaacuucagauaggugauuuaggguaucuggcagaagcaauuucuaagcagaaaagcauuugaggggugaaugcgugcuguuaaaggcauucagcuuuuaaagggaaacggagcauaaaaguuuggaaaauuuacaaccugacaaugugauagaaaagaaaaucccauuuucuuaggagauacucaagccugcuacagaaauuugcauaaguaacaaggauccaaauguuaaucaucaagacaauggggaaaaugucuccagggcaugucagaacuuugcggcagccccucccaucacaggccuggagguuuagggaggaaaaaaucauuucaugggucgggcucagggucccucugcuaugugcagucuagagacuuggugcccugugucccagucccuucagcugugacuaaaagggggcaagauacagcuuggacugcugcuuuagagaacagaagccccaagucuuggcagcuuccaugugguauugagccugugggugcacauaagucaauaauugagguuugggaaccuccaccuggauuucagaggauguauggaaaugcauggaugcccaggcagauguuugcugcagagaugggacccucaugaagagccucugcuagggcagugcagaagggaaauguggggucagaggccccacacagagucucuacuggggcacugccuaguggagcugugagaggagggccaccauccuccagacuccagaaugguagauccaccuacagcuugcacugugugccuggaaaggccacagacucaacaccagcucuugaaagcagccaggaagggggcuauaccuugcaaagccacaggggcagagcugcccaaggccaugggggcccaccucuugcaucugcaugaccuggauaugagacaugaagucaaaggacacauuuuggagcuuuaagauuugacugccuugcuggauuuuggacuugcauggggacuuuagccccuuuauuuugacaauuucucuuauuuggaacagcucuaguaacccaaugccuguacgcccauugugucuaggaaguaacuaacuugcuuuugauuuuacaggcucaugagcagaaaggacuugccuugucucagaugagacguuggacuauggacuuuugaguuaaugcugaaaugaguuaagacuuugggggacuguugggaaggcaugauugguuuugaaaugugaugucaugagauuuggaaggggccagacaaggaaugauaugguuuggcuguguccccacccaacucucacuuugaauuguaacucccacacuucccacgagucagggaaggaaucuggugggagguaauugaaucuugggcaugggucuuuccugugcuguucucaugauagugaauaagucucaugagaucugaugguuuuaaaaaugggaguuucccugcacaaguucucucucuuuuccugccaccauccauguaagaugugacuugcuccuccuuuccuuccaccaugauugugagacuuccccagccauguggaacuguaaguccauuaaaccucuuucuuuuguaaauugcucagucaugaauaugucuuuaucagcagugugaaaagagacuaauacaaggacauuuucaaacaaguaacaaacguugaaggaggucucugggugaaggguacaguaguggccuuuuuauccuucuugcaauuuuuuugguaaguuuuaaauuguuucaaaauaaaaacuauuuguauaaaauguuauguuccaacugaaauggcacuuaacgcuaaaaauucugucauccaagagcucuaauuuggauuacauuuauuccaccuuguuaugcauucaaccucuauggauuauugaugagauugcucuucauagugucugauaauuuucaggccacuaaagaacauuuucagucuuucucuuacuagaccugucaguagcauuuuacacuugauccucauauauguauucuauaugaucaaaccagggugacuucuguggcuuucaaagacucugaauauucugacuccugacucucacugcaagguaaauucacaucucuuuuaggcagauuuaggcauagagagaucccuaacccuaaaaaucguaggauacauucacccacuuagagcaucccucuucugaaauuuacaaauuaaaacaauaugaauuaaaccauuaaauauguguaagaaaauuauacaugaguuucacuuuuucuguaauauauacuuuacucuucaaggaaaucuaucauauuuagcaauaguucugccauguuauuguguggcuacuuugcuaguuuucagagugaauacuuaagaugucuauccuuggucaccauguuucagccauacucuucucuaugcaucucaggaaaaccaaacccuuucuuccuauuuuucucacuuguacuuuucauggcugaguuauccauaugauucaggucaguucaaaugucaccuuccaagaggcccucccagaccagucaauuuaaaauuuuucuauaaauuuuuuucauuuuagaucuucaacuacuaauuucuucuuacagaauuugucacaauuuauaauuaucugcauugguuuauuuaguuacauauguguguguugggggggcuguguuuguguguaugcacuucugaauaugguauuuucuuuuucuaguauauucauuuuaugaaucaaugauucauaaacgauuuuuauuuuuuuacuuuaaguucugggauacaugugcagaacaugcagguuugcuauauagguacacaugugccauggugguuugcugcaccaaucaauccaucaucuagguuuuaagccccacauguauuagguauuugucuuaaugcucuccccuccccuugcuccccaccccgacaggccccggugcgugguguuccccucccuguguccauguguucucauuguucaacucccacuuaugagugagaacgugugguguuuggguuucuguuccuacuauaaagacauaugcacauguacguuuauugcagcacuauguaucuuuuuaaaaauauuuguugacacaaaauucacaaaccuuaaaaaucaccaccuuacuuaucuaaaacaauccauaugauaucagagagaagaucaagauacaagguauuuauuaagucugaaaauagugauaaaaauaucuucuuuaaaacauaauauauauugguuuccagacuuauagaccgcucuguauuuguuaggugaaugaucacuugaaugaaugcauuaauuuuuaugaagaaaaauguauugaguaaggcggauacagagccaggagagaggaaagauauuaaacugccggucagagaccuuucugauaagagaacugacaccaagaccuaaaggaagugaagauguaauauuaaguaucacuuuuuuucuaggauaaaaauaguguuggcaauuucaauccuguuuauauuuauuaagcaccuaaacuauauugcuuuuguccucaggaaugcuauaaucucauuaggaagauaaacuacagaaagaguaauauaauaggauuaaaaacaauguuacugcccauucauaugaguagauaaacuggcaguauuaaaaaguuugagaaggugccacucucuucuugauaauuuaucuuucuuuggcugacaauguacuacaucauucgagguuuuccuucuacuuuucugacaaucacauuucaaccuccuguacugacuucuugucucuuaccucgucuguaagugagagaguuccuaaagcuuguccuaggcuacuucuguuuucuuggcagauucuccuuaauaaagaccuuauccaaagccauugcuucaacuaccaacuaugggaggaugucucuaaucauaucucugucucagcucucuccucugaacucaacacuaauauauccaaaguuuaguuugacuccuccauuuuaauauugcacucauguucaaaacucaagauauugcugguauucugucauugucucuauaucacuggucacucaaaaagucuuagcuucaguuuaucaauaaguuugugcauauuaaucaaucaagaguugauccuggcacuuccauccucacucugcaaaaugcacaaucauaucauauuaauucuaccuguugaauagcccucuuucucuucguucccaccugagcccagacuaccacagauuuucuacuguccacuuccaauuuguuucuggcuugaaguuugaggugucucuaucaaaaauauuaaucugauccuguuaugcuccuguucaagagccuuuuauuuauuuaauaaaacaaacucaggaauuuugaaaaugcccaggaucuuuuuuuucccucuaaugaucugguuuuccaaaugcaaaauauguuuguagugauuuacaaauuauuaugccauauauaaacaagaaaauacuuauuuuuaaaagugauguuuauuagauuaauugauuuaaugaaaauuaauuugguauaauuuauuggaccauuuagaguagccauauuauuuuaaauuauacuuuagcuagaauauuucauaauauuuaagguuuagaauguuauuuuuauacauggauauuuauaauaacuauauuguguuaguuguagcaacuguuuuuuaauaguauuuguggguuucccaucuuauuuucauauaauacucauuauauauaaaauauguuuauacuaaaguugguuuaacauuaaaagauagugauauuuuugaguaucuuuuaauaagcguaaagagauuuacaagaacguaaaauugaaaagaaauuagagaagcagacuaguauguugacaaacuaggauacuuagcaauuugcaaaucaaauuauacaaaaugauuuaaaaagccaucguugccuaggggccacaauaaaaggaugaacaaacugaauaauuugacacuuucauauauuuuuuacauagucuuuuucaugaccuaguuguguauugauaaauagagaaaaugcaaauauaaaauaaauaauuuuuacaucagauaacuuuaauuccuuauauccacaaacugcuaguauaucuaaaacaucggcagauacagucauaacauaaaauaauauugucuuacugauuuuuucuuauaaguguaaacauuugcuuaauuacuaugaaauuauacaauauucugaaaaauacaaugccggugguuggaagcuugggcugcagaauagccagaacugguuuaagauguauuugugugacccugacuaacucacucauccugucuuaacgccaguguuuucauuuguaaggcaggaauuaauaauacccaauuccuaugguuuuuguaaacuguuaaauaaaacacuguauuaaaagccccuaguacagugacugacacccagcagcugcucaaucagcucugccagugucauuuaguguuugcuugaauuagacagcuuugagggaguagcgugcaaguuucucacguuuaaaaauauuuuguauuugagagauucguuuuucacucuauuuaaaaaacaaaaaaaaacccagaaaauaauuucuuagucucgucuauauugucauuuugaaagucuauauauuuuccaaauacuuucauaugggggauggcucugcuauuaaaaaaauuaguaucauugcagauggaaaaguaaaauauggauauaaacuagacucacaauuaucugcauuaagaugauagggacaaucccaacuaguaggaaaucaaacacaguuuuauuuagcuuuggaaugcuucuauauaugacuauauauuuugguauucuguuaauuugauauuaacuucaaaucaauagcaaagccagauugugaggcucuaucucaggaguugcuuugaaauuggcgagccaagaaaugcuuuguguagcgugggcucuugccuuugucaccuuaacauuuuucugccuuuuuuuuggcuuugaugcuuaggagugugcuuggccuaaaauaggagccugugacugccauucuuccuccugcuucuucuuuucuuuguuguuaugguguuuguuauuguuuguauuauuauuauuccucuugauauaaucuuuagaagcuuuucaauuuucugcacuugguauaaauaagaugguuuuacauguuauacaaaugucuucauguuuauugaugaagcgugaugcuagaauguaaaugcagaaugcuacaagagcaccuccaaauuucauucauaacaaaacccuucaauaaaaaucaggguuuuuuuuucaagauuauaaugucuauucugagauauuuuaaaacauggcuuuuuguaucugaaaacauuucuaaaauauuaacugcaccccaaaaguuuauaacauaaauuuucugauauaagauaauuuauuuaaaauacuuaacauucuguaaugucacaucacauaauaggaaacagaaacaauaaucucuaaggauuacauuuccuaggacgaggcaacaugggagccugaaaauuuuccaguuucaaacaccuagaaaugcuaaauaaaauguaacauacaucuuuuaaguuauauaucugagcauccaguaaaauaggagaagcuuuuggguaucaagaaaaaaagagaacacugaaauucaggguguuagcugauggugggcuauaguagucagaggguauuuacuaaucuuuacaaugcagaauuuuggauuucaaggccaaacagaauuagaaaucaaguaauagaccugugcaaagaauaggaacucccucacgccccuagccccaccacauaaaaccuaaaaaugcuaaauucacaguaaagcagacacuggagaaaaauuaacuagucagcaaagagggaugacaaggaaauuugucuguauuuuaucuuuuuccaaaaaaaaugaugauucuugagaaugcauaagccauaaacuugcugaauuaaauuacagcuuuugaauuuacacugacuauuggauauaacccccaaaucaagaacuuaaaauagaaaaaaugguuccaagcugguaucuuuugaaauaaaguguaaccccucucuggauucacucuggaauuauaggauuacuaaugacaaagcccugaaaaauuuaaacucacaauccaaaaauauaaaacucaagaaaacaaguauaaugaacagaauucagcagaaacaccgcauggaauauuuggcccccaugaauucaauuucagcuaaauuuggggauugagaaauaaaacauucauaaauuauuugaaguaaaaugagaauuaaauauacaagaaaagaauaagauauacuguaauaggcuguucucauacugcuaauacagacauaggcaagacugguaauuuauaaaggaaagagguuugacucacuguucugcagugcuggggaggccucaggaaacuuauaaucauggcggaaggggaagcaaacacacccuucuucacauggaggcagcaagaaguacagagcaaaggugagggaaagucccuuauaaccaucagaugucgugagaacucacucacuauugugagaauagcauggggggaacugcugccaugauucaauuaucucucacugggucccucccacgacauguagggauuaugggaacuacaauucaagaugagauuugggugggaacacagccaaaccauaucaaauaauacuuaaaaauuaccagucauuguugauaaggaaauaaauggauacuccaggaauuaaaaauauauuauuggaauuaaaaacgcauuaguuaugaacauucuaacuggacucuuucaguuauuuuuaaauguaaaauaaaauauuguuggcuuuaguuaccuuguuguacuaucaaacauuaaaucuuacacauucuauccaacuguauuuuuguaaccguuaacugucaccauuucccaccuuacccacuauccuucccagccuuugauaaccaucauucaacuaucuccaggaguucaguuauuuuaauuuuuagcucccacaaaugagugagaacgcacauaguuugucuuucugugccugguuuacuucacuuaacauaauguccuucaguucuaucuauguaguugcaaaugacaagaucucauucuuuuauauggcugaauaguacucuguuguguauacgaugaauucuuuaggugauggauaccccauuuacccugauauaauuauuagacauucuuauguagcccauaaauauauagaccuauuauauaccaauauaaguuaaauuuuuuuaaagaaaaaaaccucucauuaguugcauuaagcagaugagacaaagcuacagagugaguuuguaaacugaaagguagauugaauaucgacaaugucauucagaaauuuaaaaaaacuuagaaacauuaaauauaaauucuacaauauacaguauaaaaaugaguucuaacguauuagguuggugcaaaaguaauagugguuuuugccauuaaaaguaaugacaaaaacuguaauuacuuuuggaacaauauuaauagaauuucagaggagagaaaagggagaaugauggagaaucaauuaaaauacguaacaucuaagaauuuuccagaacauuuaaaaauucagauucagaaaggacaauacaucccaauuaaacauuuuuauaaagguaaucuagcacuaaacacagcaugcuauaacagcacauuaccacggaacauaaaaguagcaagggagaaaagagagaguaucccuaaggaacaauuuuaaaacagucaggaagcuucuuaagaaaagugaaaacaaaagguagaauuuaguaggauaauauacucaaaguacugagagaaacuaaacuuucaacauagacuuguauaccaagcuaaauaaacagggaagaugguaaaauuaagauauuuucagaaaaacaaaaaaugaaaaaauuuuaaauuaaaaauguaaaaauagaagcaccuuaguaccaacacauucccauuaaaagccaucuaaacuaaaggaugugugucaaagaauggaacuauguccagaaaagagagaaauacaagaugacauaauaacagaagaaauaugcaaaugugguaaaaucuaaaacuauauugacuacauaaacuaaaauuauaaaagugauaaugacuaauauuaaaguuaaaaaagagaacuaaaacucaggacaaaaaguagacuauagcaugauagggugugauuagaaguaaguuucaaauacugugauuaggauuauguucaggagaaagaucaagaucuuaagcuauguuggaauuuaauaaguauuuuugaaaaaaaauaaggauaaucccuaaaauacuagauaugacauacauacauuucaaagcaauuguaggggaaaucgauauuuuaaaaauauuugaucaaccaaaaggggggggagaagaaggaauaaaggaaaaucaaaaagaaaaagcaaaauaagaugguagaaauauauuaagaaauacuauacugaaaagacagaacuauugauuuuuucuuaaaucuagcaaaauacuauuucugagaagcaugucuaacacacaggaacuaagaaaauuugaaaguaaaagaauugagaaagguaacuaaggcaaauacaacuuuuuuaagaaaaagaaaauuaguaugguuacaaucauauaccaaucuuagugcuauaguauaaacguauugagaucauuuguaauauacaguaguguuacuguguggagagguucaggcuucaaggugcuggugucugaauuugauccuauuuauugccccaguuguguuauuaaguuauugugcaucauguuuuuucuuaccucuaaaauagaggaaauaaugguuuguaucucauaguauuauuaugaggaugaacugaguaaauacacgugaaauuauugagcauagaauaacacucugaagcacagagaacucacugauacugagaaaaaugaggugucaaaaaauauuuuaagacaacacaaggaaaaaggcgcucugagagauaaggaagguuaguauacaaugaaaaaagguaaaauucacuacaaguuagaaaaauucuaaauaugucuguaccugauaacagaguguucaaauagauaacauuuucaaaacauaugaacccuacuuccucgaugaaaccuucccugaugacuguuucuuacuccaaaugcuaggucccuccccucagugcuucaguagcacccagggcauaaguuguaugauagucuccugucacacaguuauacuuccuuguuccucauuucucuccuucgacuaucugccauaaacucucugaacacugggacugcccucugugcucucacuaccgaguuaucauacaaacgugauaaauacuaagcuuccaaaacauguauguuuaaugaugaauccauaaauguuuuuguaagagaaaauuuaacagaugcaacuuuuaauuuguuuuuuaauaaaagaguaaaguuccuaaauauaugugggaaaacuccacacauuaucauacuucuucccaaccacaaaagcuauccucagccccaaugucauacagaauaucuugugucuucacauuucuaggggagaugauagaagccuucaucaauucuuccaggguaucugugaaucacaaaccuggaagaacugcuggcucaaaggggcuugauuaguugauuauaguucugcuuccucugccucugaaaacucaccaaaguaagagugaacugauuuuuaaaaaguauaaaggcugaaacgucaacgaaauaugaguacaacuguugggugagagauuucaaugaaguuuuuaaagauaaugaaguccaugagaagugaaaauggaaauggugaaaaacuacuuuaguacuuguggggagagguaucugugcgaggugagcuacaccacucaaugccagaaaggcucaaaaucaagaggcagaauguaucaugaaaagcggcagaauguaagguauagaagauaaaacuuggagauuggcuggggcccccuacaccacucaaggcagccauguaaccuucuguuccucccuaaaagauugcaagaguaauuaucagagaaucugcaacugggaaucucaauuggauucaguuuuugguggggaaggguguguuugaaauugugucggggugaaaauggcauaauuaccaauguuacuguaaaacagacaguaauuugcaguaacacaaaucacaccaguuguguuacugaguuacuuaaaaauugugacucacaguuugucaucaucucuuaaauagagaaaauaauaguaucuauuucauaauaucaucaugaggauuguauuaguucauucucauacagccaugaagaacugccagagacuggguaauuuguaaaggaaagagguuuaauugacuuacaguuccacauggcugaggaggccucaggaaacuuauaaucaugguggaaggggaagcagacacgucuuacaugguggcaggugagagagagcaagaaggaaaaccaccacugauaaaaccaucagaucucaugagaacucacuaucaugagaacagcaucggggaaacugcccccaugauccaaucaccuuucaccagguccuucccucaaccuguggggauuauaauuugagaugagauuuggguggggacacagagccaaaucauaucaaggaugaacugaguaaauaugugugaaauuacugaguguauaguaacacucugacccaguaacgcucacugcuacugaggaaaaugacgugacaaaaauauuuuaaggcaacaccaggaaaagggccccucaaaagaaaaaagggaaauuccucuuuuccuauguuuccagaauauagccagagacuaccggcuccuccucuggaggaagcauacugucucaauggaagacuuuggggguagaacaagggauaugcuaugucacaaaucauuuaauaaauccaucagccaacaagcuucaccuagagaugaacacaucuucaaagcacuuuacaguaugauaugcacaggcauugauaaccuagacuauguaaccauauggauaaaugauucagaagccuugguucagauuauuaaaaaugaacuaaaacacaagugucgauuucaaauaaaugcaaugguaggcaagauuugaagaugaauguuuaaauugugguugaagaaaaauacaaauaucuaaagaggccuauaaauaaaugacuuuuuacugguaacagugaaaaaaacauguuacaaauagaaaaguagacauuuagcuauuuaguugaacucauaaagggccaaauuucuuuauaagaaggcuauaacguuaguugcuuuuuaccuuccuagucauauuuuugagaaauaggaauauaauguacauauguuuaaguaagaaaaaaaauaaaaguaaaauuugaauugcagucugaagguuuguuuacaguuuccaauccaaaugcaauauuauugaaauauucgagauucaucucugugaaugaguuuuauuguccguauggcuuucuauucuuuagacuaaacucccaucaucuguuaggaagacacauaaaacaaagggauuugcagucuauguuugcuuuuuuuuuccugauaaauuuaucuguaacaagucaucuuuucaaaaguauaaguaaaauauuggcaguuuauauuuuuauuccaucuccaauguauaucuucuauacauaaaaaugugcuagaugaaauauaauuauuuacuauuuacaagaugaaagccaaaccaaaccaacaagcaaaaaacaaacagaaaaaacagaacucaaguauaauaaacuaaaguucucccugcucugguucucagugguauacaguucauacaaacacuacuaaauuccaggaaaguuucugaccacaguauuaucuauuuacuguuuacaacuagaaacaguucucaagacaaugauaacauuugucaaauccagaagucucuguuauaaauaauuacucucaaacaguauuucaauguucucauaaauauauacacauauacucuuucauuggguuuaagcugucaaaauaauuuaaccaguaaaaaauuauucuacauuugaaguaaaaaguaugaaaauauuacuucagaaaguucaaagcuguagguuauuugugcaccuaccuaaaauucauaguaaauggcaguuuaaaaaauuuaaaacuacaucaacuucugguuaaaaaaaucuaguaagacagacauuuuuugauaauaugaaucaccgaaaccacgucagccaccuugaaacuggccauuuugaaugcuguaaaaauggcauucuagguuacaaacaccaucauggguuaaaacgggaaauucuuuaccuuuucucagugaggccccucuaaauagagagagccuguugauauuacuuucaggcuauuugacuauuccucaugaaauuacaaaugcuaauugcccuuugaaaguuaauuuuaacaauaacggguuagaauagagucaagucuucgagggacacgaugugucccuggacgguacgaucaguuagauuuuaauaaugugauggaauauauuaacaaauauaggaaagaaugugaacaggggcuuggucagcaaagaaagcauaaaaagaaaggggagacagagaggaagugaggauauggcccaguuaagcagugcccauagacagggagcuuugccaggauguuaaguaguggguuuccauuggcugggccaucacuagugcacagguagguggagucuuggcuaauugacucaaguguucugaucccauugggauugugguucaggcucucucacuugaugacauuuuuuuuuaaaaaaguauuuaucuggcuaaagcuuccuucccaucaauuuucaagggagacaaggucucuuaguauuaauucugucauucaaagcaaacuuagaugugcagaauaaauguuauaaugguuauaauguauaaaugaugauacugaguauugagugcuacugaauuacuuacuaaauuacagaaaauugaccuaugucucuugacuucuguuaagagugggagaaaaaaguuccugggauagaguucaggaaugaacaguugaauauaccaacuuaaacuuaggaaagcaaugauaggagccacacacaagaaagaugaaauguuuuaaaauagaaaggccaaaaaggacauuaaaauaugcccagaauagccugugucuguccuuaaguggucucucgagaacauucaugaucuuacaguuauaguugccuuacacuaggguaagcuguuuuuacucuaauaggcucagaagacucacuuugucagcaucccaaaacuggauuucuuuaucuuucaggaguaagagcacauuagcuaaguuuagaagagugcuuguuuauuaaugaauuuaaacgagaacuguuacuguaacauggaaugacagccugagcccuaugcuuucucuaagcaggcagggaaaauauucgaaauguuuuagccuacugucacuguguuguggggaauacuuguuuuggagagaugcacccucucucucacagcccuuugugguggcuaccguacuugucaucuacuggaaacucuacugugaaacaagauuuagggacaguguuuacaucaccuuguucauuucugaacauuacaacauaccauuguccauuuccuccauauguauuuauguauauacacaucuauaauaauauauaugacuauauuuuauuaaaaugcauaacaaaaugcacacacucucauacauacacauaggacauguauacauagugcauguacacauaagugagcaccccuggagaggcugucagagggaacaaaugagcccucuauuucuuacaacaucgaaugagccucacucagguuuaguggugaauguucuucaagccuauaguuacugcccugugaaucuaggagaacuugguaaucuacagccucugcaacacuacaaaagacuaaauucagucaagaggaaaggcauaugaaaguggagaaauaaguugucaggcaaaaaugucaauuuucaugaauuucaaagcauauaaaaauuaaaggucuccuucugugcagucaaagcaaaggcuaagaguuaaaguaaauguaauaauacuuuuuuauuauucacuaggcuguguaucuuauauaaaacugaagaaaagucaauaguaguacauaaaacaaaccagcauagaaagguaggcugcaauuucuuagaaaauaaaugggguuucuucuuagaaaaucauucucauaaauguauagugcuuaaauuuaaccacaaaaauauacaaaaguagaucacucagcuaauuccaaauccguaugauauauauggucgugaauuuuacauuguuugauuuacuaauaucuuaacuucagauaugaaucuucauaucaaugucuucauuuaagcaauaggagggcguuuggauugaauaaauucccuuugugaggugaauuuagcguuaagguuugaggcaucugaggcuauuuuaaauuacccauucauugacagucaguuauagcacaugcaauauagcuauuucucuuugauauuggagcuaaacaaacaaaaacauauaaauaguauuuuauaagcaauguucccagaaaaacaccuuauuaaaguaacaauugguaauacuaagcauauugaaaguugacuuaaauguaaaaucaguaaucauuauuuuuuaacuuucuaaaugcagcuuaauuucuaauuaaaaaaauaagugauucucucuacuaaaaucaaauucaauguaaagaugcaucuuuugaucucaucuaauagaacauugguaaagacaguagucaggaagucuacugagucaucuaaaacauacuaaggauuaaggguuauuauguaucuauauauuggguaucuauuaggcauauugucuuacauaguugucgaucagaaaaggaaagauucaguggugugcuggucaaccaguucuccaacaaaauaaacccuaaaaacacauccugguuuguagcaucugcuauuguagauacucccaucaugguuaauuucaaguuacaacaauuuaacaagcgacucacggaauuccugaaaauuuaaccaucaguuuucuugagccagucuaagcaagcuccagcacaccacugcaagugauagacaagaaacgacugaugugcaaagggugcucagagagacaaugacugccccaaggacgugugguguggcuucacaaaauagcucugucuuaaaagaugacuaagaauuuaucaaauacagaugcacggaaacaguaucucuguugucauggacacgucauuguccauuucuuccauauauauuuaaguacacacaaauauaaucaugcauaugacuauaauauuuuuaauuaaaaucuguagcaaaucgcacacacucucaugcacacagaguaugcacauauaagugagugacccauacacugaggugacaacugcaaccauguaggaaauacggaagauguuacuguguuuggggagaggcaagggacagaauuucugaggacuacaggaagcaacaagggcuggaacaggaagccacaaagagccacacgaaucuaaguccgcaaggaccgaccacgugugacaagcuaggaaauaucacuuucuuaugggcaaugauuucuuuucauacagacaguaugaauucgauuuguuauuuaugcagguaaauacaaaggcgagauuguagagcagaauuaaagccuggaagaccaauuagagauaugcugcaauauuaauccaggugaaaguugaggagggccucaaucaggcaugggcaaacuaugacccuuaagccaagugcaaucuguuguuagaaauaauaacuuugaggaacaggaguauguucccucauuuacauauugucuacgacugcuucugugcuacaauggcagaggugaguaauuuugacagagaccauauggccuccaaaacugagaauauuuauuaggcccuuuauggaaaaacagacugcugauucuugacuuagaguaagggagcgagaaagaaaagucagaaacgauuuugagaaaugauuuacuauagaauucaucguacaugcugguggauguguguaguaggagaggaagagggaagucucaugaacaaaccuuaguuucuauuuggugacuguguucauggucaugucaguaacuugcaccaaaaacaaaugagacacguuuagcuugggggagacagagaaugaguuugguucuggacauggucaguuugaaaggccuaugccaucuucaugagaagauauccaauacgaugcuggaaauaaagagucacaaaagaagaaggaauaaacuaaauccaaaauagcaagugcuuuuucaaguucuaacaugguuauaaaauauccuuuacuuugugucuauaaaauaaccugguuauaaaguauuuaacgugguuagaaaguauucaaagucucccauacuuuuuuccguuguauagaccauaguccaaaaguccuuaaacucagcaaguuacuacuugugaccuaauuucagcaaagcaucccuccuuucugcuacuucucugccuuccacaaguuuugcauuuuaauguauugauuuacauuucaauaacuguaucucuacuguggguccccaaggaaaggaacuaugaucuauucauguuggcaucuuauacauaguagguaucuauuaauuguuuuuaauuacacugaaugaguugugagaaauaccaacucuguuuuagcugggugcuucagcaauaagaggaacucuuuuguauuuagaaagaugugauuggcaaaagcaacugcgagauaaucacauaagucaaacaaugcccuugauacaugcaugcccuuauuuuaaugaagacuuccauguuaaaaagguuaagugauuugcccaaagguugcaguagccagagcugcuccugcucucagacugacccuuccagcucugaccgggccgugggcagaggaaaaggacaggaaccaagcagugggaguguuucauuaucucucuguaacaucuacagaacaaggcugccaucauugaaaugccucaaaauauuagacacucuauauuucaaguaaguacaaaaguacuauuuaagagcuaaagcaaguuuccaggcuugccacuguuugcagggagacagaaaaccaaacccaacacaacucaacugacauucuucagaauauccucagggaugcccuacucaauuguccucuaccuccuucugugcuuagagaguugaccagcuguccagaaugacccugaaccugucacagacuucccugcccaggcuucuauguagcuagcacauggugacuaauccugacuaauaagauccaaaauaaaaucuguuagggauucuggcaugauacuucucacugaugguguauauuugugugugugugugugugugugugugugugugugugacagagagagagaggaaaggagggagagaaagagagaggaagggagggagggagggggacagaggaggagggggaggggggggagagagagagacagagagagagagagaaagaaagaaaggcuuuuccucauccuuguauguggcuaugugagaucaaccaugccuggaaggaccugaccgcaaagguuagcccauuacagaugguagagugaaaaguaaagugucuaacaccaaugguccauggcauuaaccaaaucuaggauucccacuuuucaggcuucucauaaaauuuuuuaaaaaugauaauuuacaaaaacccucuauuguuuaaccaguguuugcccaccauucucuuaacuggagccggaagugugauaacuggcacaguccugagauggaauggcuuagguucauuuaggugaugaguggccagaauaagggugguaaauucuuccauuugcugaguguguuuugccuuuucuguuguguggaugagucacaugauagcaugggacaaucuuucuuccugcuuugaguuuugcuguuauuuaauauuauuauguucuuuaaucauguacuggaucaugcugggacuagccuuauagcaauuuuaaaaguucucuuuugcagaaucaauuagaacuuuuauuucuaggcauucuggaucucauggccaucuggucauacaacuuuucacacaucuuuacccugcugugacacuagagaacggccucaggcaaaggagacaacagcugccaaacacucguuuucauuaacugguugucauuucucugccaauguagaggugcauuuuagaacucggaauucccuccaauaggauguggcccuauuuccuugcugaugugccucucuucaauaaagacauuuacaaaaauaaagcaacaggagaaaguugguuuuuaagaaaaacuaauuaaaacaaugcauuggagaguggucaccauguuaaauuaucuuuuguguguuuguuuuggugcuuuuuguauacaccgggucucacuaugucauccaggcugguugugaacuaaauuaacuuguuugauccuacaauaaaaaauaaacuucacaccuaaacuuuugagaucuaaagauauauaaauaauucuuuggccgacaauuaggaaauauacaguccgcuccagaaaauauggaacuuuuacgaaaguggauauauaauaaauuauauugcgagucucuaaaaugucuaagaauaucucugauuauaaugcaauuauauuagaaaucacuaauaaacauuggggugugugugugugugugugugugugugugugcgugcaacaaauucguaaaaaaucacuuaaaaacauaccuggacuaauaaaacuugauuguggauaucaaaagauacugaacauaacuaaacaauaaugaaaguacugcauaacaaaacuugugagaugcaacggaagagaagauuuaagugaaauuuauuguuuuacuuauacuaaaaauaaagaauauaguaucaguugagaauucaucuuaagaaguaacaaaaaugaaaagucaauacaaagaaggcagagagaaggaaacuaugaaagaauuagauuuuaugaaaaaauuuauacucuacugaaauaaaggaaagguaauacaaagaaggcagagaaaaggaaauuaugagaaaauuagauuuuaugaaaauuaugaaaaaaauuacagucuacuaaaauagaaaacugaugagaggaaugagugagucuaagaacauauucucuggaaagauaagacaaaucuccauugagacagauaaagaaaaaaauggagaaggcucaaguggaggcaaaacuuuagauucauuccagauuaaaaagcuaaugagaauccuaugaacuuuauguaaaauuuuggaaaucuaaugaaugggauaaaaguacagauugugauauaauaucuacaaagaacagcacgccugaauagccuuaagacuauuaugcuauuugcaucuaaaauaaugacugugaguccagguacccaggagaaucuaaugaaaauucuugaugaaggaaaggaccuucaccauagacuucaaagaauucacacaaauaauuauuucagcaucauaaucagugccgaauaaaaaacggccaacuauuuaaggaaagagaaugaaagccagcagaacagacuggcaaauaauucaagaacuaggaaaaucagcaacagauuauaauguauuuccagacaaacaaaaaucaagaaacauuaaguagaggaaauucuaaaggauuuuguuuccuucugagauucuagaagcaaugggaaacagugggugacuauguugauagaaaugaacaaauaauuauaaaauaggaaauauaacuuuguaagacuaaaaaucuagaauauauauuuuacacuauaauguaaaucuagaaaguguuuuaaaguucuugaaauaucuaagaggugaguaaagagacugauaauguuuugacauauuaaauauccauguuuuaauuuuuaggguaaccacuaaaauaauagaaagugaaguuauaacauucaaaaagaugggggaaauagaauaguagaaaauauuuauuaauuaauucaaacauucaucugacaaagauaaugugugacaauagccagaaacaauaggaacgacuuuauauuucuauucauauaaguuucuuuguuuuuuuuuuuuuuuuuuuuuuuuucuuuuugagauagagugucucuccucugcugcccaggcuggagugcaauggccuggucucgucucacugcaaccuccgccuccuggguucgagcugggauuacagguacccgccaccacaccuggcuaauuucuguauuuguaguagagacgggguuucaccauguuggccaggcuugucucaaacuccugaccucaggugauucgccugccucugccuccucaagugcugggauuacaggcaugagccacugcacucggccuauucauauaaguuuuaaaaacaggaaaaacuaaguaaagaauagaaauuaaagaaugacaaaaaauaucccaaauucacacuagcuuacauagucuauaugcugcuagaagaacaucucuaauuggcucuugguuauaaggguucuuuuacuuaaaaaaauacaaauucuuuuauaaacucuuuguuccugugacauaguauaucaaaauuaaacauuuuuaaaacgccaaaguaauuuuuaacauggcuaggaauuuuuuuuuuuuuucccgagacugagucucacuccgucgcccaggcuggagugcaguggcgcgaucucggcucaccgcaagcuccgccucccgaguucacgccauucuccugccucagccucccgaguagcugggacuacaggugcccgccaccauucccggcuaauuuuuuguauuuuuagcagagacgggguuucaccguguuagccaggauggucucaaucuccugaccuugugauccgcugguuaggaauauuuuuaaccaacagaacuuaaagaagugaaauauucucauaagccuugucuuccauuaacaucaaggaaugaccaaccauaaaugagugaacacugucuggaauuucaugauuuauuauguaaauguaaaacagucugauggaugacagcauguuucuucacaugacauagaagaaacugagucccuuuuaacaccagaaaacaucauagcagguugacagcugauauacaauuguauauguauguaaugauaugugaacaaauacuuaaaguuacacauauaauuuucuaaguguucaguguguacauggaaauaacaaaacuagaaaaaguuggcaauauuacacagugacacucauuuccaaugaauacuuauuaccaaguauuuuggaucuuuuauccacauucuucuuagcagcauguagacuagcuuauguaagcaaauagaaagagauaauauaaaaagauaauguaagcucucaacaugauuauuugaugagagauaauaucuuaaaaucuguuaaccauaagggaaagaaaaacuacuagaaucuuacuugaugugcauuucuuuucuacaagcauguauucuauucagugaucuucuacaaguuauuuaauaacuuggacaauguaggggucaaacuagcauacgccaacuguugacagaaacaagcgaggucuauauaacacaaaaagcuuauuuaaagauuuauauaauuucaaugucaugaaagguauauccaaggugaaaccaacucuaaaacugcaugugcuagauguaguuuuugaaaacauggcauuggagaauugagccuaaauagauaaagaauuacuggcauaauuacuuuuuuuguauauuucccuaaggcccuauaaaugccauacaauaaaaugagaaguuaauagaaaacauacaaaaaaucaagaggcaauugaauuggaaaugacuccaagacugaguugauagcaauauaugcuuuaucaaagagucuauuuggugaugacugaaucauacagauuuauacagauccaugaauuugagguaugaucagaauaaagagaacauuuuuaaaaaagaauguguacaagaaaaauuaugccucagcuaaugugcaguuagaaaaauauggaaauaaucauuaaacuguguaacugucuuuauacggggugacaaauaacagucacauucucuuuacaaauaggugucuuaguuugagcugcuaugaagaaauaccauagaguuaaugaauuaaacaauaacauuccuuuuucacaguucagaguuggggaauccaagaucaaggcaguggcagauccagugucaggagagggccugcauuccggcuuguugacaguaucuucucaccauauccucacacagcagagaguaagcucuagucuccuucucuuuuuauaggagugcuaaucccaucaugaggaccacacucucaugauaucaucugaaucuaauuuccuuccaaaggucccaccacguauuagcaucccguuggaugcuaucaccugagccacaggugaagguucagacccacugacccauuggaggugaggguuucaucuugauuguaccucaaauucauggaucaguauaaaucugauucagucaucacugaauagacucuuugauaaagcauauauuguuaucaacucugucuugaagucauuuccaacucaauugacucuugauuuuuuuaauuuuuuuuauuaacuucuguauuucauuuuauaguauuuauagggccuuagggaaauauacaaaaauuaugccaguaauucuuuauccauuuaggcucaauucuccaaugccauguuuccaaaaacuguaucuaggacaggcaguuuuagaguuggcuucaccuuggguaugcguuuuaugacguuuuugaagggacacagauaugcacuccauaacacucagcaacuacuguaauaguuaaagauaacauaaggaauaggaguaaagaacauucagucaguaugccuguaggugagguggcaguucuaaauuauagcuacaaaugccucaauauccaucccagucuacaacucuuccccuggaaucugagaauguuuaugauuacugugacugacagaucaugguggaagugacauuaugugaugucuaaggcuaggacauaaaagauaauacagcuuaggccagaagugguggcucaugccuguaauccgagcacuuuguguggccgaggcaggaggaucucuugggcucaggagucugagaccagccugggcaacagagugagaucuugucucuacuaagaguaagagaaaaauuagcuggugugguggcaugcaacuguaauccccgcuacuugaaaggcugagguggaaagauuguuugaguucaggaauuugaggcuguagugagcugugaucgcaccacugcacuccagccugggugacagagcgagaccuagucucaaaacaaaccauaacaaagcuuacuccuuuacugaaaacacucaaucuuggagcccugcacuguuauauaaaauacuuaaccagccugagacucucuaguuggaagggccacaggugagggcucaggcccacuguuccagccgaaugcauccuucaccuuucccagucucagugucaaacacagaagugaagaagcugucaggugauuccagcuccagcucuugagaauuuugaguuacccccuuagccaucugauaucaugcaguagagaagagccauccucaauauucugggucuaaauuccugacucaucaauaugucauuguuaaaaauaaaaaaggugacuaucuuacucaauaaguuuaucuuacucaauaagacuaucuuaucuuauugaguaaguuuaucuuacucaagauguggcaguuaaaaaaaacagacaaaauucuuugaacuuucaaauuuauaaucaaguuuauauucaaguuuaucuuacucaauaaguaaguuuaucuuacucaauaagacuaucuuacucaauaaguuugagguuguuuuuugugaaguaauauauacaacuagggaacuaugcacuaaauaauaaaauuaauccuaggacacuuuauuauuagugagaagauaaggcauaacucuugucuaacacaacgugacuuaaaaguuaaauuauacaggguauagauugcauuccuagaaaucucugaguaagcaagaacaagauagacagaucgaauaauggaacaucuuguugaaaauugcaaagcaugcacacaaaacugaauaaccuaacauuauauuauuaguguucauauagcaagaauguauaaaauucauuguugucagaaaaucauggacucugcuagcuuaagguacuuuucagaauagguaaaagaguauacagcucucaagaagaucauacauccuaaaggaaaguuuuucauaauugcuuuccaaauucauuugcacuguguagcucuuguccuuggacuuccagauuauuuaguuaaucuuuuuugguuuucuauauuuuagguuuuuuucuuuaaaugauaaguuccagcacuuugacuuuucuuggcuuucuacaaucuccagccuuuaugucugugaacucuuacacccuucauugguauaauauaaccuuugguuguuguuuugggcuucaugaccuucaguugaaaauccuucuaauggaugaauccaacccauugguaauguucaaggaaaccacuuaccuucucugaccccuucugcgaccaccuacauaccuuuucauauaauuuuguugccuuggccuuaaucuucucucugcugauuucauuuagggauggggaguuggaauggcagguggggggucgaaauggcuggugagaauucacuggaguguccagucacuauauaaaauuaauaaauauccaugaacacauaggggucauggagacaucagaaagaacacagugugacaucuacagaggguacagagaguuuuuuuuucaaaagaaauauuuaugguagaaaggaaugugguacacugaggauauauaaagagugaaaaaagcaccaugaaugccuuagauagagaaaucuaaaguaguaagaguuaaucaagaaaauaagccaaugguaucaauuacagaugcacaauaaauauugaaaaauuaucucaugucuuuaaagauagggacugguauggucaacacacuuuuggagaaagaauuaaaauuuacuuucaaauauaugaaucacaggagacacgggauaaauaaaagauuaagauuacaauauucaacuuuaggagaccuuaacauacugaaauaucauaaaaauucaaugauuauuuauauaccaagauauagacuagauaucauugcugaaccacaaggaugaagacacaggaugaaagcuaagggguuauaaauaaaguuuaugaaaacaguaacugaauauagggacauauauaaacaaauuaggucaaagcuugaagccaugcauaaacaagauguuuugaauacuaguagugguguauauuuuaguuuucuaggauuguuaggaguuuuggaaagaaacaccuaucuuuaauauacgauugugucugcaugccagguacucauucaguguccaaagauguggcaguuaaaaaaacagacaaaauucuuugaacuuucacguuuauaaucaaguuuauauucaaguuuauguuguuuauaaaaaacaauaagcaaaugaauaaagaacauaucauauuaggagagguaagaguuuuggaugaaaaaauaauuaaauuaguagaaaagaggguuagggaguagagagguggguggcaggcuguuucuacuuuagggcggucagggaaggcuucaucaagaaggugacauuugggcaauauuuugaagaagaggagacaaguggccaugugagcaaguaagagaagaccauuccaggcagaaggaacaggaagugcaaagauccuggggcagcacuguucccagugugcuaaacaaagagcacaguuaaagcagaggcaaugaaggagaaauagcauggggugggucagaaacauuccaaggaccuguuguauaggacuuuaaaggcugauucaaggaugugacuucuuuaguaguaaaauggggagcauugaaaggucauaaggagaggguaaaaugaucuggccuguguuuuaaaaaaggaugauucugcccauugugcugagagcaggcuauaggcaaagaaggguggaaaagggagaugaauucaaagaucacugugauaagccaguaaagcgaggugacagcuauaggggcucgggacagcagguagcagauuuugcucauacuuuuaagauaaaggcaacaggauuugcugaugauugagucaaagagaacuccaaguuuuacaguaugaguaauuggaauagagcggccauuuacagagguggagaaaacugaaacagaacagguuuaugaacaaagauuaagagcacaguuuugagugauuuugaugccuauuagacaucacuaugagaugcagaaaaguaaacuaaauauucagcuuguuuagggauaacuaaagcauagguuucuagagauuaagcaaguuuaaaaugaagugugccagguauaagacaauuaccuuugagcuagaugugccuaauggucuuaaaaucccuuuagaaaacacuauggugcccaaaaccguaugucugcaggccgguuuugacuugugagcucagcuuuaccaaacaaggaguaaacagcuuuaacaaaugaggccauuguguucaucuaugcuuagggaguacaugaauagguuuucagaaauaaaugcuuaaggugauuccaaagcagccugagaauguuuuugaggaauggcaacauuauuauaauaacuacauagcuuuugaagacuauuagaagcuaaaauuucauugaaaauaaauaaaauuugcuuuuuuuuuaauuaggagaaaaugcuugguagucacuuuuauguguauuaagguugaagucuggaauugacugauacuaauauucaucaucuacccuuuacauuaguuaaaauggaugccauaaaucacacaugaauaaaaauuauagaucguucaaacauuuguuaaauuguguuaaaaaugacugcaaccuauuacucagcuauguuuacucaaugagcauauaaugauuaauuuacuuuauguuuuuacaaauaaguauuucugugacaauaacaccuacuuacuagaaaauuccauaggagaaauuuauggguaauauaauuaccauaugauauuuucauuaaaaaguacauaucuauuugaugggcaaagguuugcuuauagagaagaggaaaauaagaccacccaaaaacugagguuuaagaaaaucugcuuauuuuucaaauauguccaaaguuuuuauaaguauguauuucugugacaagaucuguuuacugguaaauugguaaaaguacacuuauuugaaaacuaaugcuuucuuuugggaaaaugcuaucauucaaguuacauuuaccuucagggcugucauuuccuaauuuuuaaaugcaugauaucauaagaaaguuuuuaguauccaauuuauuacauaaaucacacuggugccuuuucacagauacuacaauuaaaguucuaaguguuauuuuuguuauggugcaucuaguuuggaauggauguggacacaacagaagcuguaaauuuacuuuuuguuuuucauucucaauaacauuuacacagcaggcaacugguuaaguaucucucaggggucuuuccaaggaacguagaagcuuuauuaacucauuucccacuguucugacuuuagaaaaaaauccugcacuccagaaacuacuuaacaguaugaaguuuagagggaggaaauuauaacaaaaaaaguguucacuagauggacaguaucaugacagaaaccagugggaagucugcuaagcuagacuauaaaacaagacucguguccaggagaguaagucacacgugggauagguuuguugauccauuuagucaacaggugcuaauuaaggagcagaagacuaagaaacaucaccuugaauagcaaaacuggaagaagaaagggcaaaaaaaaauuauuaaaauauuacucauuucaguaccgacugcugcugcauguaggaucaacagauuccaucaccuuagaucacuggcauugccaagacuucccaugaagaggagcaacagcuucuauuaaguaaggaaaaugcuuccugaagccgagcuccacaaugcuaagaaugcuguguggagaggaaggcucugucuggcccuacagcuggacucagcuuuaucacgacccagucuagaugcaggagcacagaaaacaaauauaucaagaagagagaaauaaaguuaucugguuauuagaaaagucccuguagucagauuucaaguucacuuaucagcucuccaaaaaauagcuagaggacaaagggguagacccagaaagaauaauaauaguaccugccucauagaauguuugagaagauucgcugaggucauccacauaaauaacuuacaagaagaugagcaauuagcagguuuugaugacuauguuacaaucagaaagauggaggucagaguuugaaugaaagacaaggauauaauuucaagugguauuaggugaguucccaauacagaagaugacuuuccagaugucacuacuaacugguggccauuugaucucaguuugguuccaacuugcaguaaaacuuugcucaagacacagccucaaagaaaagagaagagaguuucacaaacuuugaaugaggaagaggccauacagcgaccuuccauuucacuaaaauaccaauccgaauuaugacauuauauuuucccucaugaaaaaauggucaauggcuuauguacaaauuuuacaguacaaaguguuuuuucaugaaauauuucuuguaagccuacuaugaacaugucuuucacuuagacuauaauaucauuuguguucccauaaaacuucaauagugguaggugagagaagacuuucuuaaaacuagacuaaauacuaaauaaagaauucuuaccagcuuaagagauuuugggcuaagacaaugggguuuucuaaauguauaaucaugucaucugcaaacacagacaaucugacuuccucccuuacuggaacaccugcuauuucuuucucuugccugauugcccuggccagaacuuccaacacuauguugaauaggaguggugagagaggccaucccugucuugugccaguuuucaaaggggaugcuuccaguuuuugcccauucaauaugauauuggcuguggguuugucauaaauagguauuauuuugagauaccuuccaucaauaccuacuuuauugagaguuuucagcaugaagggguguugaauuuuaucaaaggccuuuucugcaucuauuaagauaaucauguaguuuuugucuuugguucuguuuaugugauggauuacauuuauugauuugcauauguugaaccaaccuugcaucccagggaugaagcugacuugaucaugguggauaagcuuuuugaugugcugcuggauucaguuugcuaguauuuuauugaggauuuuugcaucaauguuccucaggguuauugcccugaaauuuucuuuucuuauugugucucugccagguuuugguaucaggaugaugcuggccucauaaaaugaguuagggaggagucucucuuuuuccauuguucaggauaguuucagaaggaaugguaccagcuccucuuuguaccucugguagaauucgguugugaauucgugugguccuuggcuuuucuugguugguagauuaauuacugccucaauuucagaacuuguuauuggucuauucagggauuugacuucuuccugguuuagucuuggguggguguauguguccaggaauuuauccauuucuucuagauuuucuaguuuauuugcauagagguguuuacaguauucucugaugguaguuuguauuucugugggaucaguggugagauccccuuuaucauuuuuauugugucuauaugauucucucuuuucuucuuuauuaaucugacuagcagucuaucuauuuuguuaaucuuuucaaaaauacagcuccuagauuccgugcuuuuuugaaagguuuuuuguaucuguaucuccuucaguucugcuaugaucuuaguuauuucuugucuucugcuggcuuuugaauuuguuuacucuugcuucucuaguuccuuaaauuguaacguuaggauaccgauucuagauguuuccugcuuucuccugugggcacuuagugcuauaaauuucccucucaacagugcuuuagcugugucccagagauucugguacauuguguuuuuguucccauugguuucaaauaacuuauuuauuucugccuuaguuucauuauuuacccaguagucauuggucuuaccacgucccucaaguauacggguuccacuuuacucgaaacaauggccaugaucuggucacuuaaagcuccucaagccagaugucaaguugucucuguuugcagaagacaugauuuuauauuagaaaaccccaucgucucagcccaaaaacuucuugaaaugauaagcaacuucagaaaagugucaggguacaaaaucagugugcaaaaucacaagcauuucuauauaccaauaauagacaaucagagagccaaaucaugagcaaacucccauucacaauugcuacaaagagaauaaaauacuuaggaauacaacuuacaugggaugugaaggaccucuucaaggagagcuacaaaccacugcucaaggaaauaagagaggaaacaaacaaauggaaaaacaguccaugcucaugcacaggaagaaucaauauuguggaaauggccauacugcccaaaguaauuuacagauucaaugcuauccccaucaagcuaccauugauuuucuucacagaauuagaaaaaacuacuuuaaauuucauauggaaccaaaaaagagcccauguagccaagacaauucuaagcaaaaagagcaaagccguaaccaucacacuaccuggcuucaaacuacacuacaaggcuacaguaaucaaaacagcaugguacugguaccaaaacagagauauagaccaauagaacagaacagaggccucagaaaugacaccacacaucuagaacaaucugaucuuugacaaaccugacaaaaacaagcaauggggaaaggauucccuauuuaauaaauaguguugggaaaacuggcuagccauaugcggaaaacugaaacuggaccucuuccuuacaccuuauacaaaaauuaacucaagauggauuaaagacuuaaacauaagaccuaaaaccauaaaaacccuagacgaaaaccuaggaaauaccauuuaguacauaggcaugggcaaggacuucaugaccaaaacaccaacagcaauggcaacaaaagccaacauugacaaaugggaucuaauuaaacuaaaaagcuucugcacagcaaaagaaacuaucaucagagugacuaggcaaccuacagaaugggagaaaauuuuugcaaucuauccauaugauaaagagcuaauauccagaaucuacaaggaacuuaaacaaauuuacaagaaaaaaaaaaacaucaaaaagugggcgaaggauaugaacagacacuuuucaaaggaagacauuuuugcgaccaacaaacaugaaaaaagcucaucaucacuggucaucagagaaaugcaaauaaaaaccacaauaagauaccaucucacaccaguuagaauggcgaucauuaagucaggaaacaacagaugcuggagaagauguggagaaauauaaacgcuuuuacaguguuggugggaguguaaauuaguucaaccauuguggaagacgguguggccauuccucaaggaucuagacccagaaauaccauuugacccagcaaucccaugacuggguauauacccaaaggauuauaaaucguucuacucuaaagacgcauacacacauauguuuacugcagcacuguucauaauagcaaagacuuggaaccaacccaaaugcccaucaaugauagacuggauaaagaaaauguggcacauauacaccacggaauacuaugcagccauagaaaaggauggguucauguccuuugcagggacauggaugaagcuggaaaccaucauucucagcaaacuaacacaggaacagaaaaccaacaccacauguucucacucauaagugagaguugaacaaugagaacacauggacacagggaggggaacaucacauacuggggccugucggggaguaggggaaaggggagggauaacauugggagaaauaccuaauguaggugacagguugauuggugcagcaaacgaccauggcacguguauaccuauguaacaaaacugcacguucugaacauguaucccagaacuuaaaguauacauauacauauauauauguacauauacguauauguauguauauauacauauacaugugugugugugucuauauauauauauaaagaauucuacaugcugaaacagaguugcgguuuauaauaucucacuuuauaugagugacuaauugcuauagagaacgauucaaaagaccaaagguugggcuuuaaagaacccagucuuuacuuaguaaagacuguuuacuuuacuaacuuuacuuaguaaaguuuaaguaucagauucauaaacuaauauuuucaucuaucguaucaagcugugcauagugaacugcuguuugcaauacuauuauuuagcaugcuaauggcaaagaauaauuuuaucuaucuacugccugguuuugaauuuuuuuccauguggaaaaaauauacuuuugcccuugaaacagaauaacuuaguaacaggcaauagagcagccaaaauaaauuaacaaugagaauucuaccaugguuaagggucucauguuuuuaagaaagagaaaguguacugaaucaaugaaguucuuugaaugugucaauaccauaaaguauagcaccaauuaguuacuuacuccugcauauaguaugugaagucccuaaacagcuucuaaaaacuguagagcuaguucaaaaauguuuuaaagcaaaaaccuuugacuucaaaacaggugaaaugggacaacuuuuauugaauaugccauuuaaauaccaaguaugauuagguuuagagguagaaaaaacuaucuuaacaagaacuguuaauuaaaauuuggacuuagaugaaguguacauuauuaguccugagggaagcaagauccucugccauaucucaaaaguguuuaaguacaauugacauagaacacaguguuacaaauuauuucuauuuguuacauuauagucauugcagaaaaguaauuucagacuugcugaauugcuuuuacauaaaacuaacauuauguuauaaauuauauacauauuucaaauauuuuuauuuccuugagucaugucagucaaauuucugagagcuaaggaaucugaggaugaaauacacauuaaccuaaagcaacagguagaacagaugaccuuagcugaugcuauuuauucauuuguuuuaucagcuaauuaaagcaaaacaaauugccauugaucauugaagaauuggcacauuuuaauuuagugaacacaauauaaugucuuuaaaggagauuuauucacggccauugaaagaagauuuucaccuuaaaucacauguucauauuaccuaaucacuugccuauuugccuuuaauuuauaagaacuucuugucuuggggaaucagauucauauagucuuuaucugcucuuuagcuaccauugaagauuuagcuuugaagcuuuccuuuuaauaauucuuugugauagaacacucugagacgcuugcuuggaguucuagugcaucaauacaaauuauugauuaacugauuuuuaaaggagggggcaaaaucaugaguuucuaaacucaugcuugcaauuuacauguuaugaacacaaauuuagacuauaacaaauauauauuuaacacuguuuucuagagaaauguuaauuacagaaauacaaauacuacuguuuuauauauauuaaacauaggcaaaacauaacuguuuaagaauaauuuauagucaucuaaacuuuagaacagcuauuauugugaaauucucagacugcucagaugcuauuuuucucuccuuucauuccuuccuacuccccuucuauuuuuuuuauaaacuaugcguuguucuaggauuauuccaggagcugcauaugaacaaauauaauaagcuaucaccugugcuuauauucagaaauuaguauaauauauacaaauuuauaagcuuaaauuuuuuuucuacauuauuagguguaaaacuaaucuagcacucaaaucauaaagagguaaauuaguauauaucagggcuuaauauauuguagaaacauuuugaaaccuaaaaacagugacuuuuacccaaccaaauacauuuuaaaacacugcaaagaagaaaaaauaccugaaguuuuugguauagagccaaagauaaucacugacuccaaagaaagauugcuugaaagcauugguuuaaguaagugcucuaauuaauaaaacuuuucauuccuuucuguaagaaaaaauuaauuuauauuaaaaauagccaaaugaaaaugaucauauuuguuauuuguggaggguuuucuaaaguuaaaaggacuuauagguauuggucaauaaggucaauuuauaaaccugaauuuauaaauuuaaauuuuuuuagguacuuuaaaaugcuuugguccaggcacauggacuaggaacaaauaguuccuauuuucagugcagggguguaaagucugguuuuuaaagcaacaauaaaaaguguuuuguuuaagucugaugucugcaguauauuguuuucucuacugaaugcauauuuuauacaauaggguacuguaaggcagcacugaaggggagaaacuaauguacagcagaaaaacucauugacuucacaaaugucaggaaaaacagccuaagucacacgugcacacacacacaaaaugggaacuagacaagaauuuuaauguucaauuaaauuuuauuuugaauacauaggauuuugccuuauugagaguugaauauuuaucaauuuuauuaaagaaucauacauuauuuaugggaaaugaguacuauaaaguguauaaaaguaaacuugucaauaaucaugauucgcuuagagggguauuacuugggcaucggaaauaggaaaauuuaaguuaauacaacauaaacuauuucacuuuguaaauaaacauguuuuauugcaggugauuucuaaaucuuguguuauuuucacaucagagaggagaaauuagaaaaugcacugaagaauucuguacaaaauugcauuuguuuuauucaagucuuuagaaauauauugacuuuuacuaaauaacaaacguguaaauucuuacuucaguuauuucuauaacaccucucacauauucuuuucuaacaucuauaaucagggcaaaggcccuacacuugcaagugaauaucauucauauuagaaacauaacaggaaugauguuauaauuuauaaauuuguucauuauucaugcaaaaaauauugcaauaauuuaagagcccaggcaugugggauaaucuuucuuuccagaugguagugguaacuaugaaauaauagccagaccacaaaaugguguuguagacagggacaaaggacaaaagagugucucucuugacccaccaacuccuucccaucucucaacauauaucuucagugauguuuauuuuguuaaugggaauaucauuuauuaaugauuuccaaacuuuaaacucaccaaaugguaggguaguacauauguucacagauaguuuuaaaaccaucagaauuauuauaucagcucugaguuccaauaagaaguauggcagauagacaaaugagaagaguucuuauaaucaaaugcgggauaucugcacuauaauguugauuuuuacaaauaacauacauuucuaggauuaucaauuuucucauuuaauuuggaauguuauauauuuuuuucuaucuaucuugacagguuauuauggaauccaagugucauaaaauuaaugaaauucacccuacaaaauagcaggcaccuaugucacuauuauuugaacuuaaaaauucacaaggaaaaauauuguuuaacuuaugaaaaguauauuuuuagaguugaaauucucacaguuuuaucuacuuuugcuuuuugagaauucaggucccuucauauuuaagcugcuaauaguaucuuuuguuuuaauauuucugauuuuuuuaaaauuuuacuuuuaauugacaaauaaguguaccuauucaugaaaugcacagugauguuucaauacauauaauguauaacggucagauuaggauaauuagcguauucauccucucaaacucaucuuuuguguugagaaugucgaaauguugaauauccucuuuuuagcuauuugaaacuauguauuauuguuaaauauuguuauccuacagugguauacaacaccagaauuuacucguccuaccuagcuauaguuuuguauccuuuagcaaauuuuucucuaucuucccuugccuuuacucuuucagccucuaguauccugugcuuuacuuuucacuucuaugagaucaacauuuuuaagcuugcacuuaugagugagaacaugugguggugaacuuucuauuccugacacuuacacagugucuuccaguuccauacaucuugccacaaaugauaggauuucauucuuuuuaauaggugaauaguauuccauuguguauauauaccgcauuuuuuagcucauucaucuguuguuggauaccuggguugauuccaugucuugguuacugugaauagugcugcaauaaacauggggguguagauaucucuuugcuauaaugauuucuuuuccuuuggauaaacgcccauuaguaggauugcuggaucauaugguagugcuauuuguaguuuuuugaggaccuccauacuuuuuucuggaguggcuguacuagcuuacauuccuaccaauagcauauaagaguucccuuuucucuucauacuugugagcauuuguuauuuuucaucuuuuugauaauagccuccuacugacggugcgauaacuuauugugauuuuugauuuguauuugccugauaauuaguaauguugagaauuuuuuuucauuuuuuuuuuugcuauuuguaugucuucuuuugagaaaugucuauucagaucauuugcccauuuuaaaauauauuuuuguuguugagaugcuuuaguuccuuguauauucuggauauuaaucuucuaaugaguagauggaaaauauuucuuccauucuguaggcuuuuacucuguugauuauguccuuuguugugcagaagauuugugcugugauauaaucucauuuuccuuauuuaucuguguguuugaggccuuauucauaaaaucuuuucccagauugacauccugaagcauuuccgcuaugucuucuucuagcaguuuuauuauuucaggucuuacauuuagguuuuugauccauuuagaguugauuaugugugaggugggggucuaguuucauucuuuugcauauggauauccaguuuucccaacaccauuuauugaagagacuacccuuuccccaugaguguucucggcauguuugucauaaaccagcuggcuguauagacauguagauuaauuucugaguuuucuauucuguuuuauuaguccauguaucuguuuuaaggccaguauuaugcugguuugguuacuaaagcuuugugguauauuuugaggucagguaacgcaaagccucuggcauuuuucuuuuugcucaggauugcuuuggcuacucugggauuuuugugaucccacacacauuuuagaauuuuuuucaguuucugugaagaauguaauuccuauuuugauagagauugcauugaaucuguagguugcuucugguaguaucugauuauuuuaaugguacuuagguaaguuaggaaacuuuuggauccaagcaaaagaauacuuugacaaauuggaauaaacgcuacacacacacacacauauauaugcauauauauauauaugcauauauauauauauauaugcauauauauauauaugcauauauauauauauauauaaucuuuucacauaagaggaaauacagagguaagguagucucuggugcccaucagcaucauauagaauucaaauucuucacaacucuucacucauuaucuucaguguguuuuguccuaacacaagcucucuuuuaggguugcaaacaaguccacugaccaagauugaccuacaacuacccuccucauucacucaccaucaagggaagaugacuuccacaaauggcucauauuuauuuuuuaauguggaauagcuaccuuuauucuuauagggaaggaccaaugauuuguugaucaucaaaaucugaaaacagauaagauaauuuuacccuagugccuugccucuguaauuauaucucuuccacuaaacaauaggcuccuccauguaggaauucauguuuucuucauuuuuauauccucaaugacuaguguguauuuuuuguucauaauaggauaaugaaugaaugcaugauuuuuaggagaauaacagugacuacaaccaaguaaaaacaggacuaagaguaacauguuugagaaaaaagugauaaaagcaaugguacagcaauggagcaguggagcaaguggaaaauaaaguuugaaagauaaauuugaaaaagacuacgcaaaguuugaaaggucagucuagauccacucuuugaagguugaaaauuaaauaaauaaauaaaaagaagaaacaaaaugucagucuauaaauuuuaaaauuugcuguguaaauugugguagucccugaaguuucugagauaaaauuaacaugaaaaaauuguaucugaacauccugcaacucucucuucaccacauucacacaacucauuugcauguaaguuuucagaucccuuuaauauguuuaauauguuuuacugaaaaggcaaugacugaugaauauagccagaaagaauaggauugacaauagggaugaauaaacuuuaaugcuuuaaaaucuucgauuaugggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccuggacgacagagcgagacucugucucaaaaaaaaaaaauaaaauaaaauaaaauaaaauaaaaucuucgauuaugggacacagccaaaaauaagucuggaacacuauuuacaaugucauauuuaguuuuccuuuguagaaauguaauacguuuugcagcuaucaaaaauauuucuuucaaauuucguaaaauuaauggguagaaaauuaaccuauuaacuguuugcggccuauuaauuaauuaagcuugagcuuaagcauauaggaauacacaggaugcuuaaaauugccaucucuuugaggguuagauucuaguuccuugcuacaaaauaacuaugugaugcuccuacaugcucacugacauucaaacauggaaauacagugauaaauuuaaauguaauuccaaaguauuacaaauaaucugaauauaguuccucuauaguaacucugcugaaggaaaaaaagaaaacaguagaaagcauguauugucuuuaaugaaacagaaaaaaacuaucacugaccagcuuuuuugaacaucaguuuuuaaauaggcaccuuaucuuuggcaaccauauguuagccaaguguuuuaacccagcaaaauaaagucuugcaguugggagaaaacuucuguauguaacacgccacauaauugaauacauaaacuuaacauucacuucacaaguucaacaaaaaaguaagggaaaaugucuacaaaugcgaagacauauauuugauccaaacaaggaagcauauguugauggaaggacauucauuuuauaauuaccuaugugugacuaaagaauuccauuuucaaucaacuaacagcaaagggaauuuauguaagcuuuuacauaaaguuauaaaguuuuaaaacuaucuuaucgaaauagauuuaagcagaguacuuucucccugcugucaaacgaguacaaauaaaaguaaacaugacaaaauuguguggguuuaacaugccacccacucagaauauaccaguuuucauuguuuucaguuguuuuauaauucagcguaaauaugacagcucuguauuuauaucugccacuggaaaauuucaggaugcauuaugaguacuggcucauaaacccauggcacauacuuaaauuuuauguguacaccaagaaauggauaaaaacacaaacaugucaaacuagaaaaagacauauaguuuccugaaaauuuuauauaauaaccuggaucuuuaauuuuguuacuuuaauuauaguaacaaaauaaaaagcuacaugacacauacaaaacaaagagauguugauuuggauaugcaggguuaccaucugucaacuacaucaucaucacuuagaggucaacagaagaaucagaugauaugugaaauauuuugauccuaauguacguuuauuaaaaaaagucccuaauuuucaaaaauauuaacaguaauaacaucaaagaauaauggaugcuguuaauccuuuaaagaacuaagacaaguaggagaaaacuaauuucacacauauuauucaaaauugucucauaaagugaucaaucauuugcauaaugcugaaguaucuacaaaaguuuuaucaugggguuuuaccaucuauguauaaagacccuuuaacagcacauuugauauauaccuuucagaucauucaguucacuuaguauuccuugugccacacaagcuucucugaagacuagcaauaacaauagcccagagaaaaauuaugaagcaguuaaaaucugucuuucgaguuuucuaaacauuuuuuuuuccuaguguuaccucugccuaaucagccaguucaauuuauccucuuagcuuuuggucagccuaagaagaaaaggacugacccuaaauaucuuuaaauguuaucauucacuguaucuugucugcauuuuaauagcauuuagagucuuuugcuaaaauaacagagcugcguggguagaauuuugggugaugggagaaaauggugagacaacaugacugcuugaugauucuaaaucagcgcuacuggcaacugcucauucuuuggagucaguggaaaagacaugggcuuuaaaaucacaaagucuugggacucagucucaucucugacauuuuuuagcuaugguaucuuuucagagucgcuuaaccucccuuagccucagcaaaucaucuacaaaauaugaacaccaguguugauuugaagaguaaaugagagaacaugugauauguuugauaggaugccuggcagguaauagguaauaaauaauuaucagcauucuucauuucaucuccaaaugacuggucuugaucuuuaaaucuggucacuuuagaaggacaguuugaaauuguggucuguaguuuugaugcccccauuuaugugguccuagugacacagagacacacacucacaugaagauaagcaauagagaauuaaccuggugaauggaaauuaaugaaaugucaugucacccaugcaccauauuuugccaaaaaagggagaaucgagaaucagguccaagaucaguauuaucauugccgcacugagugauuucaguacuauaaacuuauucauaaaauuaaaacuuuauauucacaauauuaaaacuaauuuaacacuuaguaaaguacuugguauauuucagagcaacaaaaugaaugcuggaaaauaaaaguaaauaaaggcuuucucuaguguaucaggaugugcccaaaguaaaauuaaauauuaaaaugaggcuccaagauagugggcaauucaucuuuuuauccacauguuccacuuaaccaagccauauuuuauugcuuggggaagacacagcuuuacgagggggaaauggccaauuucacucuuacugcuaacaucacuacaucuucuuuacaaaguaagcuacucauuauaugucaugaauaauauauuuagcacgagaccaagauuauggcuaggacaaccauauuuuauauugaaaaaaacacgguaaccuguauucgacuguuacgaauaacagcagcaaagaaagcgaucugcuucaccuuuuuuucuugguugaacugcuuaccauucaggaaacaauauauaggcuucuagcuggcaucauuuuacccuugcuuaaaaguucagugcaauucaacaaacauguauugauugccuaaucugcuuaagaguaaucaaugggaaaaucaaagguguauaagguuuuaacacauuagaaugguaaacaagcaaauuauuaacauacaaauuuuaugacccgugaaaaaagugauauauacaucacuuuuacauauauguauuauauauauaaaggaaggaauacaguggaggggcucauuuauucaugcauuguuuaucaacuuugggagcacccuuaguuuuguuuuuccuuuucuuaguuauuuuauuucagagggucaacacuuauuaauauuuuuaggaucacauuucauuacuguucuguuguggcuuguauuucugauugucucuuuuuguugcugcugcucucagguaaacaaguuauuuaaauuuuauuaugccaccuggguuaaauccuaaaaccuaauuuuguccuuggaugagcacaacugaaauugcuacggguuucacugauuuggugugcugaaguaaauguauguuucauguguaaccacauauaaguauagaaucuucuuuaaacaaccaaauauaaauagaagcuuggaaacauuucugacauuaaacuggccaccaguugaaaaaucagauaauguaugugaaauugccuugaaaauaaaaagcagcauggaugcaauguaacauuauuaucauuaaguggaaaugacagaucauaagcaaauguuuuuauagcugacauucauuuauagacauauuuuuucuuugaucaaagaaaacucaaauauaugucuuuaaauuagauacauuagaagccuuauaaguuagcaaauauugcauguuccauuaucauuauuuacauucugcuccugcuaugaacugaauucauauguugaaaucccaaaugugaugggauuuggagaugggaccuuugggauauaauuagguuaugagaguguagccuucauggcagguuuagugucccuaguagaagagaugccagcaagcuuccagucucucucagucaugugaaaacacagugagaagcuggccaucuguaaaccgggaagaguacccucaucaagaacuccaccaugcuggugcucugauuuugaaguuauagccuccacaacugugagaaauaaauguuugauguuuaagccucauggucuauggcaauguauagcaaccuaaacugauuaagacaguucuuaauguauauacuuaaugcauuacuauuaauguaagucaacuuuuaagaugaauaaaugguuucuuauauuuagauguguuguagcauuuguguguguguguguguguguguguguguguguauguguaugugugugugugauagccuagauuagaaccuuguuggguuugggguaggaguuguauauuaaaaaaaaaaucaucagaugauacugaucaagaucauccuaacaagucuuagccaauuucucaaugcuaauaaaagucucagcucauaucagauauuuucugauucuaaaaccucaggcucuugaaguccauguuguaucaaccuaaauaaguugugaaaaaaguucauaagaaguucaaccaacuucucagacaauuccauuuuuaaucuauuuauucacucuacauacaguuuuucccuuuuuauuauuuuuuaaauuuuuuuuuuauacuuuaauuucugggauacauguguagaacaugcagguuuguuacauagauaugcacaugccauguugguuugcugcauccaucaacccaucaucuacauuagguauuucuccuaacgcuauuccucccccagcccuccaccgaccgacaggccccgguaugugauguucuccucccuguguccauguguucucauuguucgacucucacuuaugagugagaacaugcaguguuugguuuucuguucuugucuacauacaauuuuuacauggcugcaauggagcagauauucuccccagaaacuagagcuauauuuauaauauaaauauauguauauauauacacacacacacacacacacaaacacacaaugcuggaagaggcaggcaugucuauaacuagucucaaguaguauaauaaauguguuaauagaaauaugaacaaauucuuauggaauccuagagggaggagcaucuagcgguggcagcugaugagagcuggggagaguaaggucauaggaagugaggcauugaaacugaaccucaggagauagauaggaggucauuucugacagagcaagcaguauuuagacaauagucaaaaagauagugauuguauacuguaucauagcugaacugucaauaauguggagagaguguugaaaaaauagugugaaaugguaguuuaaacuuuaucccaauuuaaauauaugaaagaaaaugaauaauuaccauuauuuguuacaaugacagaauaugucacuguuuuuaggacauauaaguguuuuuaggacauauaagauaaacuucagaagacucuuuaauggcuagagguugacaaggagcuccuacuucuccaagugcaaaagauacuaugaggagaugaguugaacauguccacgaccaagauaaauugcuuaguaugugcaaauguagcaucuagaagccuggguacuggcugaaccaaugagauuaucugguuaaagaguauuccuacagaauauaaaaauaaaaagcacagaaaaucaucuauagaagagcuuccuaugauuggaguugcuuggggguauguauuuugugauuuaaaagugugacauuuuacauaaaggacacauauuugugcuaaaauaugguuccuuucuagcauacauuaagagaacaaccuuguugcaugugaggggaccagugagcagauucccuuaaacuuaggaguaagggaagcugcccuuugacaggguauacaugauauucaaacauaauggacacacagaauuguuuucuguaccuucagguuaaaguuacuacuggauaguaucuuuaucucuuauguaaaugcaggcuagaaaaggaucuauuagccaaagcgaaacagaaaggguggaaucagaauguguccaaugccauuggugacagagugaaugugguagauuagcuggacaugaaaaguccggcacuuauguagaugcagcugcuuacugcagugcaggagcuuuuaucugagagagacagcaagagcuuccaagcuaagcugacucaguucaaauuuaggccuuuucacuuacuaugaccucuuuggccaauuuacuggauuaucucuaugauguucucaaaugggcaaauuuauuuugaggauaugccaagcacauuacauucauuggaccuacuguuugauuuuagagaaguaaaacuuggaaauaagcccauuaaaugauuauuauuacauucugaaggaaaaaaaauucuugcuuugauuaaacucagauuucuguauacacagaauauuuaauuuuuucuuuuauaauuuuuacaauauucaccuaugaauauuuuauuuuuaguacucgucuuaguuuguuuagugcugcaauaacagaauaccugaggcugaguaauuuaugagggaaaaguuuauuuggcucauggagucugguggcugcaaaguucaagacugggcagcugugucuggugagggccuugugcugcuuccacucaugguggaaagcagaagaggagcugacauacacaaagaguucacauaaugaaagaagaagucauauucuuuauaaugaccuacuguuaugggaacuaauccauuccugcaaaacagaauccacacacccccacaggagggugaccuagucaugagaaaacugcccccauggauccaaaaaucuuccacuaugccccaccucacaacacugauguauaggggauuaaauuuuaauaucauuuuuuuuggaagcaaaucacauccaaaccacagcaauagcaauaguuauuguuuauaaauaacaaauaauauaacuuauuuaaaaacaaugaaugugaauucaaaauuugucaaaguagacauuucaaugaugauagaauuguuuauaugaagcuguuuguauuucuuguaaggcagcauuuaaaauacauuugaauaaauauauuuaaaauacagauacaaguaccuuaagaugauuuuauuaauuuuuaauuaaguaaaugguacaugaaaaaguauucaaauaauacagaagcaugauaaauaugagcucccccuacccccagcccucuucaagacccccauuuucuguuuggccccuguccuuccaaacuuuuuauauaucuacauacacauguguauacauauuagcaaauauuuguguuggcagaauauuuaguuuucacuuaauaaaaauaaaauuuuauggaguuuuuuuuccuguacucugaaaggcugauuuaaaaugcuaauuaguauggaaaaaagucuccuaaaauguuuuaguuauucucuguaacguuuucaguuuaaauuagacuugaaaccuuacuauuaaaaauuugaaaaggaguauggugaucuaauaggcuuuaauaauauacuacuuaaauucuaacaguucugugacaaaaccacuucucuuugacuuauuaacaaucaccagggcauuuacuucacaauaaaauaaagagcacucuuucuucuuauguucuauauuugguuuaaaaaaaucaguguagacugcccuugcucuucaaaggugauuaagacaaucacuguaauuuuauuugauucugugaauuuuuuacaugaggaaaagaaauacuuaggcuaaaaauuucaaguuuuuaaaauuucaagguagcugaaucauagaggugguuuaucccaugcuguucucgugauagugaguucucaugagaucugaugguuauaagcaccuggcauuuccccugcuggcauucauucucucucuccuuccacucugugaagaguugcccuuccaccaugauuguaaguuuccugaggccuccccagccaugcagaacugugagucaauuaaaccucuuuucuuuauaaauuacccagucucagguauuuccuuauaacaaugugagaacuaacuaacacaguagccuauucaucuuuuccagacuaaauauaaaaccacaaaucaaauucuaaccacucagaugcagugccccaucaaaugucaaggucaaggucaguucucuugacaugcagauuuaaaaauuuuaucaguaaggucaggggucaacuauuuaaggacauuuuacugaugacuagaguuauuuuucuucuauuccaaugcucaaaauggauacuaauuggagccacccugcaggcuuugaauacuccauguaaaucuucagagauaaugagcaagcucauccuagaaauggcagaggguucaaauaggauuuguuuuuguuguuuugugaugacaacuuacagagaccuaaggaguugugauggagacuaugugguauuuugugauaacaauuuguagagaccuuagaaucacuccuuuucaugacuacagcugacuuucuaaaagggguuuuaagauauuguuguucaaacuuuuuuuuauauugcauacccuaacuuagaagacacacagcacugcaggacagguccccauauggccccuuucucacuuguaguucucagaguaacuguagaauacauuggaaaugcaacauugaagacaugaaggaacaggcuggaacucuguucccauuguucccagaacaggguguccugaaaugcuuuagcucagcaauuccauugccccuggguauaaaacccagggcaguaugugcuuuggggggcccucagcugcagugcaacacagaauaugcacagaugagacuucaucugcccuuggcaguuuuccugugccuuagugggggcuggcucaccauacauccuaaccuucccuugucuuuugcuaccuaucugugaguaauaaaauugcuucacugaaauuguuguguaaauauuuuaucacucuugacuuaugcaaguggacugaugugggugcaugauauugguaaauuuuauaaaaauaaaaguuuuaauauuuucuuaccauuucccuaauugauaaucuucccuaucuccugcaguauauagaggacauuuugguuaaaaaaauuuaagcuggugggggacauaacuuggcugauaacacuagacauggcccuuaauuauaaaauucugccaaugucccuuuggaauugagagggaauuuccaugguugguaucauaaaaugccagugaaauuuuccauagaguucuagagaauuguagguggcuaugaaaaacaguaccauggucuuacacuuuaaaaaucaagagauaaucaauaguuggguccuagcauugagggagcagagacucagaggugaacaguggaaagaggacugaacuagauauuuaauguccuggacucuaaucauaucucugccacuaacuaguucuauaauuuuagcaagauuucaucuccccaaaccuucauguucuuaccaauccuagaaggauuccaagaucucuuccaccuacgauuuucaucaguagaugaugguaaauaauuucucuugacuauuaucacccauaugcuaaaagagugagagacuucaauaaauuaaaccaaaccccaagugucuuaaggucuuaugaagaauaggacuauugggauuguuuucuguuuaauuucacuugcauauagcugugcuuaaacuccuguugaaaggcuuuucuugugcugagcauggugcugcuuccacguaagcuacaaauacaaaagaaaucaagcagcaaaacucuaagguuggaaaaugugaccucugugaacauuccuaaaaacaacaauggcaacaacaacagcaaaccucucagguucuugauuguaaauaaucucuaauaaaauuaucauaauacuauuaaaaucaccuaguauucaagagcuagcauaucugucuucugaaauauguucuuuuuacuccacaaaugaaggucauauaagauaaacugaauuuuguccuaauucucaacacuucuauauucucuuugacucuaccuaauacaagcugaaaauuugagaaaaacaauacacagucagauucucucugcaacaaaauacuuaauugcuuaguccaucucacucauccacacugcagccaucuuacacugcuguuuguucuuuauuuccuuccuuucugauuaguauaauaugauacagcugcuaaauuuuauuuuuuuucacaucacauuuguacagcaaugaccuucagauauuaaauguuaaguugccuguugggaauaauaaggcuaaauuuaaaaauaaaagaguacaguaauccaugcugugaaaucuaaaauauuaugacacaauagagaggauggguuugauuucuaagaaaaauaaguaucacgaagaaaaauguuacccucugcuaaauaaauaauuuauuucucuuuucauuugguggcuuugaucgcaagauuuccuccgucucuguuucucuuuaaaugcucagauuaaagccucccauugcuauucuuuuguucaaucauuuauuuucuuugggggcucaagaacuccugaugauuuuguuuucucuaugauaguggauucuuuuuuacuuccaugcuggaagccagaaaauuaaaccuuugcaaucucaacgaagcaccuaauuaguagcuuacuaaaaaugaaauaaguuaauuauguguaauuucuucauaaagaucaaaugacaggcaaaucaccuuccugaggcuauucucuuuauuugcagcaaaaaugagaaaaacagaaaccaaauaaaguuuuucuagugcugacagcaccacaguaaaauaauaaauuucuagguuauucuauuagaagcauuaacucagcaugaguccuugcuuguauauuagauuuaagacaguauccuaccauagaacaagaguugaugaauauacucacaauccaauucacuaaaaugcaugcugccucucaaacuagguaaauuuaauauaaacugaauaccuacuaaguacaagguaauaugaauuccugccacuuacugguucuguaggccuuggcaagccacuuaaacucucugagcuucaauuuccucaucugcagaauagggauaauagcaugugguacucugugagauuauugugaaaauaaaaugaguguuuggauaacaaacgcugaagaaacauucuuuuauuaaauaagacccacaguaagggagguagacauauguaaugagaauaucccuauauguaucuuuguuuaccaacacuaaccugggagagaaaaacuagcccuucccucguuuucacacacgaacaugcuuauucaugguaugcauguuauucaguuagauuugcuagacagcuaggggugacaguaagggagucacacugcagagaggguuaucuacucucaaucucacuggcuccuucucagcuuccgugcucugcuauuccuuuccucuagaauuaccuucuugaucuccaaauugugcagaucaguucacuucuagucuugucuccaaaagaacauaaccaaacccacugagauuuuucagaagaaaaggccaacuguauaacaauuucuaucuucuauggaaugcauuuaugguuauaagugccuguuacuccauuauuguuguuauuagagaugauaauaagagccagaaugcuucccuaagaaauaaauggcaagggaagaacuacagucaacaguuauugguuauuuuuccaauaauuucacccacuaagugaagaaagagacaagcaauuccugugaagaaaaggcaaagucaagggaugauugggguuuuauuugguauuugcauauuugugaaguuaaggaaaucagagcccauuaaaaguugaagaggaaggaggaggcagauagaauaacuacaaaagauggauugauguaccaaaggggagaauagaaguguuggauuaagacauuagcuuugagaggaccagaguuagacacaucuuccuuugggauggcagucaagaugggaguaggacugaaaaaugcagagauucuagcaggaaacugaguucaaggaauucaagcacaugagcccuugaaagauuuucauggcuuuggcauacagaaaacaauugugucucaucauggauccaagucugcuuugaugugaagggcccuguuuuaccucuuccaucuuagccacacaucccuggaccgaugacuuggguccuaaauauuguuaccugugccuaacaguuaugccuauacucuaguccaugacugccuguauuuuuacuauuuucuauuugcuaaaaaucaccagcauuuuccauuacuuauggcauuauuuaugugauuaacaagcacauauuuguacagaggucucuaaguagguaauaaagaagaacuaggauaaaucuauuaaccaauuguuuugaaaaaauauauaggauuauuaaaaauaugaaaacuucccaauguacuuauuucuaggucaauuauauuuacuuagucaucucuccaaagugaacaaguaugauauuucaaaaauuuaaguaaaauuuacuacuaucuucaauagugguuugguucuuuuauuauagaaaguuguuuaaaaggauucauuuucuguaugcagcucucaagcaaauucagauucuguagcuguuagcauucaaugacaauauacuaaguuuuuauuuuauuuuugucuauuuuaugauuuuaaugcuuacuuauuaugccuaaagugccuuucauuuagccuuaccauggaucaauggaaauaaauauaaaaaugugaauguguuagauaagaaucagaacgccgagaguucucaccaucaaguuuugccuuuuaucaguauucucucuguagucaucacuaugccuucuguuuucucuggaacaggaacuuuauguggcagucagucaacaaguuccaucugucuuggcuugugcuaccacuuccuucuucucuuuucacuuccuagaucaguuucccaauguguguucuggggagcacuauggccucaagacaguccaaaaagggucaaauaaauuugagaaacugugucccuugcacauucacauuuaauguaucccuuguauauuaaagacugugcaggaggcccugcuucaugaaaauugcauguuuuuaagccaguguuuuccaaaucuguuuaugaaaaauccaccuauauaaauaaauagaaaccaacccacauugauaauuaugaugauuauuauuuuuugagguggagucucauucugucauccaggauggagcgcaguggcaugauuucggcucacuacagcuucugccucccagguucaagugauuccccugccucagccucccgaguagcugggauuacaggugugcacuaccacagccggcuaauucuuguacuauuaguagagacgggguuucaccauguuggucaggcuggucucgaacuucagaguuugugauuauccugucuuggucucccaaagugcugggauuacaggcaugagccaccaugcucgaccugauaauuacuguauuagaauuauuuucucuuuuuuuucagcuauuuucucugcucuucccaggaggcccugcuaaacaguuuggauugccaguacugaaccucuccagguguuaaucaggcauuuucugagugguaaguaaaaauauccgcauuuuuagaaaugaugaagaaagcagaaaggagccuuccuuucugaaaauguguccaacuuguugcuauaauggauaacuucaucauuaaaaacaaauacacaaaaacacuuauagaauguuuuccguuuugcccucuuuucuguaucuucaaaugaauuauuuuucuugaaguuugguacccagaauagagcgcaucauaguacauauaguugaaccaguguagaagaaaauacggcuauuauuucccguguucuuggcccuucuucauuaaugugagguaagaucauccgaacauuguauuugagcagcuuuauuacucugccaacucuuauuuaccuugaagcaaauaacaauguucucauuucuuauuaguauuucugcauuaacuauugccaaagccaugucaugguauaccuuaauaaggagagggcagcugagaacagcuuuuuuaaaacaugucaaucucauguuuugaaacauguugugaacaguaaagccagcugaccauaggggaacuuucugagauacugaagcagcuggugagaucacuccugagugaggauacugguggaaaagucuugagaacugaucauugguuaguuccaugggcaaugagaugaacaaggggcaagaagugaacaaggucuggccaguggccaaaaggagaacacuucuaguaaucucgaugagucuuuauauccuccuuugccaaauucugcaacugcuugacccucucucucuccucugguggcuucuauagacuccgugcccugugcuucucugccgaucccucuaccugcuuuuucuaagucucauuugugucucugucuccucuguccacuccuuaaugcugcugucccucacugcuugguugguacugcugguuccucauucugugcacucucauucauauguacaguuuugacuauuguugccacggcuaaugcuguauuggugcucccaaauuaucucuucugaaguuuagaccuauuuacccaauuauauacaagguguuuacauaaggaauguugaaaucuccuuuuugacauuuauaauagaauuuaucuuuacuuccaaauguuugcauccuucuuuuugccauucuaagugauagaaccguucuacuagucguccaagccagcgauccugguuaucauccuuggcuucaaccugaauucuucaggcccuucucuuuagcuuuuaccagggaacauuguaccucaaaguccuuugagucuuuuucugugucaucccuuuccaugaucacugccauugccuuauuucaggugcauaauuuccugcuuggaccacucugauauucugguuaaaagcuaaggcaaauauaccuaggcucugauuaugcuucagucacucacuagucccuaguuguaugagcaguuuacucaacucccagggccaaacauuacucuuuuauaagaaaacugagucccacuaguuagugguagaaaggaagcuugaauacagauaguuucauuucucuucaaauccuuuuuaaccuuuccauaauguccuuagauauuccuuccaaguuugugucaucuguaaauuugauaagcguaguuugauguuauaaucagaguagggaaaauaacgaucccucuaaucacagcauuucugacaccaaauguucagguuuuuaccugaugaggaguucagggugaagccaaggaugaugaacaggaucacugacuuguacaacuaguaaaacuguucauaccaauuaggauggcaaaaagaaggauguuauaaguuugggaguaaagcaacucuacaacuuucuacacaccaacugguuauccaacaauucaauacaauuuggauacuaacuacccagaguuagugaaaacccuucaggugaaggacucaguuccaaaaucauaauucagaugccaaucauaaguccaacccaucaaugcuucagaccaaccagcuuuaaaucuuggguucucacaaaccucuccuaggguucaauaauuugcuagaguaucucagggaacucaagaugguacuuuauuuguaucuagugguuuaucacaacggacacauucaggaacagguaaaaggaggaaaugcauaggaaaaggcaugaugggaggcaccgggggaguaguugcacacaguuucuauaccuucucuggggaugccacuaaccuagcaccucuguguguucaucaacucagaagcuuaucaacucuugucauucaggaauuuucauagagccuaaucuccagcccugcuucccuucuaggagguugguaggugggguaaaagauuccaacccucucaucauuuggucuuucuggugaccagccucauuuugaggcuuucuagggguuucgcccuaaguuggaugugaucaaaagaaacucuuugugaccaauaaaagacauuccugccacucaggaagcuccaagggucuuaggggcucugugccaggagucagagccaaaggccaaauauauuuauuaugccagaagaaucacugauuaaaaacauuacauaagaagggaaucauaguaauggcuuaggguugccucuugaagacuuuucuugguugaccauuucuaugucauaagugcaccgugacaaaggaccuaacaaaagaguagaggaagauguaaagcauaaauuaagaacuauaaauggcgaucugaacuagugccuaaagaaaaaaaaaauugagauauacuaaguaagaaccauauaucaagacuaggguccagaguuuggagaagauaugucagaaggccucaugagugggaaggagagccaugcccucugcccuccuccauacuuuccucccugggcagagaugcuuacacacuuacaugcuuacaccugcaccaugaggccaggauucuggcaaucguaucuuauguuacaaauacaccaacuagcugcuuacaacauucaguaagucuucuuaaaauaaagcagccuuggagacaacuucuaccauuauucuauaaaaaacuggaucuuuuaucauucuuauaaauuauaagaauguauauauaaauuacaagaauguauaauuauaaauuauaauacuguguauaucaauuuuaauacuguauauauaaauuauaagaauguauaacuuauaagaauguuauacauuuuuauaauguguaagaauuauaaaagaugguucacccaccuucaccucaaugaacucagauucacucuauuauccauggugguaguagagaaugugguauacauaccuguguguguauaugcgugggugugugugugugugggggggugcucaaucccuuaaucaccagacaacagucacuggaaauccuaucauguuuucucaucccauuucugucuuauuuuucauugcaguuucaagguagagacagaugaggagaggugccuucgcuuuguaaaagcagcagauuccuucaccuuuccucuuggucugugucuauuuaauuugagguuacaaaugcauacugaaggaaaagcuaguuaacuuaacuagaguuuuaagguucaacuacagauuuugccaaagaccuugcugaaaaaucaugguaaaguuacugugucucuccaguucccaaccacugcugcaccaagagagcugaguaauauggcacccgccugcaggcugguuuauuauaguaguuauuucaaaugguauaugcauguauaagggugggggcuuccucuccaaugauuuuuacuugucagugaaagccucuugaucuugccaacuaccaauucuauuaaaagaaauuaguucuggaauuauucuuagugcaacccguuugcuucauuaaugacugugcugauaaauuaucaguuuaagaauuaauuuuauaauauuuccagagauggaaggcuuauucuugccuguaguuucuggccucggcccucuaaauagucgauucagucgucccaguccuugcacacauguggcugaggaaccguccauugugacuacaguaguggagaagcuguguacuuuuauugacccuggaugaccuggacacucaaacaaauguacuggucacaaccuccagcuauauuaguuguugaauucacagaauguaugauuuaguuuuuaacuguuaaaauuuguaucacugaucuacauccuuugcugagagcuccuuucacaggcaauuagaggcucucucccucuuuaucguggauuccaguuucuuuuuucugauacuugccaaguucucccauuuccaguuggaaacucauuuucuuugugggaagauguggaagaaaaauaugacugaaguagcccaccuugcuucuuuccugucauucgcggccaaccugacacuugcucguuauuuuugucccaacuuaccucuauuuuuauuuuuuuuccaaaaauuugucucuagauuuuguuuguauaagugccagcuuauucuggccuacuagaguaugugauuuuuuuuuuacacaguuaauucucucuagauucuuugguuucuaaucaacuaauuccugcuaagguauugguggcugauaacggcuuaauggaucaacucuuugggaugacauuugcauuuucacuccugcuuuuaaauccuuaccccaaaagaccacaugauaugagaauuucaaguauucuuguggagacaauaaggaaaaacuuguggaaggaagagagcuuuucuuaagucccacuaagcucagaacagauauuuuaaagugcucaacuauauguaagucucuuguucuuauaaauaacaugaggaaagucaacaugagaaaaaauaaugcacauucauaauugcaaaauucagacagcuacaaaaggaaugcagaacagcuuucccacauuuuagagguuucuaaaauguagcuaaucugacauuuugcuuuuuuauucugaucuauuugauuucauuaaauuuuaacguaagauguuuguggaauaucaaaagcagugauugcaauuuaaccuuuucuuaauuacuuuucaguaauuaagaaaaugccaaugaaaugcaggcauucuggugaacaauauauuaugcuggcuaaaagagauuagugucuagagucagacacaccuagauuccaaucuccacuuggacucuuaagagcugaggauucuuagcaaaucacaucacuggaggcucuucaauggacaucauaagguagagccagcagcuagggcuaucaugaggauuagugagauaaguucagcaaaaugcucagaagaguuccuagaacuaguaagaagccaaugaauauuucuguugugggcauguaugcuuuuuaaguagaaaaaccuaacaagccccuucauaucagcuuugggguuuuaugaugcuuagaaauuuccucagcuugccugaccaacaaaagaaaaauuagcaauacuuucuauuggauucuaagauguacucauuuguuuguuuauucauuuacuuuugucauacauucuuguauuuaugcauguacccauucagcauguauuaaguacccauuauauuagaaguugaaaagcacugguaaauaagacagacauacuuccuacccucaaagaacuuauagucuaguggucucauugugaaaugugaaaugggcuaaguauaaaagccaaggguaagugaggacaggaaacauucacuucuauacguuucaccucauuugugaaagaaaaccauuucacacccacuagaagagcuguuaccacaaaagcaaaacaaaguaaaaccuugaaaauaacaaguguuggcaaggauguggaacaaucagaaccuuuguacacugcuagugggauguaaaaucgugucauugcuguggaaacagugaagcagucccucuaaaauuuaaaauagaauuaacauguaauccagcaauuccacuccuggguauauaucuaaaagaaguggaagcagaggcucaaacaaauauuuguauaucauuaguacauucacaauagugaaacagcagaaacaccgcaaauguucauugaugcaugaaugaauaaacaagaugugauagacacauacaaugaaauacgauucaaccaugaaaagaaucaaaauucugacauaugcugcaacauauauggauccuaaagaaacgugaugugaaauaagccaggcacaaaagaacaaacauuauauguuuccacucauauaagguaccuagaauauucaaauucauaaagauagcaaguagaaugcugguguccaggcgcaguggcuaacgccuguaaucccagcacuuugggaggccaaggcgggcggaucaccaggucaggagaucgagaccauccuggcuaacacggugaaaccccaucucuacuaaaaauacaaaagcaauuagccgggugugguggcgugcgcuugucgucccagcuacuggggaggcugaggcaggagaauggcaugaacccaggagguggagcuugcagugagccgagauugugccacugcacuccagccagggcuacagagcaagacucugucucaaaaaaaaaggaaaauagaaugcugguuaguggaggcuggaggcuggaggaggaagaaauagggaguuaguuuuuaaugagcaguuuucauuugugaugacgaaaaguccugaagacaccaauagugaugauggucauauaacaagguaaauguaccuaaugucaccaaacuguacacuuaaauauaguuaaaaugguaacuuuuaugcuuuauguguuuaaucacaauaagaaaacauuacauucuguguauucaacacauagauggaagcugugacuaacauauuuuuucccacuauuauuuagggaaucuuagcugucauuugacuggcuaaaaagaaaagccaaaucaauaauuauacagcaauaauaggaguuacgcuucauuuucaguucuuuguaaauaaagcaaacuauuuccaugccuucccucagucuaggacuuuccucccaccaagauauuuuauucuuucaccucuucagaaaagcaagaaccgcauaauuaaacccaacagucuaguuucacagaggcagacauggcauuccaaaacauuaaauggauauauuauaccacuauaaauaaguuguguuuaguuaguuuuaaauacucuaauuuuuguuguuguuguuguuguugagauggagucuugcccugucucccaucccagacuggaguguaguggcgcgaucucggcucacugcaaccuccaccuccuggguucaagugauucuccugccucagccuccugaguagcugggauugcaggcgugugccaccaugcccagcuaauuuuuuguauuuuuaguacagaguuucaccauauuggccaggcuggucuugaacuccugaccucaagugauucaccugucucagccuccaaagugcugggauuacaggcaugagccacugugccaggccuauacauuuauuuuccuaaaauuauuuugaaacauggauguuuuaaaaagucagaggcugccuuuccacacuucugccauuaccuacaggcaugcagugaauuuuaacaaugcauuuuuccuaguugguacauauguuguuucaaacaagaauacugcugagguguaucuuuguuuagccaguuaggucuucacuggcaaugaaaauuaauagaguacuuaaaacaaaaacaaaaacaaaaugcccccccagcucauuguuuaacauuaaacaaguaguuuaaaagauauuuuucuuugaaaaacaaaugauaaacuagaaaaaaaaaguaaaaauaaaaucagcaugugauuuuuuaagggaccauauaaauuuaaaauauacaaauaaguugaagaaagauuugaugaaauuguuaugaggaaaaacuggagauguuuauugaggaaagacuaaaguguucuaaaguaugucuuuaaccuuuaaguugauaucuagggaaagaacacaccuuucuauaaauuaagcuuuaaugcuacagccagagaugaaaacauaaggcugaauggauuacauaucugauguggcaugaugcaacuuagaguucuuuaauaacgugauugcaaaaaauaaaaaugcuuaaaucaugcacacuguugucuucuaggacacaauaauauaaacauuucuaauaguuuuuaaaauaugguuaauuauccuuaugaauucauugaaaagauguauaaugagugcuuugcaugcaucagacacuguguuauauuuuaguguacugggauaaacaaaaucaagaguagcuccugcucuccugaaccuugugaucuaguuguucaccuaauacaccuuacuucuuuucaagccaucaaugucuuagacagcuuccuaauuccaaagauacuuucucuggccucuuaauuuccuauucuacacacuauaccuucaugaucuuauuucuuuuuuuuuuccuaauaguucugccauacggaaacuaagaaauguauaauccuuugcuuucuaagcuaaagaaaaaaaagcucuuagauaaccauccacauuauuuuuaauagauccuaauguuuugggaaaugguccauuuuucucucaaauuaaaggcaagaaauuuauugaauaaagcuguuuguggagaacagaaauaugauugggaauaacagagauauaaaugcguaauuaaaaaauauucuauugcuuaaaaaacuaauuuuacuacucuaaauaauuuguuauaaaaagcuucaggcuaggaugauggauaauugaaaacuugaaaaagaaaugaacuccuuuaaaugaauuuuccaaacucacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuuucagcaccacaccacaccuauuccaaaauugaccacauagucggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauacagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccgucagagaauacuacaaacaccucuacgcaaauaaacuagaaaaucuagaagaaauggauacauuccuggacacauacacccucccaagacuaauccaggaagaaguugaaucucugaauagaccaauaacaggagcugaaauuguggcaauaaucaauaguuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacacugaugcaaaaauauccuuagguuaaacagccguauacaaauuuucaagauuugcucacggagggaauaaauauugaaugccacuuuauuaaauacaauugagcacacaaacuauaaucaaauucacagauaauauaaacuguuuaauaucaaauauaggaguauuacaaagaugcuaauuagccuucaauaauuacuuuccccccuugcauagacuuagaucuuuaccuggauauuugguuauccaauaucccuugcaacuauauguggccacauuaauauguuccagccaaugaggugauacaugcguaaacauuguaugagauuucaggggaguggccuugaagggugagaaucaccccauaucuuuugaugcuuuuuuccuccuaucuagaacuuggauguaauaucuggcacucaaauugccauuugggauauuugcuuguacuaaauauaaagcagaaauauggaaaaagccuagcuuccugacuccauggaacacugcauuagccuugaacagucuaauucuauauucucucauauaacaaaggaagaaaucuucaucuuguuaauuucagucucuguuacucaagcugaaccuaauccaaacucauaccauaguuuguacuauacauaaaaauagggugcuaugugugacaaagccuaaaaagcauauggaauugccugugguggacaccaggccuugaagacugggauacucuagcuguggaaagcugagaucuuuguuauaccguagcuaaauauuugguuauauugucaacugcugucuuuggaaggcaaauuaggugccaacugagacuuuccauguuaagagaaaugcuuggaaagacucaagugcucuugcgcacuggcacuggcuccuucuugcuguguuuagcaaagucuccaggagagagaugaaguuagucuagaacucaccagccuaaaggcugagaugagaguaaagcuacugugaaguagaaggugcuuucuucuuauguugacagucuaaaaugauggaaaaucccuaauucagaagcuugaaaggguuaaaaaaauaaaaaugaaaaaaauaaaaaauaacucuguauccuaaacugcauuaugguguaagucuaaaccacagcugccaagaggcagcuuuagaaggaaguaagccuguggccccaggaugucuuucauaaccuucagguaaggguuaucuaccagacacuggggcacagcacuguugcagugaucagauugaggauaucaucguccacuaaagguuuauucuuuuucaggaccucaagguaguuugacauuagcugaaaggcagagagaagaaaaggagggaggugcaaguucucuugaaggcagauuagagggcucaccuccacugggaauuggcagaacacagagguaaguaugaaaaagaauagucaacagguuuuaaacuaugucaagaacagauguuuaggugugguuauuugcacauagaacugccugaaagaaaauagauuagaagacuauaacauuuuugagaaacuuacauugccaaggaaaccauaagcauggccugcaaaguuuugugcccuuucaaugacuucagcaguccuuaaucacuaauuuguaucagcaggaggucaguuaugaaagcaugcagcccacuagacaggaaaaagcagaaugcccuucucagauaggaucacgauauggcuucucauagggaccucugcgagagugaaacuuugggucacaaaaggcacuggaaaaauagccucuuugcuauuccugccuagcaagauuuuaaaauugcuauggaccagcaauggcuaugugucucucaugcuuuuauuuucauaagaggaguguauuucacaguaaacagguuuuuaauuuauauacuacucuaccacaagaaaugaaaccuugaccugacguagaguucuguacaucaucagagauggauuugagauggaugcaauaacuuaugagauuuugggaaggucucacuugaaggaacauaaaaauguccuauguauuggaaaaaggguuaauauagguauuucuguguacuaauauugguacauacugucaguuuucccuacaaucuguuuucaugaucuuuucaguaaaaaaucucccugcaccuuuuauuugaggggagggggcacuggauucaugaaugucuggaagaauuuuauuucccagcuugcuuugcaacuaguuguagccacaggacuaagcucuggcugacaggauauguguagaaauaucuucagcaucuuucaggaaguguccuuaaagaaaggggcuccaugacucuuuucacuucuuucuuccugcuguauggaauggggauggaagacaucuugaccaagagugagaaacaauguacuaaagaugguggaaaaucuagauagauuagaacuuguuaaauuagagguugcaugcuagaugcaauccaccacuuguuuuuguaaauguuuuacuggaauacaaacauacccauuuauuuuuguauugccuauggcuguuucucugcuacaaagcaaaguugaguaguugugagaaagaacacauggcccaaaaagcuuaaaauauuuacuauaugacccuauauaaaagaguuugcugaugcuugaaauagaauucauacuucgugaaaccacaaaaugccauaccagccccuucauccaguuuaaaucguuacuaaguuggauuucuauaauuauauagcugaagacuauccuaauaauuuggauuuuuucccucuaucuuaaaaguuaauauuauuauaucuauaauauuuucaauauagaaauccuauauuuaacauuacucauuucugggugucacggcucaugccuguaaucccagcaauuugggaggccgaggugggcaaauuaccuaagcucaggaguucuaaacaagccuggccgacauggugaaaccucaucucuacuaaaauuacaaaaauuaacugggcaugguggugcacgccuauagucccagcuacuagggaggcugaggugggaggaucacuugaaccugggaggcagagguugcagugagcugagaucaugccacugcacuccagccugggcaacagagugagacuguugucuuaaaacaaaauaacauuacuuauauauaagugcaaaggaaaaauaaaagaaacaauguauuuaguugauauuuaccauuauauacuuugacauaacacaagagauuaacuucccuaauaaaaauguauauauacuuaauguuuuuaaagaauuaagaaguaugguaaagaauucugaaauuauugaugcaauauaaagccuuuuaaaauuaaacuuacuggacacauugcguuuauggacauucuauacuggaaaguaaaauccacucaccaaugacaaaaaagaagaaaccucaacaauuuuuguuacaugaauaaauuauuaguaacuguaaguaacaaauguacauuuaaacacaagugcuaugucagaagauuacuuuuauccacuuauauuuuuaaaaauaauccugacaaauuucaccucccuuuaucuuaucuaguuuguuuccuaccacaugaaacucuugucuauguaaaauuagaaaaaauuaaagacaugcuuuucuaaaguaaacauuuuucuccuguuuugaaaauuuaaauauauacguauauauuuuuaauuuuacuuuaaguucugggauacaugugcagaacgugcagguuuauuacauagcuguacaugugccauggugguuugcugcaccaaucaacccgccaucuagguuuuaagccccacaugcuuuagguauuuguccuauugcucucccuccccuugccccccaccucccgauaggccccagugugugauguuccccucccuguguccauguguucuuauuguucaacucccacuuaugagugagaacaugugguguugguuuucuguuccuguguuuuccagcuucaucugugucccugcaaaggacaugagcucauucuuucuuauggcugcauaguauaacagugucuuuaaauuuuugucuuauaauuuuugucuuuaaaaaaacaaacaaacaaacaaaagaggguugcucuguucuccaggcuggagugcaguggcacgaucuuggaucacugcacuccaaggcucaagagacccuccugccucagccucccaaguagcugggacuucaggugcgcguacccaugcccagcuaauuuuuguauuuuuugcaaagaugggguuucaccacauugcucaggcuggucaugaacuccugggcucaagugauucuccuaccucagcuucucaaagugcugggauuauaggugugagccacaacgcccagcgaacuuuacauuuuuauauggaaauauauucaaguaguuuucacuuauuauuuuuuaguacuauaaaagugcuugucauguugguuuuauaccuacaaauggcuacuguagaaaauuuuaacgaaaaaagaaaggagaacauuaaaauuauucauucuucgaaucagagauaguauugcuaaaauucuguuuuacuuucuuuuacagugaggaauggguggguacaaaacuagguaagaagaaagagacaaaccguagaaagcagaaaguuaagagaagggaaaaccaggaaaagagaagccaaggaaaaaaaagagauacauauauacacgcacacacacacacacauauauauacauauacacacacacacacacacacacauauauauauauauauccuuuuuuugaaguuuaagcgacagugagguaggcagacauuaaacaaauaaucucccuaauucauauaucuuuauaaucuauuauauauacucaaaacuaaagaaccugaccuuagccaggggcugagacaaagggaaggcuucccugaagaaguguugauuaaagugagauuugagaaagaaguagucaucuuaggcugaagaacauuccagacagaggaaauaguagaauguguaggaucccugugacaaaggcagcauaacacucuauuagcucaaggaaggccaacaugaugcuggugcacagaagcagaaggcugggugaggaugaaugauguguguaacacagaaaggaaccauacgaugcaagguccuuguaauucagguuauaaauuugcauugcuaaacaaauaaauaaguauugcaaucacaagagaaacaggaagucagugaggguggaaaggguaggggaaauuggcaagacaaagucaguggaagauagauugaaagaggacuaacuagaauggacugaaaccgucaguggauaaaucagggaacuguuaagcaguccugcagagagaauaugguagucugguuuaucacaguggcagugaaacagcugagaggcagauggauuauaaaaucauuuaugagaugaauaguuauggauaauaaauaaauacuuaaauaggauugggugaaggacuggauuuguugcauuaagauaaaacuaagacuaaagucauucuuuauccuggauggagggcaauggcacauucacugauauggaaaauauuagacaggucuaggagaaugcaauuauaaauuuguauuguauuaaaauauuuuauccccauugcaauaagacuaugucauuaaccuuuuuguauaccauuuaauauuauucaaaaucacgacuuuggguggcugcauaauacuccauuuuauagacuugccacaguaucuuuuagcaucuuucugcuguugcucauuuaggcauuuucuaguuauugaugacuauguuguugcaauaaacauucuuguauauaacuacuuuauucuguaaucauacaaugggauccguuaccauuauuuauauucuuucaaaaguauaugaaucaaaauucguguaacuaaauuuuacuauauguauuuaaaucuuaauaaauugauuuuaauaagugauugagggcuaaccuuauuguaucaucuccacauaaauaaaaucuuaacacuccuuuuaauaaacacacauuauaaacuuucuuauacuacuuaaucacuuagcuauaauuuuguuuuaauuuuuuaaaauguggauuucuaacuugucccuugaugaugcuaaccucacaucauuauccagugucuuauuuuucugaugcuuucuuugccucucuucuaauccuccucuccauuucaugaaaucuaagguuuuuauuaucagagugcaacaaaugucugauaauaacagacauuuguuuuuuuccuacauuuuuauccccaaaucuuugccuacauuaguguuucucaaaguauggagagagaaugacaagcauugagaucacccaggaaguaauuuaguaauuuuucaaaacaauaaacauagacuuaucauaugacacagcaauuccacuccuagguauauacccaagagaaagaaaaacauaugugcaaucaaaaauagguaaauuaauguucauaucagcauuauauauaauagccaaaagguggaaagacccaaaacuccaucacuugugaaugaauaagugucucauauauauguauacacacauauauauacacacauauauguauauacauauauguaaaaauauuuggcaauaaauagggauaaaguacuguuacaugaauugaauaaacuacaguugaauaaagguugaaaacaugcuaaaugaaagaagccagucauaaaagauaauuuuuuaagcaauucaauuuauauaaaauguccagaauaaggccaggugugguggcucacgccuguaaucccagcacuuugggaggcugaggcggguggaucagaggucaggagaucgagaccaucauggcugacacaguuaaacgccaucucuacuaaaaauacaaaaaauuagccgggcguguggcgggcuccuguagucccagcuacucaggaggcugaggcaggagaauggcgugaacccgggaggcggagcuugcagugagccgagaucaugccacugcacuccagccugggggacagagcaagacucugucucaaaaaaaaaaaaaaaaaaaaaguccagaauaaacaaauccauagagacaggaaguaguagauucgugguugccgugguugccuacgauuugggguuuuguggaagaauucagagugauuucuaauaguuuugggguucuauuuggggucaugaaaauggccgaaaauuagauuguggugauaguuacaagacucugugaauauucggaguaucacaccaaguuauucacuuuaaauggugaauuuuauagcauaugauuucuuggccaauaaaaugauaagaaaaaaagaaaaucuguuuaaaaugcauauuucugggcccaaccucauaccuacugaaucagaauuuuacuaagaaggcagccaaagacuuuuuuuuuuuuuuuuuuguaaaguacccuagaagguucuuaaggacauuaaagugugaaagccugguaugaaacauguauuaucuuagcaaacacacaaaaucucugcccacugcucuucgaaucaacuuuugcacuaggcuagcaaauaguagaacuauuucuauuucuucuaagcuuuuacauagugguuauuacccgucugcuucauucagccugauagcuugcauuuccacccuaaagcccaauugaauuuuuuccuucuuuugaucuuccaacauuuuuuucuacauauaacauugacuauauauuuacuaggggcaauucccccuuuacauguauuuucugcccuucaaauauucuuuuauuuuaaauauuaaaccuaaaaucauguauacauauggaauccuugaguccaucucuuuguucaauagcccauagauaauaggaaaaguuccaaagauauuaaaggauuuuuuuuuuuauugcugacuuuuugaagcauguagcuucuccuggaaauaauaccauauaguccaaugcuggcagagaauaucuuuacucaaauuuuauauuugcauacugaucuaauaagggugucuaaaaacagagaaggucucucuucccaauugugagguagugaacuuacugguuauuauagauuaaguucuacagaggaaugaugccauaguaacuuuggcacuaauuguauuuaacuucagugaaugagauagaaagaucuagaugucagagaggcuuggggauuuuuuugauuggaaaaguauuaaagacaauguaaguuuaaggcuaacuuuugaaguaggcugaauuauauguuacuaggaaagucuuuggccuaaauucccggacccucaaucccacacauuauaccuaaaaacacuucaaauuuccccaaaaacacuucaaauuuucccauuagauauucaaccauuuuuagggucuugaaagccaaaaagucuuacaaaauuucuuaucucagcaaaguuucaggauacaaaaucaauguacaaaaaucacaugcauucuuauacaccaauaacagacaaacagagagucaaaucaugagugaacucccauucacaauugcuucaaacagaauaaaauacuuaggaauccaacuuacaagggacgugaaggaccucuucaaggagaacuacaaaccccugcucaaugaaauaaaagaggauacaaacaaauggaagaacauuccauacucauggguaggaagaaucaauaucgugaaaauggccauacugcccaagguaauuuauagauucaaugccauccccaucaagcuaccaaugacuuucuucacagaaugggaaaaaacuacuuuaaaguucauauggaaccaaaaaagagcccgcaucgccaagucaguccuaagccaaaagaacaaagcuggaggcaucacgcuaccugacuucaagcuauacuacaaggcuacaguaaccaaaacagcaugguaaugguaccaaaacagagauauagaucaauggaacagaacagagcccucagaaauaacgcugcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuacacaaaaauuaauucaagauggauuaaagacuuaaauguuagaccuaaaaccauaaaaacccuagaagaaaaccuaggcauuaccauucaggacauaggcaugggcaaggacuucaugucuaaaacaccaaaagcaauggcaacaaaagccaaaauugauaaaugggaucuaauuaaacuaaagagcuucugcacagcaaaagaaacuaccagcagagugggaugggaaccuacaaagugggagaaaaguuuugcaaccugcucaucugacaaagggcuaaaauccagaaucuacaaugaacucaaacaaauuuacaagaaaaaaacaaacaaccccaucaaaaagugggcgaaggacaugaacagacacuucucaaaagaagacauuuaugcagccaaaagacacaugaaaaaaugcucaucaucacuggcuaucagagaaaugcaaaucaaaaccacaaugagauaccaucucacaccaguuagaauggcgaucauuaaaaacucaggaaacaacaggugcuggagaggauguggagaaauagaaacacuuuuacacuguuggugggacuguaaacuaguucaaccauuguggaagucaguguggcgauuccucagggaucuagaacuagaaauacaauuugacccagccauccuauuacuggguagauacccaaaggacuauaaaucaugcuguuauaaagacacaaauacacguauguuuauugcagcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaaggacaaaaaacugaacaccacacguucucacucauaggugggaauugaacaaugagaacacauggacacaggaaggggaauaucacacucuggggacuguuguggggucgggggaggggggacgguuagcauuaggagauauaccuaaugcuaaaugacgaguuaaugggugcagcacaccagcauggcacauguauacauauguaacuaacgugcacauugugcacauguacccuaaaacuugaaguauaauaauaauaaaaaauaaaauaaaauaaaauucccaggaggaguagaaaauauuuuucauuacuugagaaacaucugguugcugggauggacaaagggaacccaaaguagaaagagaaauuaaaaauaaaaggaggggugaguucagcaaaagcucuauuuaauuacuacgugaguaaaccaaacuagaaaaacuaacuuauuuuaaaaucugaucuuuuuaaaaacucaacaauggaaaacaagccacagaaccagaaagaacuuaacuuuuuaguuaaaagagagacauguaaauaauaauaaauuuaauaauuaaauuuacauacaaauaauugauugccuaaaggagaaacaaaacaggcaagcagacaaaauaagcaauaacagaccaucacaguuauaggcacgggaucccauucuguuuguuucuguacauauaagaauauuacuugaauuuccagcaguucaaaaaaguaaguaugcuaaauucaucuccucuaccuacuuguucugucauagaguauuagauaugcaaacaaaaauaucaacuuuguuggggaaaaaaaaacacaaacuucuuucugguuugucaagaagugcuuuaaaauaacuuccuguaacuaccuuuauguauugcauuuuugugucauuaccaaaugacuuguggcuacuaaggaagggcccuggugacauuucccuuccuaccugaggucagaguuggcugcucuaaauaggguccacagaugcuuaccagcugaggccacgcugccuggacugcccucagucugaacacagcaggaguaagagagccaggccauuucuuucugacacaggauucuaacagacaauuuuugcuagagacuggccaauacugccucagcugugcaaccaucuggggcccuacccacucacucauccuucccuuucaccauucuugaaugucagagcuccucuuuaaccucuuuuuccuuuagaaguacuugcccaauaaaucuuuugauugucugauucugucuuaaccucugcuucuuagaguaccugaacuaacccaugaugaagauucuuuucuuuaccaaauuuuaaucaggcucugaacuuucuccuaggcccaucuguuuacucucuuguaaaauccaguuuuagcaaaagaacccugcgaagucaguuuagccagaacuccccgcccuugagagcugaucguucucaguaucucaucauccuugauaccugaccacguuccuccugcaccaccccacagaugaugucugaucacucuagccuguuuuuggcaagaauucugguuagguggcuuugguuagaaaccccuauacuccuggauuguuucuuuguaguaauuuucuauccacugacccaacccugcuuuuugcuauaaauucccgcuuguccuuccuauacuuggaguugagcccaaucucucuuccucgcugcaaaauuauauugcaguggucccuguaucuauugcaaugguucugaauaaagccuuccuuacuaugcuuuuaacaugucucuuugaauuuuuuuuaacacugauuauucaugaaacaugaaggauacauuaaagauuucuuuuucuuuuuguuaaagcacaauaaaaucaacuucauaggauaaacuguagacuuauuuaugcuucccaaguaaucacuugacaccuaucacauauuugcaccagauauacaaggcauuacaguuuuaaaaauuuggccaguaguuucucuacuuaagagcauuuuagauauagaagauauuugcuaaaaaauucacauacaaaauaauauuuaauuuacuuaucuuuaguguuauccguauuauuuucacagucagaucuugauguucuuuuaggcuaaucauuuuaaaagagcaaaaucaguaucaagaaaaaagaaagcagaacaugucaaugguaaauggccgcaggguuaagccaauucuugaaagucaaagaguuuuugaaauuuuaugauauuuuucuuugaaaacuucuuguaaucauuccuuaaaucugaguauuuccaaugcaagccaguuguaagagccagaaaaaggcaaaggcauguagaauaucacaauaauuguaaugauaauuaguuuaaaacauagcucuaaucaaauuuuacuugugggagcuauaaaaaaaagucuugggaaucuugggcuacauaauaaauacuuuccaaucuccaaguggaaaaacaguuucugaugagguuaauauguucaauuucaauguguaauuccuuuuuuugugcucuuuucuuuuaugcauauaauugguaaacaaauaaaaaaagccugaaaguucuuugggaauuagauugaaaauuuuuuucucauugauauucucauaauagaaagugauggcuuaaaaauuuuuuuguauuaaaagcuacuacuuauaugguacuaugcuuauuacaccugggugaugaaauaaucuguacaucaaacccccaugagacauaauuuaccuauauagaaaacccuauacauguaccccugaaccaaaaauaaaaguuaaaaaaaguguuuuuuaaaaugaggaacauugcauaaaauagcaaauauugauuugaauauuuucaaggacaaggaguuguuuuugcauaaucagguacugcuuaaaauguuaauugacacagaguuucuaggugacucacuacaauuaggggaggacaaacuccucuacgaaaaaaguggaaaaaauaaucacauaauaauaauggaccagagggaaaauauuaaaaauacuaagaaaaauauaaaacaaaauguuaacuaaaagguuuggaagcaguaaauaaaaauaauuuccaauuauauaauauuagccaagccaaauuaaauuaaccauuaacaacuuacagaaauugcuaagguucuaaguugugauuuccucaucucacucuaaaauuuaauaaauuguuagucauuugguuagaaaaaguuggcuuuugcuuuuaauacuaaauuagcauuucaaagagaggcauauuacacaaaagugagauaggguaaccaaguacuuuagcauuaaugaaggauauucagcacuauguaaauguggaugagagcuaauuuccaguuuagauuuuaagaggcgauaaauaguuuacuuucuaccccccuccaaccccaguaguauuguuggaacacugauggaacaaaggccaaaaggaaaagauuacaguuaggugguauuuucaagguggaaguauaugcuugaggagguuauuugugaaucaauauuuuuaaaggcuauuuuuaguauaacagcuucuuagcuuuaagucaggguucuccauuugcuuauuucuaaauggcaagguccccaaauuagagacugauuggaauuuuaauuuaccauagcagguuuuagaugaguagauucuugacccuagaugcagcagaaagagcauucagccaagacuugaucugaggaauuucggaacugacugagaacccaucaaaagaaacuagaagagacaggacgcugggaauuuuguuugggagggagcuguccaugguuccguuaauuuugguggaacuaugaccacauacagaacaaauuccuuaguuuuaggauguauaggucaaaagucauuuucagggaaacacagugaaguggaccucaaauugugaaaggggaaggagaaaguguaaaacaguggaaaggggagguaugagccuuuucgucaggaagaccggugucauccuugacccuuuggcuuucacaccccauaucucaccugucugcaaguccugcuggcuggaccuccaaauguguaugcagaauugaucauuaccuacuggcuccacugcuacaaucuagucgauuuucuuucaucuggauuacugcaauaguugccacuguucucccucauccaacuacagccuuuuaccaaaacagcagccugagagacuguuuuaaaauaaacuagauucacucgguccaaccuucucagucauuguuaaagacccuucacaauccaaccucaccuuuucucagccacacugacucccuuuccuaaucgcucccugcacacaccagcuggauaucggguuccacuugcuuuccccucuaccaagaguguucuucucucccaucuucucaugguguguguguucucacuccuuugagggguuugcucaaaugcuaucuucuuaaucaaagguuucucuggccauuuaaagauaauccucaauccccucccaagaacuuccuguccccucccugauuaauuuucccccaaauacacucauuuaaccaauguuauugguuuacuaucuggccuagaauguaaucuuccaagagcaagcacuuuuuccccugauuuguucacuaccucaacaugaacaauaaugccagguuuucagaaaauauuuauuaauccaagcucuacuacuuguuaguugcccauaaucucuuuggauauaaaugaaugaauguaggccuuaguucuauaacagacaguaugaaugaaaacaucaaagcgaauucaaaaacauuugcaaaagcaggccuagaaaaaagauaaaaagauuuacuauuucagccaguguagagaaaaaucaaacauuaaucuaauuacaguuugaguuuaaggacuuauauuuugaaggaaauaaccauauuuaauugauggcauuuccuuuuuugggggggcaggugggguauggaguuuugcucugucacccaggcuggagugcaguggugugauccugucucacugcaaccucugccuccuggguucaagcaauucucaugccucagccucccaaguagcugggacuacaggcacgugugccaccaugccuggcuaauuuuugugguuuuuuuuaguagagauaggguuucaucauauuggccaggcuggggccugaccucaggugaucugcccgccucggccucccaaagugcugggauuacaggcuugagccaccaugccuggccugaaggcauuucuuaugagaagauuuuagauauaagacagcugacuugcccagcauuuauauguuaaaugugaggacauuucuuacugcugcuaagggauuuaauguauaucgauggggugccagugguguucucuucaacuuuucauguuguuuuagcguaaacaacucucugggaacacuuuguaauauuucuaugguuuuaagcuuaugcuucacuguuuaguagaugcccaucguacaaaauuccaagacaaguacaguaugacaaaaagaugacuuaauuuauucuuaaauacauguaauuuuggaaagggaacuacauucuaaggaaaaaugaaagcaaauuuaagauuuuuuucuucuuuuaauugcacucuuugugugugugugguuguuuuauuuccaguauuauuacuaucuacaaguaaagucuuuaaugauuucauuuauuugguagugggagguucccauggugcugcauaucaaggucaaguuacaaauuccuuuguuccugaaaauuuuucgggucaaccaaagcaaugaagccagauucuuuccccuugucccuaaguauaauccugcuccgaggguugcuaaccccaagucuuagcuggguguucucuucucucuacauuacauguguaaggacccaaauguaacgauacaacauucgguuaguuccacguagaaugugcuuucaaaccaaugauacauuuucuuaucauuuacacuuuguuuuuuuacacaaagcuuuccaauauuuaucagagauaaguucucucucuuaugcauauggacaugaaauucccuuggagaauuuuaaaauugguuuccuugcaauucuauacgugguccuacgcagagguuacaaaaucacauucagaaauuugaccaucaaauucuuaugaccagcacauuuuuauccacuaugcacgauacuuuuuguuuuuguuuguuugaaugccucuaacuuuuaguuauccacauuucucaaaguauguguuugacuuuuaacuucauaagagccaucuuugagaauagauaauauaaaauuagaaguaugaaucuccuuuaggaagucugcuaauuuuucauuagaggggguuguaaaauaaagcauuuauaccuuacuaugugcuaaauuguauccuccaaaaagauacacugaaguccuaacugugaaaccuaugaauguggccuuauugggaaauaggguucuuacagauacaaucagguuaagaugaggugauaaugauuaggaugauaccuaaucccaugagugguguccuuaucagaggaaggaaauucagaugcggaaacacaaaggggaggagacuaugugaagauggaggcagagacuggagggagguaucuauaagccagagaauaacgaggauuacugguaaccaccagaagccagaggaguugaaggauccuccccuggggccuucagacaccucaggauccuguugaaccuccauuuuagacuuccagccuccagaacauugacagaauagaacuauguuguuuuaagccaccguguuugugguacuuugauacggcaucccuagaaaaucaauacguaccuucaaaaaguuuguuuaggauucaauuugcacacuccugaaaugacacauugucuaacuuauaucauuugauaaaaugugucucauuccauuauuuuucuuuuugggagaacaaugaaaaagagcuagaaaacaaacuucuaaacaauagauuuccuguugguacaaaagcaaggcagcugauacuucacagugcugacaaguggauucugaaugggaugcugcaaguucguauucuuugauggaugagccaaaccaaggauuucugggaaacuaucugggaggcuuuucauggaguguauuccaucacuaagaaauuuucaggcagccaaaugcuugaaggaguguugguauuuuccuauaauaaauagcuaaggagccugauaaccacauccccuaauuauuuuaaaacauaacuacuugauaaaaaucuauauuuacauaccuaucugguuagcucguuuuugccuuuacuuucaauagcaaaaaccccaacugguuuugcacaaccuaauauuuaaaauccauggucuauuucaaugaggauugagaggccauuauuauagacuauauguuugugucccucaaaauucacauauugaaaccccgagccccugugggugguauuaggaguggggccuuugggggcuaauuaggucaugaggguggagccccuaugaugggacuggugcacucauaagaagagacuuaagagugugugcucucugucuuucucucucugucucuauuuuucuucgaugagaacauacaauaacaaaaugguugucugcagcuucucauuaugugcccucagcagacguggaaucugcccgcauuuugauaccuuggucuuagacuucccaaccucaagaaccaugaaaaacauauuuauguuguuuagaccacucaaccuauaguauucucuuauagcagccaaaacugaccaacacaguuauguacuggugagcuggaaagagaugugcccucuuauuaaacuucauuaacacaaauccuauccuaucaaacucaggccagcuccacugcuuucuuuuucucuugccuucaccacuugcuuugguaccuuccuaagaccugccugcuuccccauugaguucuuuagaacuccucuuccaguaagacuggcucuagaagcuucuuaucucuccucuucagcccacagcuccuuuuucuuuuaaugauaacaaaagaggaaauaaaaaugaccacaacaaagaaaauuuagaaauuuaaaaaucauacugcugucucauagccauggauuccggccuguaucagaaagcuuauuaccacguaaacagucaauagguaaauuuaauuauuguguuuaacauucuuuugauuauuaacauuaauggaguguuaucuaaaaaaauucuaguuggaggaaaauaaaacauguuaaagcagcuaaaacacacuuuacugaagaaacaugccaaauaacggaucucuuugucugcuuauccccaagaaaaaaaaaauuaaaagaauucuuggugauuaaacaucaucugaucauggauguuacaaaggaggacuaagacuuugccggcauuagcagggagcaagcacagagagauaaaauugcacacuggagugaaacggcccagccugggcugcaaagaaagcuacacaaccgggacuuaacuucaaaagaaacaaaauguggacguauuuaaggguuuggaaacaaaacagaguguaggacggcaggaaagccuuuacuugaggcuuucagugagcaggaaaaauacuuuucuucagugaguguggggaagaaauacuuugaguggugcagaaguugaugagaggccauuaaauaaauaauggucugaagucuccaguguuccuugugaggcugucucuuacagaguuaaaagaaaggcucaagaugcauuggaaagucagucagcauuuagcauuuccuagggucagaucccagguuuaaguuuaugccacacaguguucagaaaacagauucuauugccauuuaauagaugaagaaaguaagauacaguauuaaaggauccacuaauuaagugauaaagccauauucaaaaucagguaugcaggauuccaaagcucguguuuuagaacaaagucaauucuccuuuccacuauacuaguauuucuuaagauguguuuauuuuaacauuugaauccuacuuuaaaauuuucagcacagaugguauagaguugugugcauuuguguuuuaguuaaaguugcgauccagaggcaguuccucuucugaucaggaauccacaaguaagaggugucaagaguuuuagugcagaaacgguacacccacaccagagggggugacucuuagauuuuuacuauuuauucccauaucaacuuaauucacugaaucaacaaguccucuaaugaacugaaugccaaacuggguuuucuuuggugaaaucaguggucuguuagauagcauaaauguuaaagaaauguuagaaaggagauaucaguagugaacuuaaaggcauuaagggucugugguuugccacaacaccuuuuagagacacacccagccuugugugaagaugguaaaagauucuggcgaggccuguaaccugaguucuuagaaaugcuucuggaguuagcaucacuuagugauccugugccagucauucgcugaggaggcuuucugucaccuggcaccagcucuggguguagcugaaucccaccauucagcgucgcugcuucgggagaacauuugauucaaggugcagcaaguuagagagcugggaccucacugagcuugcagaagaauguuuaugaacagugcugugcuuucuugguaauaauuguucauuuaauaaauauguuuaugggcaucauaacuuguccugugacuucccuucuuuugcccucugggggcaaagcuauaggagaguagcuaauucucaugcaucccaaacuuuucagugacugacgauguuuuacaaaaagaaucuaaaaggcaugugugcaaauuggcuaaggucaaucuauaauucuguuucucagacuguguuuaucagaaucacuugaaguuuuuaaguauucaauuucucauucucuugaauuucaaaguuccagagguggggccugagagccagaauggcaaugaguucuucucaugauucuuacacacuuaggauucagcuaaugacgauauaacaaaacaagcaucgugaucauuagcugacaguauauccuaaaggcagaccauagacccaagaggaaaucaauauucuccugacuccugggcucaaaaaccagaaucuguaaacugauguaaauagcacaccauaaagaccucauauccuauaaacucuaugccaugaaugugugguuacagcuaugugcucgccccucuagauugaaaucgauaaaaacuggccuuaggcauucagggagcucauguauggccaaaaauauuccagucaagggaucagcagagauuaucaguagcuuucccacugacaacugugaucuauuugugaucauagcaaugaaaacuguuggccauaagccaaucauauugaauauuuuuuuggacgguaaccaguuuggcuauugaguuguuuuuucucacaucaguauguccaguucauucacucauaagacagcuuguuugacuuucgucuacucaucaaauauuuauugagagucuuuuaaaaaucauguagucuuaacuuccaacaaauauuauggaagauuaaagaagcagagcccuaguucaugauuuuugucucuaacuugucacuaauuagauggggagaaaugcccugguauaggacucagaaaacuuaaggugcuagcugcaaacucaguggcaagucaguaaauugccuagggccuccucuguuuccucucuagacaauucauaauaaagugacgucuugcuuaauuuguagaauuuacuaagucuuucauaaauauuuauuguucaucuacaacauuccaggauuuuuucuaggaccuugaggaauauagcaggguaugagauaaacaagguggcugcucucaugucaccuuacucuaaaaacuagaacacacacacacacacacacacacacacacacacacacacacacacacacacagagagagagagagagagagcuauauaacuauauauuuaauuaaacaaaguagauauguaaauacaaauagaaacauuuucagaggcaaacauguaacauacagauuuuaaagcuuaaauaaaagccuuuucuaagcaugugauuuauuuuuuacaucucacauugcgugauuuaggacaggaaacacaauaaucuaauaaaagauguauugaucuaaacaaaguacccagcacuuuaauaaaauauguccucauaauguauuaguuaugaaaaagaucauuuucugacaggacacauuuuuucaauuagaaaaugugacaggucuuugcuacaacacuuuuucacacauagaguuuaucauuaagauaaucuucuucuuacuaaucuuuucguuacuuaagaaccaagauguuugugacaacaugucuucuucuguaagguagacugugguaggcaccuuuaaaauggcacccaggaaucaauggcucuuuauaaucaugcccuugugaaauccccuuccuuuaacuguggacgggauuuagugacucacuucccacagguugaaaauaauaguagugaugggauaucacugcuaaauuggauuauauuuuaaaaaauacucauaguuuuuaucuggagaacuuccugacuuacuggcuuuccccuccccuccucucuuucuuuccuuuucccucucuauuucucugcccagugacccccgggagaggcuacuugaagaagaaagguauuacagaaucagaggccacagagaacugaggcaucccagccagcaccaacugucagccagguaagugagaccuaccggaagcagacgaggcuuccaaugaugcagccacaaguaacaguuugacgucaaccucaugaaagacucgcucagcaaauuacuacugaauuccugauccagagaaacugcgagauaauaaauguuuguuugaagacacuaagguuugaauaauuaguuacaaagcacuaggugaacagcaaauauuccaaggaccugacuuuugaggauuaugaggaugaauuuagaaucuccuuuuuuauacuucaaugauuuaaauuaggccagaagaauauggugacaucaucuuaauaucuucaucagaaagaaauaaaauuuuuccuuuucuuuuuuuguuuugcucaguggaauuacaguuuguuuugucaugagaucuacugagucaguugagucaaauauaaauacuucauaaucaaacuucauuuugaaaccucauuuuuugcaauggauuaguaaccaaaaaggaauggcauucuuaccuccaaaaaaguacuucucgccaguuuuaacuugaaggggacuauuaguucgaacugcugaugcuucaucuccaucgauggugagaauagcaaaauuuuccuuggcuaggaagcgaaccucgugccacuguccaucauucaacccagaaccugguaaguacaagauaaaagucauuuuuaucuuaaaauuacccagcugaacacaauuuccaaaaucaacaaaucacgauuuuacaaauaaaaguauuuuucucuuggaaaauacagugcugcuuacaauucaaacugacgucucaugucucuuuaacaucaucauaagugguucuauacuccaccuaacugaauaaggcauaauauaacccaaucaaguagagaagcaguauuaauaccgcuguguacuuagggaaagaaauggauugaaaaaaagucauuuagaugaccucggccucccaaagugcugggauuacaggcgugagccacugcauccagccacugagcacauuuuaugauuaugugcuauuuuaacuuagugaauuaugaacuacuuuaacuuaguaauuuauuuucugguuagcuuugcuagaucuuauucucagacaagaaaaugaauuuauggcuuuuaucuaaagucugucuuuguuuuuaaaaucuuuauuuuucuguauagcuuguuuucucucaauaaacacauuugguaaguauaguuuauagaaauuaaguacuaaauaauaacugugcauguguaguuauaaguacgaacugaccacuaauagucauggaaaauaaugauaggauuaucugaacauuuacaaauaaguuaucuuuauaauggaguacaugguauuaaaaaaaaaaaacagcaaaauaaaucaagaaugcauauccccaacaauggcacuucauuguugcuugauacaacgaucuuuggaaacaaaaauuagauugaauuguccauuagcuggacaguagcuuaaagcuuuuguuuaguuuguguucauuuuaugaagaauagucagaaaauuaaaaagcaaaaauaggagagcagccaggaaacauaagcaucuggacaaaguuuaacacuggguagcagagaaaaccaagagggccagaggggcuuucuucgacccugugaaggccugugcuaugacaagguggugggugggggguauuuugugcuauucuucuucagacggcacaauguagaauccacagguagaaguuacaugaggacgugcuucaguuucacaaaagaaagagaacucuaacgaauaaagguguccaaaaauagaaugagagcaaaucaaugacacacagaucaaggcuccaagcuccugauaauuuauaccaggaaucugaaaaaccacaguuuguggcugaaaucuggcuugcugccaccugcuuuucuauaaccugugagcuaagaaugguuuuuacuuuucuaaaugguuggaaagaaaucaaaagaagaauaauguuuagugacaugugaaaauuauauacaauucaaauguuaguguccauauaaauguuauuggaauguagccaaguacauuuauuuacauaccacaugcccuacaucaagagucagcugcacuggaaacuauguaguucauaaagccuaggcuauuuacuacaugugcuccuuuauaggaaaaucauacauuacuaguugguuuauacuaagaaauagaaaaacuauuuuaaagaacuuaagggcuguuggagcuuagaagauagucacauguuuguaguaguuacucauaguaaguauuauuacacauaaucaccccucaggguuuuguggguuuuuuuuaggauuuucaaauuuuaauuuaguaauacuuacugagccccucuuuuuuuuuugugauggaguuucacucuuguuuccuaggcuggagugcaaugacgggaucucggcucacugcaaccuccgccuccuggguucaagugauucucccaccucagccucccaaguagcggggauuauaggcgugcaucaccacagcuggcuaauuuuguauuuuuaguagagacaugguuucaccaugucaggcugguccugaacuccugaccucaagugauccacccaccuuggccucccaaagugcugggauuacaggccugagccacugcgccuggccacugagcacauuuuguuucaaucaagaaaacaguauaaaaucccugcucuaaaggaauuaaugcaaaagacuuuccaaauuauaaaauuuagcauacaagugaauauauguauaaauaguaugcauaauauaaauaauguaauaaggcaaacagcuaugugagcccacuaucaucucuggucuaccauaugauccagcaauccaacuacuacguauauacccaaaaggaagaaaauacguacacggaagagauaucugcacuccuauguuuguugcagcacuguuuacgauagcuaagauuuggaagcaaccaaaguguccaucaacagaugaauacagaguauuucauuaccccccaauuguuccucugauuucacucuuugcacuaacagucuaaucuccccacaaagugguauuaucuuuauaaauguauaacugagaucacacuauucccuauaacagcuuucuguucuuuuugaacucacgaaaaguacugacuaaaguccuuuuggugaacuaagaugugucaugugaaccaucuggaaugccucgugugaauuaucugcaugguuuugcucccucacaucagaucucugugcaaaugucaucuuaagagagagguggucuuuccuagcuauucuaaauaacauaucauuuuccucucucucccaacauuccuucuuuucugagcuuuauuuuuccuuauaguuucucauuacuaaauuuauuauauguucauuuacuagcauacuuacuaauuuucugucuucuaucacuugauuauaagcucucuuuugucuguuuucuucucuacuaaaaaaacccuaaaguuaaaaccaugucugguacauagugggugugaaugaauaacugaaugaaucugagggagugaucaugaccaggaaucuggcacucuagguuucauagauggccaaguaaaugaugaaacauaaaaaagcaauaaaaauagcauuggaguugcugacuauggcuucucagcucuacacgguaaugugcaauaugacucauucuaaggguaaggauuaaguggauauaauuuuuuuuguuaaguuuaauuuaaugucaauagauguuccuggaaauccccaucauccuaaguccauuuguaauugaccuuucucuguuaucaaguuauuaaaugaaguauaucucuucaucccacucuggcugucaccugcagaaaacucccauacauuucaauggcuuccaaugauguagaaagaggaacaguccagaaacuaggugugcaagggacuguaguuacuacagccucucagagagacuccagugggcuagaacucaggugcccauaguaacaaucuccuuauuaaagaaccuuuuuguggcuuuccaccccaacuugucucaccuccccucucccagauugcauuuauuggaccaaugucaaauaaacaauaugcacccauauucauauaucagggucuacuuuuugguacucauagguuacuuuguaagauaguuccucacuggaaaaagaaaaaggcaugauuuaaguccaaguucuguuucugacaagaauaucuuaagucauuuaaucccagaguuuuauuuuuccuguccauacaaaaauugggaaaacaauaaauguuauuucuuaucuuucaaauauucugaagaacaacacagauacaaucucuuguacuauaaaauuacucuaugcauguaaaggcuuauucuugaaguuaacugucagucaagcagcaguguuuacugaaauaguuccaucucaagugggucccuuuggguauucccaaggaauugaugcacugaagacccuaucuucaccauagcauuucccuuuaaaguacaaaguaggauuuauuguugauuaacuauaggacugcaugguuuuuugauuuuugucuuuauaauuugacaaacccugcuaugaaauacaguuuuaggacauggaucucaaagauaucaacgugauauuuguucaguccccaaauccaauccuaaauaaucacauguccagagauagacccuuauaaaauaucuucgguuacucuaaguggaagaacaagaaagccuuucagagaauuccacgacaauuucuccaucacaaaauuaauuuagaaauggaacaucuuccuuuuaauuuuucauggcaaaaggucuauuauucuaaucagauuaaaauuaaaagguuauuuuauuuucuuccaggaacuuaauuacuagagaaauuagaacccagauuaaaggauccuugcugauagcagccacuacuguaucaaagcuuaagcuuugauuccuauucauuucauuuccaauuauuauuuugaaauuuuaauguuaauuaucaagagguaauaccucaguaaucuaugauaaaaauggguccccaaauguaaugaaguuuauucuuaaauguggcaaggaagacccaauuucuuauagaaaaaugugcugcuucuuucauauuuugucuacaucuuguaagaaauaguauccugaaggcugucuccagagaagaauagaauuucaugaucuuuuuauaugucagcauauauaguauaaaguucuaagcucuaugugcuagccauggugauacuuugcuugcauuugauucguaauaccucacaaaauuuuuuuaaacaauuaucuccaguauauagggaaggacugagucuaccaaucuguaagcauccuauagaugguaacagguaaagguuagaauuugaacucagacauaguugguucuagagcuugaacaaauaaacaagaaccacaacaaaauacauuauuuauauagacccugugcauccaugaucagaguuuucuuauacuaugcaaacacacacacacaacacgugcacacacacacacacgcaugcacacacacacauggguacacacgcaugcgcacacacacuuccauuugcuaccacaucuggagaagugcucaguuucuggggauagccauaucucauacagcaucaggucuggaaauaaaaugaggcuuugaguagguggauuaaguauuuguauacuaguuacuauuaguauuuguacagcauuagaaugguggcugccagauaggagacaguguaucuauauuauuaagacaaaaacauggacacuuuaauucauuuuauuucauagaaaaguaagcugagacacauuuaauaauuugucuuucaucagggugcuguggcucacaccugcaaucccagcacuaugggaggccgaggcggguggauuaccugaggucaggaguuugagaccagccuggccaacaugaugaaacccagucucuacuaaaaauacaaaaaauuagccgggugugguggugggcacuuguaaucccagcuacuugggaggcugaggcaggagaauugcuugaacccgggauguggagguugcagcaagcugagaucgugucacugcacuccagaaugggcaacaagagcaaaacuucaucucaaaacaaaaaaaaaaauugucuuuggaguuuacuaucucauaauuacaaauauuaauguagugauaagcuuucuaaacaagaaagcaaugcaguaagucuuuacaauguggagaucauaaauuucaccuacaggacaacuaaaaaaugcaucuuagccaguccuuuguuaaugggaauuugaggcuugggaaaacauauacagugauaugggaaacuuauccuauaucuuaaacaacuaagacaaaggugaagaugauuuguucuacagaaauguguagaugauucacaaaguuagggcaaagacacugacauuaaaguugccugugcagacauuagaacaaaauuauuucuaaaaagugagaaugaaaaaaugaacuuucuaaaugauuuauguauguaaucugaaaaacacauaaauauuauugacaucuucacuuaggccuugacaguuuaugugcaaguuaguaaaaauauaaaauaauccagggaaaauggagaauugccuuauauuuggggucauaauauauucaggcacacguggagcuugccccauaagaggcugagauugaauuggaacccggugugguauguaccacuguuauaauucuguaccacauacagugugguauguaccauuguuauaauucguaaugauaaaaguguuucaacuguaccuucuaaaaggaaacugauauucauauaaagaaaauuuaaccuaaaacgaacaucuuugaaaccauauuacagcaccuucucauuuuauauuuuuauaacuaaauuguuuuauaauauuuucucuaacaccucccuaacuuauaauuguuagaaacacuuguuuuguaugcaaauguaaaauauuaaugaaaaguuuucuauccgugcuuucuaauguuaucauuuuuaaaguaagacucuugaggaaguugcuuugauugaacaagaagaaacagauguugcucuuauuagagacaagaagaaaagacugguuuaaugaauguugaaaaaagaaaaagaacguauuuaaaauauaauggcaaaccaagauguaacaucuguuagaaaaugcuucaaguaaaauuacagugacuggaguuuucagucuugugaucaauauucaaucuugagagcaaaauuuccuagaauaugaauucaucuuuaggcaguuacaggguucuaugauguguuacuaauauaucuuauuaauaaucaauuauccuuuuaugcaauaaaacuuuaaaaagguauauaaauuuucauauaaauaugccaugcacuauuucuuaucuauaaaaauuccauaucauaagaaaauggauccauuuugaccuuucucauuuucacaugccaaucuaaaccacauuauaaauaugaucaauuguugucagauaaaacauguaaaaaggugcuugggcagguacaagguacuuuuguuuuuuaugauaaagaaacugccaaaugccuuauuguaaaguuacaaagagucacuuuggaaugugugguuauuuuggaaaaaucacuugaauagaaacuuuaaguaaaacaaauacauuggggagaucguaugucaugacauuuuuuggauguguuauuagaaaugaucacuucauagcugggugugguggcuuaugccugcaaucccagcacuuuggaaggcagaagcgggcauaucacccaaggucuggaguuugagaccagccugaccaacauggugaaaccccgucucuacuaaaaauacaaaauuagccagcaugguggugcaugccuguaaucccagcuacuccagaggcugaggcaggagaaucaccugaacuagggaggcagagguugcagugaaccaagauugugguauugcacuccagccuggucaauaagagcaaaacccugucucaaauaaacaaacaaacagaaaugaccacuucauuuauuuaauacguagaaucuuagggauggaugggaugaauucuuuucuuacaggcacccaaauucuucuaagaaaaaaggaucuagguagugguccuuaucuugucugcacaugagagucauuugggggagcuuuuaaaguuccacccugauuccuccaaaucaucagugagagaaauuaaggcacuaaacaaauggagauacauaccaugcgauucuaaccgaaacccaacaauauaguuuuuguagaaaugcaugagaugauucaaaaauguuuaagaaaaugcaaaaaaaauccuuaaauauucaaaauaagcaaaaaagaaaaaccaaguuagagaacuuaucauuugauuucaagauuauacauguauaucaucagagaaagaucauaaauagacucacauguagguagucaauuguuuuuuaacaaaggcaccaagacaauuuaauggugaaugaaaagugucuuuuacaaaaaaugaugccagaacaacuggauaaauacagagaagauguauuuuugacuucuacuuuauacaaucaaacaaaaaaauaguucugaaaggauuugagaccuaagaaaacagaauauuuucaggaccugggggcuaacagagguuuccuagaggacaucaaaaucacuugauaauuugagauccaucaaauuuaaaaacuuuuucucaucaacagacaugguuaauaaaauccacggcaagaaagagacuaggaaaaauuauuuucagugcauguaucuuaaaacagaauauacuaaaauauacuaagagcuccuguaaaucaauaaucacuggaaaaaaugggcagaagucacaucccaaauaaagaucuauuaauuauucauaagcacauuaaaaagugcuuuauauuauuagucaucagggaaaccaaaaccaugauauauaauuuuauacccauuucgguggccaaaaauuaaaagggcuaacuagcaucuagagcaauuugaacccucaugcauugcugguuggaguauaaaauuguacaaucuuuuuggaaaacucuggacaauuuuuaauaaaguuaaacauauauuaauccuaugacccaacaaucccccuccuaaguauauaucuaccaauaucagaauguauguugcaaaaauacucauacaggaaugcuugacagccuuauucaugacaguugcaaauuggaaauaaacacauguacauacaguauauauucaaacaaggaaauauugcuaaauaauaaaaaagaaaaaggaaugaacuagugauacaagcaacagcaucaaugaauuuuuaaaauauuguguuuuguaagaaaaaccuggacauaaaaauaacauauuuuaugaauauguucauagaacuaguuuauaaaauagauacagggaggggaacaucacacaccggggccuguuguggagugaggggaaaggggagggagagcauuaggacaaauaccucaugcauguggggcuuaaaaccuagaugauggguugauaggugcggcaaaccaccauggcacauguauagcuauauaacaaaccuguacguucggcacauguaucccagaacuucaaguaaaauaaaauuuaaaaaaagaauaaaaaaaucaagcugauagaaaucagaacagcagcugucuaugggaaggugggcacaagugggaauggacuguaggguggcacgaggaacuuucugagggagagaaaaaguucuauaugcugauuccauguuugcugucuaaguguauauacucauccaaauccauugaauuguacuuuuaagaucugcgcaugucaugaacaguugguccuuauuauuugcagauucaacauuugugaauuugccuacuugcuaaaauuuaguuauaaacccaaaaucaauacccauggucauuuaaagacucaugcauguacagagugguccuaaggcacaaguuuccaacugagcuaacgcuuugccuucuuguuuaaggucucaaccugcaaacagguauucuuuucacuguauauccagugccucuuuucacuguauauccagugccuuuuuuuuuuuuuuuuuuuuuuggagauggagucucacucugucacugaggcuggagugcaguggugcaaucucagcccacugcaaccuccaccucccggguucaagcaauucuccugccucaaccucccgaguagcugggauuacaggcacaagccaccacgcucggcuaauuuuuuuguaauuuuaguagagacaggguuucagcggguugcccaggcuggucuugaacuccugagcucaggcaauccacccgccucggccucccaaagugcuggauuacaggagugagccacugcacccugccagugucauauuuuuuauacuuuggugcuuuuguugacuuugcuguuaaaagcgguccccugacauaguacugaagugcucuuuaguguuccuaaguuaaagcuguuaugugccuuacauaaaaaauauguguuuguuaaauuugauucaggcauaaguuauaaugcuguugaacaugaguucaguuuuaaucaaugauaaauauuaaauacaguaacuuuaaacagaaacacacacaaaacaagguuauguauugauuaguuggugcaaauauugugaucagaggcuggcaggaaccuaacccuguauuucccguaggaaaaaugguucaauaguugccaauucaauuuucacagugacuauacagaacauaacuauauauugacuaaugagaacgaugagaaucuacuguauguaauuuuuaccucaauaauauguaaauguuuucaaauggaguaauaguggugcuauucauuuuaaaauucaacuaaauuucauucaaugucuacuuuaugcuguguuuucuacgucaucaaacaaugggaaacccaauauauaugaaauuauuugcucuuaaacaggagaaaacaauuagacucuuaaaauguugaacuuacagagaucaauauuuuagcauauuaaaaauuaaauaacuaccccaagacuaaauguucaugaaaaaaauuuugguagcuuuuucaaccauuacugauuccuagccaaaagacaaacaucacuauacuucaaaaacucuuauuugaaacuuuauuauucugccaaugauuaauuucuuuucuugacauaaucuuacagaccagguaacuuuaguaggaauauguuuauacaaggagccauuuucauuaaucuuaucacuuuuggcagaugccugccuuccuuccuucuuuccuuucuuucuuccuuccuucccuccuuuccuuuaucuuucuuuccucuuuauuucucacucuccccaauugucucuccuguuuuuuuuuuaguauuugauucucuguugaauauaaaacacaauacaaguugucaugaauaggaagcuauuguuggcuucaaggaggguucuaauucaucugacuauugauuaaugaaaaaauguagguaagaucuaagauggggugugguaaagccguuaagucuggguaucauaccaggaugucauuuauaccaggguuucaaaugacaauaucaauccucuguuuauuuguaaauauguauugaauaccuacuauuuccuaaguacuauuuuagcacuagagauacaguaagucauaacugguuucuggucuagaaauauuuagcuauuuuaauuugaauaaguuuuuacauuucuuuguaacuugguuuccuuauagaggaaaucaugauucaugagucauaauguauaugagguaccugauacuauugagagacaguagcagcuuuuaucauuauuauuuugucauguauguauaaagacaaaguacauguauguauaaagggaaggcacuuuggagguuuuagaaaaggaacacaucacauuuuguauguagugugugaggucacaagacaaagacauuauagaguggcauuugagauggguuucagguuuuaaauacagacuuuuaaagaauacaauucuucauccauaaagugacauuuauuggaaaaaacuuggaaaacccaaaaaaguauaacagagaaaauauucauaucaugaagagaugucacacuuaauaucuguuguauuucaucuggcuuuggccaugaguaacugcaaacuacucucguuacuuugauaacugaagaaagguuaaaaaacaggaagaagcacgugaugaucaucgucugcuuucucugauuucuuaugacuggggugauuugacagucuuugcuuuucaucuuaacuuuucagcuguucucuaaagagaggaacguguaaauuugcucccaccagcuuaagcccuuuuacaguucuccuucaaagagucaagcucauucuuucacucauuuauucacucauuaauucaucucuuacaaugcaacuggcauaguuugaggugccagggguauaagaguaaagaagacacacaaggccccugcccucagggagcuuauauucuugugugcaaagacagacaauggguuuacagguacaauuucagacagugauaacugcuauaaaauaacuaaaacagagauuguaauagagagauaagaaugauugacaaaaggguaaugcucugaggaggugacaguaaaucugaagccugaaggacaacaagaggucagccacaugaugauuugaugcaaaggcccugagagaaaauaugcuugguguauuggagugccagaccaaagggaccagagugcaaaagguaagggggaaggacugaggaaauaagagaaaauauauagguaaaggccugauaaguagaaggcaagagugaagguaaggacaucuauuaggaugcucuuaccgucauuagggcaagagacgauggaaguuuggacggagguuagcacuggagaaauguggccagauuuuucacguuuuggaagcacaacuggugggucauugacuggcugucgaaaguuugagaaauagaucuguaacuuaagcaacugaguggaaauugaugccauuuaacuguaaugagagacugggggagggagucgagguugggcgaaucuguuagaucaccaaguagagauaucagguaggcaguuauauauuugggucuggagcucaagaaaaaaauguagucuggagauacaaaucguaugucaugaguguaagucacggggcaagaugaaguuaccuggggagagacuugacacagaaaagagaguuuaggcugaaccuuggaguacucuaaauuuucaaaguugaggaaauggaugagaggccagguagcagagauucuuugcuugacuaaacuuuaguuaagcuccugaaguuucuccaaggcccaucugugcaauuccuuauacaauucagcuuagcaaagaacccugcuaagucaguuuagcaagacacacccccauuccuacucccccugcucugauuuuccauaucuaauuaccccgaugauaucugaucagguuccucauccuucgccaucucccgggggaugguggaucaccccagcuuguuuucagugagaauccuguuaggacaguuuaaccagaauccuguuugcaccugauguuucuucuuaguaauguugcauccacugaccccacucuauucuuuggcuauauaaauucccacuugcccgugcuauauuugaaguugagcguagucuccgccacugcaaaaucccauugcugugguccccauacccauugagauggcacugaauaaaauauuucucaccaugccguaacaagugucacugaauauuuuuuuuucuuuaacaaagaaagauuacugagagaguggccaguaaaagaauaggagaaugugaugugaagaaggaaacuauuugaagaagcagggacuagucaacucuuauaagugcaucugagacaucaaguaaaacaaggaggagaagugaacauuagauuugagaaugugaaggagaauguugauuggaguggaaaggggagaauaugguaggugaauggaaagggaagauaugacccucgaguaguuuagcuauaaaggagaagaacuuugaauagugguguauauugagaagcuaaugaaaacuaugaauccugauccaagaaaaacucauucauauauaccccaaauuuguaugcacuuucagugguuuaggucuucucucagguucagaacccugguuuauauaauucaucauucuuuaauugcaccauuugacuuuauuggguaaugcauauauuaucauuucauuuaugcuuuucagauuauuuuucuuacguuccguuuuuucuauuuaaacauuuauagguuauauuuccuguuccuuagcuuuuuaaaauaaauauccaaguuaauuuuuuaaauuaaauauuaguauuuguuuacagucacuguuuuguucuguucuaagcagagauuuguagugauaagauuguuauuguaucauuuuaggaauauaaguuuucauuauuauuauuacaauuucuuaaaucuaaauugacuaaguuauuuuuagaccuuuauuuuugucccauauauguuucagauaaauguaauaucuuaguuuucuauaaaggcacaaaaucauccuugguuuauagaaaauugacacuauguaaacggcaaggacauucaaaucaauuccucugacuuuuucugaggauauaucuauuugacacauuguagacaauauaaaaauaaaucugaugauuccagacuuuauggaguuugcccaacuguauggucuaaugauauguaaauagcuuuauguacauauuuauaauuucuagaaaacgcuucucuauauuuuacaaaucagaguuacauagcuuuggaagaauaaauaaaaauaaauggggaagacagaguguagcugagauuaguuugguauccaacugggaaucugacaagaagucaucccaaauauaggcauucucuuguuuuccauauccuaauuguaauaugccauuaaaacucuauuggucccgucuucaaggcugguguuauccuguuagagaaaugaacacuagaaugauuacagagcaccuugccucuucuccaugucccaaaggcacauaguuccuguccucuuauguauuaaggaagaaauuauguaaugcuauuggucaaugacuuuuuaaauucugucauauuaguauuauagaugcaaugcaaaaaguauuuuuaaaaaggaauaauaggaauaucaaaaaugaaaauaaugacaauuuagacaagguuaauucuugaaucaauuuucucauuuuuucuaaauguuuauaacaaaagcuuaaaaugaaaaauugucagaaauguaauuuaauggcuuccuuuaaaauaguauguaugauuaauucuauucuuugaaauauuucaaaauuuugguuccauaauaaucauaaagaacuugaauuuuaguggcuuucauuaaaauagagccuuuuuauaccuguguuuacuggguaacacgagugagauaauuguuuuuaaguuagagagguuauccagucacucaggggcucagaaauucccaaguucaggaaaucaucaugaucagaauccugacaaggaaaagacaucuuaaaauauuacauccagguacaauccuuuaugauuugaauagaaacaauuauucuuaaauugcuuuauaaauugcauaauaagaauagaguuucuuauuucagauaauucugcauuaauccuuuuuuuauaaaacucuguuuuuauacaugccaccagauaaucuuuaacuuuuauucaaaggaugcacccaggcugcagauauaggcaaaaacucagugcuuaccuuuuacagguagguuuuuccugccaaccucucuacuacuuauucuucuacaugacuccuagcagcuucuguauguuucagcucaaugucauuuccuccaauuaaaccauuaaugaggacugaaccuugaaagguaccucucaagguauucauuaacuaugucucuucagaaaucuucaauucaacaauaaucuuuuuugagugucaacugcccuuuugguaguuuuucuuacuccuaguggcaaaacuuguguggaaaaaugccauaggugaguacguuaaaacaguauuuaugugagugaaguaacacauauuaggauauaaauguauguuaccaagucuuuuuguggauuauaaacuaaaugugauaggcauuugauuaaugguuaaaaauaaaaauauuuuaaaauguaauauuuuuauccuagcauaaauuuuaaaaauauugauuuguuauuaauaugguuucauggguuggcaucaugugcauaagucagguaugugugcuuguauauguguaugcacacauaugugauauucauuacaugcuacguaagacaggagagccgugugauauacuaaaauagaguuggguuagaauuugggcagcauguacuguaauauuaugugaagaaguugcuuucucucucuguccuccaaauuuuuaucacuaaaaugaacgcuucauuccagcugaauuacaagauuccuuuucaugcuaacuacuuaaaaaaaagacuagaauacauucaugugccauagagaggaauagaaagaccaaugaugauguauugauuuggggggaaaaaaacacguuauuuagggcacauuaaaauaaauacuuauauaauugaaguugaaaacuuuuggcuucacauuuguacuugccguucuggaugacucuaaacauuaaacacaauggccauggaacaccuacagagaugaaagagauuucaccgagaugaaaaaagaaaauuacauguggaaaauguaggacucgucacuugaauauuguaucuuaguaaagggaagaugggaaguccugguaacgucauagaaucuugggaauaaauaaaugacauaccaauauggaagaugaaaccaggaccauagaaagaacuaagaucuuuuaccagguaaaaucugaaagggaauucauagccacuucugugauuuaacgccaaguuguagagucccagaaaguacugggaaauugaagauagaaguaagauuuuugggaaaagcauuuguucucuauuucagaaauucucuggaauacuaauauuaggaugaagaugucauccagcaauaccccacaaaggcaauuaugugagagaauuucugguagguuagaugacauauaauguuaaacuucuaugauacaaaugaguaauuaucauuuucuuauuuauagaacauguccuaucuaaagacaacauuagcuagauccacagauaaucuuuuuuuauuauauagcacaauuauauuguuuuugguagcuacuugcugcguauugcuuaaaguugguugcuagaugagcaucccucuaguuaaaaugaauuauugaaacuaaaagcaaucuggaggguugguaacauucuauuucuugauauagacacuaguuacauagguauguucaguuuuuuuuaaaaaaaagccuuugaacuauacaaucauaauauggacuuuuuccauauguauaugucaacaaaauaaaauaauaaaucagggcaagaauauauuuaauguacaacauaaaaauaccuuaaaauguggaaaauauuggagucacuguuaucuuuaaaacucauuagauggggguauagaugugucaaaaaacucaugaaauaugcauauaguuguaggauauuaauauauuauaauuuagcaaaacugauagcuaucaaugccauuaaugucaugugaacugcaguguauaagaagaaauuauugguggacuauggcauaguagacaaugucuucauaaaauuuuugaaggugacuucaggacacuuuuaaggguuuucaaguugauaucacuuucaaauuaugucuaauuucauuuguaaacuuaaugguggcugggugaagugguucauaucuguaaucccagcauuuugggaggccaaagcaggaaaguugcuugagacuaggaguucaagaccagcuuggacaacagagugagacccccaucuuucucuacauauaaauaauaguaauaguaauaaauuaauaauaaaaauaaagggcuuuccuuugauuaauuaucaaccaugauuaaggcucuuuuaugacacacagauacauaauauaaaauuaagcaccauuuuguuuugcuuucccuuuaaacuguagagaguccaucaucuucccuguauuuaaauuuucucaggcuuuccucaucuucauucuucuuaaauucaccaucucuguaugccuuagacuaaaaaguauaaccagaugguucaaauagccuaauguuuaacucuugaaaucucaccacugucauggcuuaaauuagcuugaagauucucaaucuucacucugcucucacauauuugagagaugaugaugucauccaaaccauggcucacaaugacagugacuuuccuggagaagcuaaguucuuugguagcuggggauauaagucaaguuugaaaaacuaaauauacauuauuugagaaaggaguuucauguggcuggucacaccugauuuauauggauuacacacuuagacuaauagcuaaauuagaguguccccuuugugucuagcucagccuuuaacaaguuguacuaagguuucaugcccacuaucaaaucuccccaagguaaagccguagccucugaagaacaaggaggacuaagaaggcacagaauuuagggagaagaauuugaaacaguaagccggaugagcgaauuaagucacucuuggucugaagaagacauuggcuucuaaccucccuccuuuuggaagauggagguccugucuaucccccaacagcaguuucacagaaggugaucucagcucacagguguagagggugguaaacuccaguagcuaguagcuaccugcugaugaucacacaggucauagucaagggaagggucucuagaucaauucagugaaaaccaauucucuaagaguggauuggccaaaaacaauuaucuaaagaaucaggugaugacuaacucaccaaauucaucaauuuuaccaauuuauuagguaauuguguuaagaaauauucuucuugaauauauucuaugaauaugaauguauucaucuuaugaauauauucaugaauauauuucucuuaaauauauccaauaaaugugaauauauuaguaguauuguagggauuauuuaauuuaucaaaagcuaagggucauagguuuagucuuuuaauaaauauauucaugaagaacauauucaugaggauuguaguuaugaacuaaaucagccugugaauauacuaaaggaaaguauauucagggaauucuuucauucaauuauucaauacuaugucagacaauacccuagacaauaugacuacaucaaaaauaaaguuacugaccucacagagcaucaauucuuaauauacauauugucuuuuaaaaauaauauuuaauauaagcuuuuggcuaauccauuuuguaaaucuggugaauuuaccuauuucaagggagauaucuaugagcaauguugcagccuuccuauauugaaugcugaugauucguuauaaaaaucuugcaccagagguuuauuauauugguccuuaucauuauuuguaauguucacauauagccuucuuuaaaguuacauaugaacuuucuuuuaaguuauaugugaacaucaaaaauuuaauaagugaccauucuguguaacagccagaguuacuucccauuuugaaaaugaacagaugauuaaaucgagauucaaaaaauuuaagagacuugcccauauaaacuaguaaguugaaaaccugguaguaagacccaaguuugugaaauucaagucaaagauuuuuuuucacuuuucagagcugccacuuaucaucaguauuacaacucugcacuuuccaaaacuugagauuuuguuagcuggguuuagcacagguuauuaacucagauuucuacaauaacaaugaaaaggauaucuuacuuuucauaucaugggauuuauacuucccacucgcuuuauuuuuuaaagcaaauuaugguagaaauauaguacaucagaacaauuucuauguuaaagcauaaaaguaagguuaaugugaauauaacaguuauuguuacuaauucuuauuuuuauuaagcaaugaauagcuucauuaaguaauacauuagucuuucuugcuagcuuugugggagaaagaacaaugagacugcuugaguuaaacuuuguguggcuuuuaaaagagaaaauguucuuucccaaagggcacuacaaauaaaaauaaaauaaaaaacccuaagcugaacaucauuauucucugagaaagucaucaaaagaaaaugaaaauguuggcauuuucguaaacgaguuugcauuuuauugagcaugacuucuacgagagauuuuuucgucccuguaagagacgccugaauaugaagcagacuugcuggaggaugugugaccucuguuuuugucucugaacugugcaaagacagaaaagggcuuuuguuauuguuuuccuguaaaagccucaguuguuuaauuuauuuauucccagcccguucucaaagggaacucaagcaaacagaaauuggucacuagacaccucuuuucacuguugauuuucuucuuuguuuaaacagcggcuuucccacucugguaaugucuuggcucaaacaaaaguuaugguuacacaagaaagaguuuacaauuagcuguauacauuuggaaaacaaacaucauuuguacuauacaaaaggcagaaagaguccauuguaagucacuguaagaucacuuuacauguagacuugaauuguucacugugcucugcagacagaauuuaagaacaaaucucaugcuuuuauuuaggccguccaccuaucugacagaucucugucuaccaccguguaaacauccuaauaaaucccuacuuagcaucuuguaaacuuaccauuuucuacugugaucgaugaaguuaccucaagacaggaaucauauaguuauuucauucuuaaaguauuuagcguuuacauugguucaagucaauguugacuuugugacaaaagggagccauugagagcugacgagaauucuaacaaugccugguguauaguaagcugguggaucaucuagggauagguuuaugaagcaacauaaggaaacugacuaggaugauuuccuuccuucuuuaacuaggcacuuaauaauaaucaauauuauaauuuagcucuuacuaugucaagacaaugagaugauacugaagaagacaaaguuaucauuuuauggaaaucagaugcuagaugaaaauguaguuuauaugauuauuagguccuauuggcauaaacaugaagaguacugacaauaaaacuauggggacccaucgccuaaguucaucaaauauuuacugagcauuuauuaugagaaauaaugaauucaaacgucuuucucagcaagauuuauuaucucugagucaaagcuuuaagaaugaauaaucgucucaccauuagccugaucaagaaauuauagcauuauauuuuacuuuuucuuuagagaugauuauuuuuaacuggaagaaauaauacauuuauaaaaauauuuauuauaugcagaaaauuuuagugcauuaucugaaauccaaguauaucuaucacuaguaaauuuauguagauuauaacaugucaaaauguagguaaguauuacuaacacauuuggcauaauaucauaaagauaggguucagaaugauuauaguuauuuaaucaucuucauuauaaugauuucaaguauguauuuuuggcuaugucuagcaagcuauguauaaugcucuguauucaggauagaaaguaauuuguauucauucaauuuuacauuuaaaaauguaagcuccauuuuguuacaaguacaguuauaaaauccuaucacagaugcagaauuauaaauguuauuuauaauuuuuagacuuuuaaaaauaauuaugcaaguuuuauuacuuaacauuauacgaaaagacugaaauaauuuuaaauaauuauaagggauuaaugauagacauaaaauuuuauagcuauauaauggagacaauuaucacgcuuuuauuuauuuccaauaauuaugcuuuauuuuuccuuauaaaaaacuuuauucaguauaaaacuucacaaaauguacugugaaucuuuuaaaaaugugcuauuuuucauuuuaauaauuaaaugguuugauuuuacacccacugcagucauagaugagagaaauuagacuuuuuucuuuuacaucuuuaaggagguaaauuaagaaagaaauaagaauaauuuuguccccaacuauacuuccaugauuuuacucauucaacagauuguucuguaguuacaaauucugaagacuguggaugauagagaaaauauuugaaacaugguccucaacuucugagguacuuacugauuuauggaagacauauguagagaaguaacuauaaaagucagugaacauugcuuaauauuaaaagaaaucacuaugaacuauggaauggauggauuacuuucuuuugaggauauagggaagacuucauggaaaaguuucuauuuauggaaauugauggaaaagcuaccugaaaugaagagauugucaagaauuaagggauggaaguguaggaggcuauuuuuuuuuuuuuuuuugcaugguuuccaccccuuccugagcuccuagaauauauaaaugaauauccauuagcagcauauuucuaucuuuaaacccacagaguuguucauacucaauauauguuugcugaaugagcaaguggauuauguauaauucagcaagagcaauuugcaugcauuucaugguauggaaugagugauaagaccagagguaccaguugaaaccagaugaugaaggacuucgaauuucaaauuaagaaguuugaauucauuuacuauuaucuuuuaaauguuguuuacuuaaaaagaaagaaaaggaaaaauuauuguggccacuaucaauaaaguuuaugaaaaguaaaaaaaaaaagaaguuugaacuuaaucuaguaagaacuuuauagacggaagaaauggcauaauaacagauuucuugggaggaugaauauagcagcuauagacuauaauacgaguaaaucaugguacuuucuaguguacagcauccccacaaauaugcuuauaauguauaugugcaaauuucuaagguaaauauauauucaauauuauacuuagcaaccugaauuaucuccauucaacauuggaaaaucagagaaaaaauggcuaaacucaggaguucaaauaguaguaaauucugacuuuuuaauucucauuuugguguuucauuaugugauuugcuucugaaaaauuaaguuuaucuagucuuuagcuuuguaaugcuaugguucuucuguuuuucuuuucuuuuugguucucauuuggcuucuacuccuuuucugaaugucucaaacauucaucaaaggcucauuaugacauguaccugaaccauccugcuaugacuacguaaauggagaauucaaucuaguuuugagacagucuuaaauguuccuauuuauauuucagcuacucaugcaugaacuugauuacaaauuauguguacauagccauaguuagugaauccucaaaccauauugcaagcauaucauauuucacucacaggaacaacggaauacuagcugucauugguguuuuauaaagauaaauuacugaaccacaaaaaucaugagaugaauuguaacgcagcacuuggauuuuauucauggaggcaccguggcuuugucagucaaucauaggugagcacacuugguuuucacgucuaacagcauuauugucacuacugacaacucuacucaucauaggggaaguggguucuuuccagaaagccuacagggcuaaauugcauugcacauuguauuccaauucacagcaucugugcuucauuugcaguuuuuuuuuugucaauugaacgcagcauuugaaagaaaaauuucuuauaaauacaaauacauauaugaaagugugcuaguauaaaaaaccuaacauagucauuaauauugccauaucuguucccaauauacaagaagaccuuaugagcucucaaacacagguauguuuugaugaaauauuaugcuguuacaguagaaaacaaugcuucaaucuaaucaggauacagaaagaaauugugucugcauuaaaaccauuacauuccaauaugagcuucaaguuuggcaucaaauucauuuguuuauuuuuacaagcuaugguaucuguaacauagcugagacaaugguuacuucaagacaaguggcaauuuaaacuguaccaggaauaaagagaaacuauuuaauucaacuuacaaacauuuuauuggucuuaauugggcuuagauauguauauuuuacaauucuuucuuaaaagauuuugcuugaaauuaaaucaguaacaaaaaaucuuccaagaacaacaaaaagcccaggaccagauggacucacagcugaauuuuaccagaugaaugaagaugagcugguaucgauccuauugaaacuauuccaaaaaaaaaaaauuaaggaggaggcauucuuuccuaacuaauucuaugaaacuaguaucacucugauaccaaaaccaggcaagggcacaacaaaaaaagaaaaauacaagucaacaucccugaugcugggauauugcaugcaaaaacacacaugcaaaaauccucaacaaaagacuagcaagccaaauccaagagcauauacaaagaugauccaucacaaucaaggggguuuuauuccaguaaucaaaggaugguucaaccuaugcaaaccaguaaaugugauucaccacauaaacaauuaaaaaaaaacccauaugaucaacucaauaggugcagaaaaagcacucaaaauccaacaugccuuuaugauaacaacucucaacaaacuacggauugaaggaacauaccucaaaauaguaagagugauaaaugacaaacucacagccaacaucacacugaaugaggaaaaguugaaagcauuuccccuaagaaacuagagcaagacaaggaugcccacccucaauacgacuuuccaagauaguacuagaaguccuugccagggcacuuaggcaagagaaauaaguaaaaggcauccaaacaggaaaaggaauuguuaaauuaucucuguucacugaugacaugaucuuaaaggucccuucaaaagaucccuagccuugguaaaugacuucaguaagguuucaggauacaaaaucaauguauaaaaaucaguaucauuucuauacaccaauagcauucgagcugagaaccaaaucaagaacucaauuucacuuacaauagccacacacacacacacacacacaaacauacacaagcacacuaucuaggaauauguuuagccaaggaggugaaagaucuuuacaagaacuacaaagcacugcugaaagaaaccauagaagacaaacaaaagaaaaaaacaucccaugcucauggauuggaagaaucaauauuguuaaaaugacuauacugccccaaagcaaucuacagauuuaaugcaauuccuaucaaauugcuaaugucauuuuucacacaauaagaaaaaaaaauucuaaauuucauauggaaccaaaaaagagcucgaagagccaaaguaauccuaagcacaaggaacgaagcaaggagcaucacauuaucugauuucaaauuauacuguaaggcuauaauaaccaaaacagcaugguauugguauaaaaauagacacacagaucaauagaacaggauucagaaauaaagccacacacaaccaagagaucugugacaaaaucaacauaaauaaacaaugggaaaaggacauccuauucaauaaaugguguugagaaaauuggagagccauaugccuaaaaaaacuggacucauaccucucacuauauacaaaaauuaucacaagauagauuaaaaacuugaauguaagaccugaaacuauuaaaaaaacaugaaauauccuaggaaaaauucuucugaacauuggucuagggaaagaauuuaugaugaaaaccucaaagaaaaugcaacaaacccaaaaauagacaaauaacaugcaauuaaacuaaaaaguuucugcacaccaaaagaaauaaacaacagaauaaacagacaaccuacagaauggaagaaaauauuugcaaauuaugcaucugacaaaggacuaacguccagaaucuacaaagaacucaaagaacaacuucauuaaacaacaacaacaacaaaaaaauuaaaaagugggcaaaggacaugaacagacauuuaucaaaagucauacaaguggccaauaaacauauaaaaaugugcucaacaucaguauucaucagagaaaugcaaauugaagccucaaugagaugaucaaaaucaaugaugaucaucuuauacaagucagaauggcuauuacuaaaaagucaaaaacaucagauauugguaaggaugcggagaaaagggaaugcuuauauaacauuggugggaaauuaaauuaguacaacuucuauggaaaacaauacggagaccucucaaagauguaaaacuaccauucgauccagccaucccacuacuguguaucuacccaacacucauauguugaucacagcacuauuugcaauagcaaagucauggagucaaccuaaguguguaucaacagaugacuaggaaaagaagauguuugugucucuguguuugugugugugucuguguguguauauauuauauauauguguguauauauguaauauguaauauauacuacauaacauacauguaauauauguuauguaauauauuacauaaaauagauauuacauauauaugaaauauauaaaauacguaauauauaauuacacauauaaauauauaauauacauauauuacauauauauuuauauauguuuaaauauuacauuuuuauacauaaaauauauauguauagauauaaaaauauauauaaaauagauauaaauauauauguauaaaauauauauuacauauauaaaauauauauuacauauauaaaaugaugaaauacuauguagccauaaaaaaggauuaaauaauguauuuugcaacauggauugagcuggaggccauuauccuaagacaaauaacucagaaauagaaaaucaaauacuucauguucuuacuuauaagugagaguucaacaauagacacacaugaacauauagauggaaauuauagauaccggggacuccaaaguggggugggucagagcgggugaagguugaaaaauuacuguuggauacaaugaucacuauucgggugaugggugcccuaguagcccaaauuucaccauuacauaaauauauccagguaacaagccugcacauguacccucugaaucuaaaauaaaaauaauaaaaauuaaagauguugcucuucaguauauacaaccugaagcuucaaaaccaaagcaugcuaccauaauuauuaauuuuaaaacaguaauaucaauaccacaacaauuuaaacaacacaaacaaaacccagaaccccucaacguagacuguaaauuucggcgcgaaguggugauaaggugaauucaaucccgcccguuuagauuguccucagugcugggggcuucugcaggcugggagugggccaggaagcagaacauaggauuucaacuccaguuuaagcagcaguggaaaccccgcaccaugcccuuccuuagucuaaaauaaaccacaguccacagcagcaaauggaaaagaagaauagcuaaaaacaggaguguccuuaagacuucucuccaaggccuacaauucacauaucauuuuauguacguuauucuaaccucagauaacuucacucaacauaagcaaauggaaguauauuaaaagacaaaucauccagaugauaaguagauuuaaaucacacuguauauaggaagcuuaaagaaacuggaauacauggccaggcgcaguggcucacgccuguaaucccagcacuuuaggaggccaaggcggguggaucaugaugucaggagaucgagagcauccuggcuaacacggugaaaccccaucuccacuacaaauacaaaaaaaaaaaaaaaauuagccgggcgugguggcggcgccuguagucccagcuacucgagaggcugaggcaggagaauggcgugaacccgggaggcggagcuugcagugagccgagauggcgccacugcacuccagccugggcgacagagccggacucugucucgaaaaaauagaaacuggaauacauggcaagagaaaagcauaggcugaagguagagauacaguaacgucuucaaauaaucugcucuuucuacccaucaaagacagguauguaaugaacuucaaccuugugcucuagugcuuacuugugaaaaauacguauacaugcaaauaaauuccuuuagaguuuaguacugaaguagaguuuggcaaacuaacauuauguaagggagucgggaaggaaggugucagaagagaggaugaguagaaguuuguuauggagaaggguuacaagauucuaggaugagcaaucuaauuucauauuacaaggccaggugcaguggcuaugccuguaauucuagcacuuugggaggccaaggcaggcagauuaccugaagucaggaguucgagagcagccuggccaacauggugagaccccaucucuacuaaaaauauaaaaauuaacuggguuugguggugggcaccaguaauccuagcuacuugggaggcugaggcaugagaauugcuugaacccaggagguggagguugcagugagccaagacugcgccauagcacuccagccugggcaacaagagugaaacuccaucucaaaaguaguaauaaugauaauaauuucaaauuacuagagauuugaagaagcagagugauaucauuuggcuauguccccacccaaaugucauuuugaacuguagcucccaaaauuccaaguguuauaggaggcacccgguaggagaucgcugaaucaugggggugguuccccuauacuguucuuguggaagugaauaagucucaugagaucugaugguuuuauaagggguuucucuuuucacuuagcucucauucccucuuucccugccaccaugucagacaugcuuuucgccuuccaucaggauugugaggccuccccagccacauagaacuauaaguccauuaagccucuuuuucuuuauaaauuacccagucucagguacguuuuuaccagcagugugaaaacagacuaauacacagagcaugcauuagggauaauguguagugcaguuuggcuggcauucagggugucuggagcagagggagaacuggggaacaagacuggacuuggaccagacugugagaguuuuuacacuccauauaaagacauuagacaucaugcugcaaaaauugagaacauuuuagagguugcuugaauuuauuuaauaaaauaaauaaucucaugaagcuggaguucaauggagagaggaaaaaacuacacuuauuccugcugcuucucaaaugaaugguauuuuaaaggaauaucaacuuacuuagcagcuaagacaaggaucuauucaauuuaacgagguguuaucaugaucuauacaaguuguucuuucgugaaacuacuuacauuucuguuuuaaaaacuuaaauucuacguucaauaacguuacccaaaguguaaugagcugguagagauacaagauuuucuacaaauccauucugaagcugacuuccgaaaaaucagguauaaaaagcggcucuaguuuugucucuggugggggcuuccuagggggaagagaagagucauggacuaaaaaugacuuacgaaucccuacagaguaaauccagaguggaggcugccaccacagucguccuaauggcaaaugaaucaacacaacuuauuucgcacaugaggcuaugcuagcaggaaaagauuccuggacucugacuagauucaaagagacagcuuaccagaggcuuaagggcugaaagaagcagaaacaauguauaauacacacaucugagccauggcauuuacaggaacagccuguggaacaccugugugacaaucauuaguaacaaaugaggucauuugucuaaaaugcagaugcccuaagagauucuacuacccuaggucuauuguguggccugguggguggcgauguacauacagccagggcuaagagucauugcucaaauagcaauguccaauagaaauauaaugggagccacagagguaagccacauguguaauuuuaaauuuucuaguagccacauuuaauaaaaggauaaaguaaccagcgacuuaauuuucguaucuauuuuacccaauauccaaaguauuauuauuguaacaugcaagcaauaugaaaguuuguaaugagauauccugcauccuuuuuugucauacaaagccuuuuacaaacuauguacauacaaauacauacugaguauuucacaauggaagcucaucucaaucuggaaugcuguguuucaaggguucauaggcaccuguggccaguacucaugaacuagacagaauagauauagaaagaagagacaugacucaugacuuuuugcuuucauugaaacuauugcgaauucuaaaucaaccuuagguuugagucaccauguuauguugcguauuguguuuucauucuucuuuuuaauuuuuuuuuaagugauaagguaucacucuguugcccaggcuggagugcaguggcacaaucauagcucacugcagccucagaauccuaggcucaagcuauucuuccaucucagccuccugaauagcugggacuauaggagcacgccacgaaacccaacucauuuuuuaauuuaaaaauauuuuuuagagacaguggucuuaccauaauauccaggcuggucuggaacucauggccuccuggaauccuccugccucagccuccaaguagcuaggauuacagguaugagccauuguaacaagcuagucuugucucuuaacuccauggccugaaaccucauaucccucaucucuacuacuuuugccuagcaaauaccuauccauacauaaaucucagcucaaauaauccuugcucgggaaaaucuugauuguccuggcccuucugucuccuccagcaauaucaucaaaaacaagaggaauauagcaaacauguaaacaaaacccaggggaccugguuuguuuccuugucauaugugcucggcauauugugucucucauagcacuauugcagucgguugcacauguauuuaugugaugaugauucuaagucacuccuucuccuugauagaaggugcugugucuguauguuacagggucuggauugcauuauauauccaacaugguuauguugagugggugaacacuuucucagcuccugaacugagccuucccucugcugaaauagcuugagagaaucuuuguuuuuugcaauuagaaaagccuaaauaaaacauuuucuuaaccuaaaaguuacccuagauacauaaaaagaagaaauaaaagugcauuuugaaauaucuuauggucauauacacacacaaaauaagucuuuaucaauccucaaggaccaaacagaggagaauuuacugcaaggugaauuaagcuuuagauucaggacccgugaguucuaggaguucucgucuaaggaagggaagccagguuacacucaggaagcauuucaucauaacauuguaaguauuucuaguaaagcacuugacaucuuaaaaaauuagagacucgagcauccaaggcuccaaauauuuguuauggguuuuuucauuaaauaaagacuccauuuaguacuuuauuuguaguuuuguaucaagagguccccuaccuccaauuuguauaaagcuuucagcuacacaaaaccuggaugcauccaugcugagaaaauaaaaucuuucauuuucgauucuucuguguaauaggaaaacaaaaucucaauccuucuccaaaaauuuggacuguauaguuuaaaucucuuaugacauuaaaaacucaguguaucugaaaucaaacuugcucuccuucugacaucccuaaugcuaucuccauuauuuuuuuuauuaucauuauaaugcugucaguucuaggauacaugugcagaacaugcagcuuuguuacauagguauacaugugccauggugguuugcugcagccaucaaucugucaucuacauuagguauuucuccuuacgcgaucccuccccuaccccacacccugcaacaggccccgguguaugauguuccccucccuguguccauguguucucauuauucaacucccacuuaugcgugagaacacgugguguuuccuuccuguguuaguuugcugaaaaugaugguuuccagcuucauccauguuccugcaaaggacaugaacucauccuuuuucauggcugcauagaguuuagaagucagugcagcaagauauaaauuuggucauuaucuguauguauauuuaaaaacauugaagugaaugagugucgaaugagugucaaaaaagaggauguacauacauuuaaauuuuuagauaguagacauuuaauaaaugucuacaaaugguagauucauucuaaucucauagcauuaaacaccauuuauaaaaauucaaaaaauauuuggacuguaaugcuuauauauuuaccuuucuuauuaaggugaaugggucagcacaaaguagguuacaagcaggucaagggugccagauuucagggaaaagugaaagaccaugugugugggaggaaccuuccacugcuucucaccacaaccacaaacaccauucugugaagaccagaaaugucacagggacuacuccagacuucccuuggguaccuuguacucuacuucaugagguuaaucucaauaguuagaacugaggauugucaggguaggaaaaugaagagcugaaagucacugauccucucuucaagauuuuuauaaucgaaaacacacucaacacauaucaguuuuaugagaguacuaugaaaauuaaguacaaauuuuauggcaauuauuuauccagacauuuauuuauucaacaaacaagugaaucccaauucuaugcuaacagugcuaggggucugaugggaugcaaacugaucuuauuccugcccucaccaaguccauaguugcguggauagcagcacuauuauaggaauucagaaaaaaaaaaauguguuaaccuugguuggcauaauaggaaaagcuuaauagugaggguaaauuuugaaacagaacaucagagagaggaaggaugcguaccaaaaacaugaaaggaaacaagauucuaggagaggacaucaccaucaaaguuaaauuaauuaaucuuauucacuccucaaucguugaguaucacucauugccauucaaccacuggacauuauuaauacuguuuuccauuacuuucacuguugucuuuugaauuuccaugcuuuucauuacucuguuugaaauuuuuuaaguauuacagggcuaugcaaugcagauagauguaaaaagaaucaauggauguaaccuaaaggaauauggauacagcaauaccaaaagcauuuaauuuggacuaucauaugacauacauuuauucuaaaugacuuuuuguguucacccuuugucucuucucuuguccugauaaucagaaaucuuggauuaagcuaagcaagaaagccaagaggccauagaaaauccccuauugaaaaugaagcuugaguguagauggguuugauauguagccuuccaugccccuuacuguuaaguagcuuuaauuuugacauuaucucuucuuuuugccauuuaaucauaacacuauccuagauugcuaaacaguuucuuauagagaaaaugaaauaaguauucuauaacccuuacagacuuaaaaugggaacacaaaacaugcuaagaaacagauaaguuggaaacuuaaauaaagcaccaaggucagaaacugaauuuuacuuaugauaaaugacuuaauaaaagagauuaaaagaacacaacugguuauaacuacucccacaaccccaguucugccauaaaaauaaugauuaaauccaacaauaggcucaaaaucucauuuuauucacugcaauaauagauaggguuuuaaaaucauuuuuuauggaagcacaaauuucucagugaacagaaugcugcaguuuucuuaggcugcagaaauaccuuaucaugacuuuguucuucauaguaauagucucagaccauccagauacucagagcaccagaagcauggagauaaauuaugcugugaaagaucccaaugcugguccaccugccaagaucccugaggcugauacaccacaaagggagauaggggcugccucuacaacuuuuugcaaauuaaaaacuuaaaaagauguggucucaauggcuguaugacuugguacauuuaaaauaucuuugugcuauguuuuucagcuccauccggucuuuuauguuucucucucaacugguuauucuaguuagcagcuccuguagccuuuuaucgugguccuuagcuuuuugguauuggguuagaacaugcuucuuuagcucaacaguuauuacucaccuucugaagccuacaucuguuaauucauccaucucaucauccacccaguucuguguccuugcuggagagguauugugauuguuuggagaagaggcacucuggccuuuugaguguucagcauuuuuuugguugauucuuucucaucuucaugaguuugucugguucagaucuuugagguugcugaccuuuggaugagguuuuuguggggacuuuuuuguugaugcuguuguuuuguuuuucuuucaauagucaggucccuccucuguaggggugcugugguuugcuggggguucacuucagacuauucaccugggucccucccacacuuggagaugucaccuaaggaggcaaagauggcuuccugcuccuuccucugggaucucuguccucaaggggcaccgaccggaugccaguaggaaugcuccuggauaaggugucuggugaccucuguugggaagucucacccagucagggcggcacgggauccaggacccauuuaacaaagcacuuugacuguccuuugguggagggagugugcugugcucgggggaaacccacucgucugagcuguccggauuccucagagcuagcaggagaagagacuaaaucuacugauccacggagaucacagcugccccucccacuaggggcucaggcccaggaagaucagaguuuggucccuaagccccuggcuggaguugcuggaguuccugcagggagggcccacucagugaggagggaugggucagagucuguccuaaagaggcaguugggccacgaucuuccacagcuggugugcugaaauguaggaacuaccucuugggaccaagccauccagucuccccagcaccagcagaggaaaaaaugguggccuggagcuacagugauggcugcugccccauggcacacguuuaucuguguaacaaaccugcacguccugcacauguauccgagaacuuaaaauacaauaaaauuaaaaaaaaucuuugugcauauaaagaaguagugauccaucuucuggguacccacagcccugcuugucaggagcuagaauuuaacucucacuccucccuuaccugggaguccuucugaaguacaaccugagcaacgcuaagggugaccugggucucaggugccuaagagauggagcccuuucuacaaaucaagacuugccuucucaagagucuaccuauugaacuucgcagaaggcuuaauauguaaauaaccuuccuccucauguaggauuugaaaccucugucuggaaaaugcagcuugaccucaauuuccuggaccucaguauguccuuuugagcuucaccucaaauaguucauagcuguuuaggaaaacaguaaauuaagcaggggaacacuguuaacauuuguagcucauuuaaaguuuucacugaugcuaucaccugucuugcugcauccuccauugcuugaaaucuugugugaccuugguguuauuguggcugcugguauaaagguucuuaacagcuguaggguucugaugcagcugcuccaggcuggccccgucaggcaucuccucggccugaggcugggagauggcuugacgaggcuagccuggagcagcuccaucagaggguuugauaugcccuagugggcacaggcccgcagggaccaguaaguggcugcugcuccuccugcagcucagauacuccauuucagacuauucacaaccccucacuuccugaaauuuuaucccacuuccccuuagacucuuaccuuguucuaccauucuacguaucucuuucacagaggagggucuaaaaacacauugacacuaaguauuugcauuuugaaagauguuuaaaaauacuucccacaauaaauaaauaucuaacuguaaaauuccaugcuucucuggggaaaugguuuuggauugcuguccucucuugagagacucauaucacaacauuaaaccaagaguugauuucaggcucugcauaauuguaucuuucuuugaguaaucauuuuucaugcguucacuucauuugcuucuauuuuccuugccuuugucugaccuuuucaaaacaguaaguuuaccccauaucuguuugucacugucauauaaauagcagucaaauaaagcaaacacauugcuuacaucuauagagcuuccuagguuggaaugcuaaggccuccacugacugcuaggaaaaugcaagacaguccucugaauccugagcaccucaugccaaaugcgauguccccauagacucaaacacacaugcaugcucuuuccccuauacgucuugcuuugcaaauuacucuucaauucauucaaaaugauucccggaagagugaacugauuuuuaauuauuuagggagauggagaaaugagacagaggucccauuuaaauaucaagguauccauccauauguaugcaucagagcugaaucaauuucuacauaugauuucuauacuauaggaccacgugaccccucagucugcuucacuccuuccggguagagaacacaguauguaagagauaaaagacacugaaaucauauacuguaaccucacucuaauaccauuuaauauuauguauaagucaaauuaucucaggcagaucuuugaucugguccaaaaggagaugacaaaucaauacugagauguucguguuguuuuguuuauguuuucaaggaagaacaauguuuacuucuaccaggaguuaaaaauagguaacuuuuuaaauuuaaaauaucaccuuuuagaagaccuugcagacucccagauaaucccuauagucagaagugacuuuuuuuuuuuaauuuuuauuuuucucccaggcagggucucccucugucacccaggcuggaggacagcggcaugaucacagcucacugcaaccucugcuucccgggcugaagcuauccucccacuucagccuucaggguagaguagcugggaccacaggcauguaucaccacacuaccaugccuggcuaaccuuuugcacuuuuuguagagaugagguuuugccauauugcccaggcuggucuuaaacuccugggccaaagcaauccaccugccucaguuucccaaagugcugggauuggaggcaagcaccaccaccuuuggccaacuaagucuuguucccauguucaguuaauugccuauguuuguuacucuguagacagugucuacagcaaguuacuaucuguauuaguuuucuggggcugucauagcaaaauacacagacugggugcuuaagcaauagauauuuauuuccccauaacucuggaggcuggaaguccaagaccaaguugucaguacauuuggguucuucugagucgucuuuccuuguacuuggguaccuucucccugugucuuuuuuugagacggagucucgcucugucugucgcccaggcuggagugcaguggcgcgaucucggcucacugcaagcuccgccucccggguucaugccauucuccugccucagccuccugaguagcugggacuacaggcgcucgccaccacgcccagcuaauuuuuuuuguauuuuuaguggagacgggguuucaccguguuagccaggauggucucgaucuccugaacccgugauccgcccaccucggccucccaaagugcugagauuacaggcgugagccaccgcgccaggcccggccucccugcguccuuucauaccccucccucugugugugucuguguccuaaucuccucuuaaggaugccagugagaccgaacuagagaacaccguaacaacccuguuuuagauacuuauuuaaagccucugucuccaaauacagucacauucuaggguaccagggguuaagacuucaacauaugauuugugggggaacacaguucagcccguaacacacccuauguauuuaguucucuuucaaugcuugagcuuuagcauucugucuuuccgcauucaaguaaaaucauugcagguuuuuuaaacguuucaaaguguguuguaaaauccuucaguauguuccacauucacuuccacugcccuucuugaacuuuugucuuacacuuccucuuugaauugugguccuaagaacaacagucuacauuuuauaacaaaagauuaucauccauucuuuguaacuuuugcuugccuccuaacacagugccuggcucacgguaagcacccaaaaaucuuuagaugaauauaaugagaaauuuuaucauuauacaugguuauaauaaguguuauaauccugacuuaugucuagcuuauaguuaauuaugauucuuaauuaucuucugcuuugucagcaaauaaccaguuuuacuugaacagaugcuugccuaucuaaugauccaucaaaaucuuucagaauaauuguucagauuacaaaauucuaaguaacaaagaucuccaaacuugaaguuuuaaaacaguuggcugucauaauacccuucauuuuuagcauugucuucugcuaaccauuuguaucacugaauauucauggauuuuuuauuuuuuuccccagugaaaguaaccugacaacgccauucaaauaauauuuguguuaaaaggucacuucucugaccuacagaucaaaaacuugcaauaggugaguuguucuucaugguagguuuuuuuuuuuuuaaaguaucccuuaccacuugacaagaacaaguaccgagagguuuucucucuagagcuuccaaauauugguaccagcacuggcugaacaacauagaauuguauguggagcuauuuagaaaugcaacaaccuagaacuaucuuagaccuucugaucagaaucucuggggguagaggguguguuuucagaaggugaacugguaauuuuuaugcauaaucaagcugagaaauuugcuuaguaaggaaguagucccaaaauguagcugcacauuggaaucacccaaggaaccuuuaaccuggcggugccuggauuucaauccacugccagaguaacaggaauuuaaacauuucucaugugauuuaaugggugaccaaaaggauacauugcugauaaauuagaagggcauuacuagcuauauuuuuaauaaaucauucaaaagcuagaagcauaauauuaggaugaaccccgaauaacauguuuauuacaagugguucaguaugaauugccagagacuguaaaauguggacagagaugugucugguugugccucggauuuugccagagacuacaguuuuuaaaacuuagcugcaauggaauucucuggaaaacauauuauaacgcugauuguuggagcuucuaauucaguuguucuggagugagugccaaguauuuaccuuuuggcaaguuguaaaguaauacugaugcagcugguccaggaaccacauuuugagaaucacuaucauugaauuuccgcguccauaaagagccaauauccuuucacacaggugaguccauugguuacaccucucaacuaaauaauuaggagaccacaacucaaggcauacgcaccugcuuucaaagaacauuguacaauaugagaacuacaaggucuucucacagaauuccauauucccuacaaaaucacggaggaaaaaaauuauacagguucugugguaucacuauuaauuuucauauucucugaaauauuauaguguggauaguacacauuuaauuuccauuugucaucucaugcauacuauaauauuuucagacuuuuccuguccucuaaugaaugcuuggaauuaauuucaaacccuugaagauaaucuacaaggcuuuuuaaaaaaauuuuuccccauaauauuaaaagugcuuuugaaucuuugacucagagguauaggcuugcauuuuauauuauggacuuuuacaugaaauguaucuuagagaccugaaacaaaaauauuuuugccuuuacuuauuaaagccccaccugaaccaugcuaaagaaucccucuuaaguccucuuucacaauaauuagguauuauuuucucagaucuaugugaacaaacuucacguuaaguugcaaacuaggaagccaugaauaguaaagcuuuuguuagauauggcucacuaccguuccucaucuucaagguuuaguuugccuucguccuugaucucuuccauaguuuccgcggaaaaacauuuucuguucggaaauccacuuuacuuuccaaaaccauuugacuugccagucgucuccaacaagacugacccaaugaccaaucuauccuuuuguggggagggagggauaguggaaaauguacucaguuacagcuauaagcacuaaacacucucagaauuuuauucagauuuagggagauaaccuauauaaccuagaauuuauguuaucaaucuuuuuccaaaaaccuaauugaauaguuuggauaauauaaagaauacagcauucucuacuucucuagguguuuuaaauuugacccucgcauugauuugucauaaaccucaggaagucuacuccuuugaacaaaacagccucaaccuuugagauucacuuuuaagacgaugcucuugucuuucacugaaaccuuuuuaagaacaaagaaacacacacaugcaaaugauauaaacacugcuuuguauuugccauaaauguccuccauauacaguuguucagcagaaaauuacguuugaauuucacccuguguaaacauugucuucucugaagaauucauauaucuuaaaaauauuguuuauuuaauauuuuucuuuuagaaaacucagaucuuauuuuucucccuuuuucuugaugucauugucauauaaaguaauauuuuuccuauuuauacauuaucgagguauuuuaaggaaacagaagacccauuaauauuaacagaugacagauguauugguaauacauuccagagcuuugauagcagaauuggaggaaaaguaaaaagagaaaacaaauguacugaggaaaaugucucaugauuuuauacauuuuaaccuuaugucauccucaaaacuauucugacaguuagauauaaugaucuuucaacugauacccagagaaguuaagugaauaugccuacagccagguaccugauaaacuagagagaacagacuuaaauacaugucuucugaccacaacaugcuacaacccauaacgcacacuggaaggaagcuauuacaagaugcugacuuaaaauauaguuaugugacuuguaccuguagacuuccauaugaaaccaucccauacuuccaucugcuuuauucauauaggauggcugugccucugcuuucacucugaagcuuuagaauuugauaaagaaacauaugacucauccaggaaaaaacaauccagauugagaaaagggaaugugggaacaugcauugguguugggaggacuaaacugcuaugcuuuuucacuggaauuauugaagacagcauggguuagucuagagcacuagacguggaauucauguucacaacuguuaccaagaacugcaaguuuaggaggucacuuaacucuccaggccucaguuuccgcaucaacaaaacagaguuuacauuggaucaucucgauguucauuugcaccccugaucuucgacucuuuuucaccuauaagcugauuauuauaguuuauagcuggauuuagaggguaucauacaguuauaggugaguucauucaggggacuggacauuucuucaaguacgggagaacaguuagggggugcugcaaucauacgugcuugugcuguaaauaagcaaaaaaaaaugugaaggaaaaaaucuaaggacuucugauauggcuacauagagcauuaauggagauaguccaguuaauauauauuuauuguuauauaguuucaaguugcuagaaggaagauauugaaugcuccuaaugcaaagaaauaauaaauguuucagaugcuggauaugcuaauuacucugaucugaucaccaaacauuauauguguugaaauaucaccauguacucuaugaauauguaccacuaugcaucaauuaaaaaauaauuuaaaaauaaaauaaaaaaacaaauucacuuaauaaccaauuucauuuuuacucaagacuguuccaugaugauugagugauuucaccaacaggguugcauuuccugugguuucuugccaucuauuacuuugaacgucucugucucuauauuguuuuuauuuguacuuauuuacuucuuuagcaaaccaucaucauccuuguaugucacccaucuaaacacuaagauguugaacuuggugcucccauuugcacucauuuuaaucaaacaaauauuugcacucauuauguacuuaagacuuuguucaauacugaaacgaugcaaucuguucuguugccucucuccaucugccucugaaccuccacuaucgaucuagucacucaaccuauuacauuuucccaaguuccauauuuuucaugaagccuggauucuauagugagucaucucacuuaaaguuuucauuaucacccuccaugugaaaagauccuuaacuuccuucacacagagggucccuuauucaugcucaugcugaucuguggacucccaauuuccuagcgucauuuuaaaaaauaaauuguacuugaauuggagaaauaccaguaaauuaugaaugccugauggcgguaccguaguuuuggaguuccauacaugugguaaguauuguaacuugguguguuuugugccuaaggaauguuuaugagaggaauaccccuuguuagaaggaggcuauuauggcagaagguccugcacacacccacugugcauuucgucuccuugcaccugagcuguuaccuggagccccaaaggagugcuccuagguuaucugauuagauugcugagugggccgcugcaaggauucccuuugaaaggaauuacucgauguugcccugcuuggcagacuugcuuccuguucaacagacuucuguguaagcugauucugaaugugaucaauaauugccuucuaaaccucaauguuucacuggaccucaagagacugccugaugggcauugcccuagcucacuucuacaauuagccauuuacuuccucuuaaaacaacuccaucucucuacuaaaacugaauucucaaaagccaccaaugagacuuuuucccccaaaccaaagccuuuucauucucuugaugcccaagcguuuugucaaaaaccuaucagcaucccuucuuucauaaaauucucucacuuaguccacguguuucuuuuuucuccuaauaccuauuauuauuccuuuguuucuaugcuugauuuuuuuucucuuuuucccccuuaagaauuguaaauuaucaguaaaaugucaguccuaguauuuuuuuuuuccuggagccuucacucaacgucaguccugugacucaacuuauuauauccaaaucuuccuccacccaccacuacauguuuucuuugaauuacgcagaugacaccaaguucaaugcguccauuaacuguccuguuccccaccacuccccucacacagacagguucccuuaccaucucuucagaggcaacuucacauguuaguccucagguuucaaauguagaucacauuugucauccuguucccugcuucuguaauuuuaugaaguaugccuaguuuuucuuugggagcuauuuucuauuguucuaccucuuuauucucuuuaauaccacuuaguccaggcuaucacucuugacucaagccugcuuucuggacucaaggggcuuuuucuauccuguauacucuugcauacugcuccuacauuuaacacccgcauauugcuuaucaugccauuuuuacaccuagugaccuaugcuaacaugacagaaagcuguaauguuaaaugucccuaaaugaauacagagcccccuucaaguguagcucucaacaccccuucgguaggcuuuuugaauuuuauaaucuaaagacaguguccaucuuucucucucacucugggaaucgaaagaucucauuuucucccucuaggucacaaggccuuucuuccccaccaaccauagggccugucacuuuagcguguuaagaaaauaaggugcaaucuuugcuggacuaugacccagucuuccucacuucaaugugguuuauaucaguaacaaaaucuuauuuuaaaacacuaaguauaucgucuuaguuuucaaagucccaugccacccaucauuuuccuuacuaaaauaugggcuagcugugguggcuuacaccuguaaucccagcacuucaggaggccaaggcagggggauuccuugaggugaggaguucgagaccagccuggccaauguagugaaauccugucucuacuaaaaauacaaaaaaaguuagcugggcaggguggugugcaccuguaaucuuagcuauucugguggcugaggaaugagaaucccuugaacccagaaagcagagguugcagugagcuggagauugcacuacuguacuccagccugggugacgaaggcucaauaaauaaacaaauaaacaaacaaacauagaaauaaaauauguacagagaccucuaccuauuauuuauauaaaaacaaaaggaagagugguuuuaucguaaaauguauuacuuuuaucuccauuuuuuuuauauggcaugguaacuuuaccuccagaggugcaaaauuauagaauaagagcaaaguuaaacauaauugacuuuaaaauacauaguacccaaugcguacaacauauaauauuuggccgggcaugguggcucacaccuguaaucccagcacuuugggaggccaaggcgggcagaucacucgaggucaggaguucgagaccagccuggucaacauggugaaacccugucucuaccaaaaauacagaaauuagucagccguaguggcaugcaccuguagucccaucuaauugggaggcugaggugggaaguuugcuugaacccuggagguggagguugcagugaguugagauuccacuacugcacuucagccuuggggauagagcaagacuguguguguuuguguguguguguguauguaauauuuaccaauacagcauugauagguguugaaaaagguaaacaaccaaaaagguaaaguucacauuacugcugcucuagacacuuaauaugccuaaacaaauacauaaauagaacucauuuuacuuggcagaggaucauuaucuaugcacacuuugcuucuugcugcagguuuuuuccccaucauaauuuuauaucuaaguuguucacaugugcugccaauacaugauugcaauuauaacuuagaaauaaaggcaauucuacauuucuucucuuuucugagcaagauaauuguauuucuuuggaauauaaauugcuacgauuuuuagaguaagaaauucuucaaagaacaauuaagucuuugcugaaacacgaaauagaagauaguucuagagaagauuacagcguuucaauucagugcccccaaugagaauuuuaaaaauuggcuuaacuguugccuaaagucauuccucagauucuaagaugucaagcuguauguuuugaaugagcuuaaauacauucaccaacauaagcaagcccggucaacuguaaaguuauucgagugaaucaaauguuauuucccauauauaaccaaaacuaggaaaaaccauaugguuauauuaaacuuugacacacauuuaacuaaaaguuuaacacauuucuccauuauuucuuauacagaaggaaugaauagaaaaaaaaaaucaaccaaaaaaguuuguuuaaaguuaacacaagggaaucaaaaacuucuuuaguucaaaauggcucucugauucaacauuauugguuauagagaauuuuauuuuuauacuaguacuuggugauacauuuuuccuauuauugucaugcuuuggaggugcuaacuccuguaaacuguguuuuugucauucugauguaauuguaaauacuguauuauuguaaguggcauuacgaaaaaacuuauagaaccuuauagucaaggaaaaggcgagcaagaaugaccuucuggugaucagagggucuuucaaauacaaugaaguuuucacugacuccaugagaacagacugugucuugcacccugacugguaucuuucauuuucacagacaggcccuguggaguuggggguggagggaacucaccacagaaaucacaugaaugccauaaaaaucacugaaucccagaggucaggaauucagagauacuugaagacacccaagcacuggguuggauucaaagagucagaggaaugaaucccauuuuucgcacuuacuguggggcuggaggaaguuacuuacaaaagagggcccuugucacuaaaauaggaauaagacugaugccauagaagauuaagaguugccaauaagauacuaugucagcacagugcuuggcacagaagaugcacucagaaaauggcacucuuaaguacacagugguaccuagagaccacucguccagccugaagccugaggauuguucaggauguggaaugaugagcaucaugcagcagcaggcugccuggaagaaaggcucuuuuaaccugaucucugugucuaagaucacgggauucacuuuggagccucccaaacuggaagaaacaguuuugcucacagcgguuuuguauuuccuaguuaucauuauguacaccugguuauucuuucucugcuuucaaaaucuucagagaucuuugguuuccuguucccaauguggauccuuucauccucauaccaucugagaaagugauuucuuuuuaaugcucuaagaaaauggcaggggcaauaaaacaaaagaagcaauaagacgauguucuaucuuguaacauuuuaucuuuuucuaaaaaaaaaaaaaaaaaaaacagagaaccuguuaagcuaaucagcaggauuggcuccagcuggaucuggcugaugcuucuacguggcuagggaacccagguuuguuaaaaauggugcuucugggucauuuucuauauuagauuccagaauaacauggugaaucacagugccuaugcuccaaucuaguggauaagguucaauccagagaccgaggaccguaacagaaauguacaagcaucagaacgggcaguagccaauacuauguaagaaaauaaucuaaguuuuaacgaccuggacuaggcauguuauucucucccacugaggcucucugaaguucaacuucuuuaggauuaccagucuucauuugauccuugacaaggcccaaccuuauuuuuggagaaucaaguggaaugacaggauaucaacuagugaauuguuuguugaacacaagaggcaggcuuccugaguucagauccagccucugccacaaaccacauaccacacuguugaguguaagcuagcuauuuaaacuuucagugucucagguuuaucaucuauaaaauggggauaauucuuguaccuacaucauagaguaauuguguaauugggaugauuuuuuguaaaaugcauaaagcauacauaacagcagaaacugcaaauguuugauagauaugugacagaauaaaucaaucuaccaugaguuugguauuauaauuaguaucgaauccaaggacugaaaagcacaucucauaucaccuuccccccaaugcauaauuuagauuagucaguuacaaaacuuggaacagucuaaaagaaaaauuauuuuucuagccuuauuauuucauuaugguaugaaauuauuaucccugcuuuauagaggaagcaauugaaauccaggaaguuaaaauuacuuacuaaaagugaacaaaagauaaaaugugagaagagaugagacuagaaacugagaaaaaauaaaugucaccaaaccuguugggagacagagcuuuuuugcaagauguaauucacagcccuuccugaaaauaauuagaauuccuaauaaaacacuugagcaauuuucugauaaacucucaugauacuuaaagauccuuucugggaagauccacucagcugacuaucaguuuugaaacuugccuacaucuuuaauccaucuuacaaguagccuaaucuuuaaccagacaauucuucauuguaugaccucuccccaccaccccucacccaaauguuucuaccuaggggagaaucuugaauucagcuuauucagcaacuuuucauccaacagcacguuugaaauaaaacauaaugugggcuuauaaucaucuucucugagaaguugucuuuaaauauguagauauuucccaguugaauacagcacuuuuuccuauauucccaaagauucuuacuccuugcuguuuuuuuuuauuaauccccaaacucauauauccauugaauuaaacuuggaaggaauauuaggaacaaacuuguccaacuuucuugauuuaaaacaucugcaucuuuccagcuacaaacauagagacucaaagauaacuuuaaacugaagauaaguaucugcaauaagccacuacuaugggcagaaauaguuuuucuguucacaguagguucauuuuauuuguuugcuaguuggucaguugcuugccucucccuuucccauucaggcucuaggcgaaguaauaggaagguaucaugagcagugcacagucagacaugaccaaguccacaaauauuugugucuuuccauaaugucagacuuucaccaaugcuauuucaaucaucaaagccaugagcuaccugaagcuccagaggagguaauucucuuuagugcuacccauucacuuggcagagccauaggcacacaagcucaagucacuccacaggucagacaauauugcaaaccacacauaaccuaccuaccuaccuaccuaccuaccuaucuguuuugacuaaacauuccacaacaaaguaacauuuaacaucaagauaaaggagauaggaaaaaaggguuaacaaaccaguucagagagagcaauguggaccaaacaaugccucguccugauccaggugguccaucagggucuugcaaggaagagauuuuaaugugggcagagucuucggcaggggaugcuggguacuuaucacaagggacagaaagauggugucugcuaagacagcaguuuccaauuggugaaauccugcucuuuuuuauggccacagaguccucuagcgaggacuaauagugaaagggugugaaugauuauguccuuaucugguugggugcagucucuauugguuagccgaacaccuggucccuguuggcaugauggcuuuuaaaauguaagauggagucuuuuucuaagauggagcuacuuaugccaagggugcucuauaaagaaaagcucuauaaaacaaacaggaacaaagcaacccaagguugguaagagaagcucaagagaaaacaugagauagccaguaguucucaaacuuuagccugcacuggaauucaccagaaucaccuggaggacuugcucggacagacugcucagccggagccccucauugcugauuuuguaaguccagggugaggucugagaaucugcauuacuaacaaguuuccaagugauguagaugauacaaggagccacauugugaaacacccagauguguuucuucaguggaaacuucuuuuagaucaucaccuucaggccagacacacacuuuuccuccuucuccuccaaacuccaaagcucucccucccccgaaagagggacuguacuaagacugagaauccagacacaugagguugacaagacugucagauggggggguggggggugcuuaguggauaaggggcaaugauuauguaagugggagaugauauagcaggaauuucuagaaggauuucagagggaauuucccuguaaaaauucgauccucacgcugaagagccacuucggaaucuccaucugcauuuuuuuuauuauaaaaagcugauuccuuuucucacuuuuuuucuccuugcaggugaaagagauccaaaaaggggcagguucucuugaucaaaacuauccuuccaaaaguuuuacuuggagagguuauuuggguaacaaguuuaacauuugcaaauccaccacccccucuucucccacuuucccuaacaucuauuaacauaucuggauuuguuuuuauggguguucgcagccucugcuggcugauguuaacaucacauggggagcuugugaagaguaagaccagggaacuaccccauucagauccacgcaaucagaauuggaaggcuauggucugguauuagaauuuuuaaaguuuccaggugauucugaugugccuccaauggggaaaaaagucaguuucaaucaaauagucaguuacaucucugugagacugagcugucuuuuaaucuggauaaugagaaaauaccuaauccacaggcugauuuaggcagcaugaaagcugcgugaggguugugugugcagagaaaaagaaagaagggcagagggagagcuuuucagaaacggagccuccagcaaagagcacggaacuuugguaggaagcaauugacuaaaauuacugcccaaaguuauaucacaacuggacucaaucaauuaugaccucugacuaguaugaagacugaaaaccucaguuuacccaaguccacugcauuucccaacuccagcucugaaucuucuguggugugagagagagauugaagauuggugcugaaaccuuuuuuuuuuuuuuuuuuuuuaccuccaaugucuuccuuuauuauaggagacaauuuauguuauucaaaggacuuuccuaaugugguuucuuuuuaaucaagagaccauuguugguguguucaaagguguuagcacuuggauuauauugagaagagggacaaugguuacuuuacaaaauauuaauuuuuuuaacuugagagaauuaugguuugaaugucuuucgggggaauagaauguauugguaguaacuuugauaacuugugccucuuaacguggugaguagaacacaaauuuaguuuaaaucucugcauaugcaugaacuugagaaaauaacacucaguggcccacauaaugaugaaauccuauaaucacaggcauaaaacaagcuauuucuuuccuagccuuucuucuguuuuuaacaaguugacucaaagagucccuggaaauuuuccaaaaaaugggcuccuacagcaaucauguaaugcuuaaguauuuuucuuaacccuauacaagcuauauugaugaaacuugcuuuguauuuucaacuaauuagguuggguacaaauuucccucagucucugguauucagaaauuuuguauguguguguguguuuuccaccaaugcuuaaauaucaaguuuuuuuucuucucccauagaucaguggaccauuaaggccagcauugauucaaaguaacauuccugugcuucguccugacucaauuauaagacagcuuggucucuucuguccuaagcuccuuacaaccuuguucucucuucaugccuguuuucaaaaccauguaaauaauaugcaaaguucuaucccaucaaaucuaaauuuaaaccuuaggcauucaaaauucaucuucuguaagcagaaguucuauuucucauuaucuuucacuggaguggccuaauaaucauuguuuaaauagcaagacuaugggcaugcucaucaucaccuugucacuuuauucauauuguuugccaaacuagaguagucucaacuucuuuacuaaugacaaacugccaugacagccaccggccccauaagggacuauuaagagaguuuggucacaagaaaaguaacucaucaaacccuuuuguuacagaaaauagcuggauggagaaaauaccacugacccuaacccaggacaauccuccugucuuugaaugucuccaugcugcucacuugccuccuugcacucaaccaagacugcgaaguguaccugaacaccaauuaggaggucucccacuuccacacacaaaaaagggaaucccaugguaauaaaaugcuuuccagagauugucucagucucuuuuaacuauauaaaacuuucacugcuaaaaacuuuaaaccucuguugacagaaaaguagcaauagacggggaccugugccaaauuuuguaaauaaacaacuauuuuaaauguguuucagacuuagucuuuggcacuaucuaaauccuauaaccuuuucggaagcaguuuugguuccaaugugugcgguuauccaaccugcaauuaucccuuuuaugugguauuugccuauuucuaccccucuguggauacgcccucccacuuccacacaagaaugguaaaguaaugguaaggaauugaaaggagagaaacuguauuuucuuuucuuucuggccuccucuuuaucauccccuuauaccuuuuuuuaaaaauuuuuuuccuuuuccuuuuaaaauuucuauauaccuaaaacugaaccuaaacguaagcauaaaacgugcccucaauaaauguuuuagagcaugcuuaacacucuucuccuaaggaaauaagaaugaaacagaccagauggcuauguuacuuuacauauguaacauuuagucccuauggcauuuuaacuauuccuuugauauuauuagaagaaacuucaguauuccauauacucuugcaaaugauaaacaaaaaacuuuuaaaggacucagauuuuuuuaacagcaauguaucucuguccacugugguaaucagucaaucuuuaucuucaguguuugaauaauauucauaaauguauaaccuauacuaaguucuuaguaaauaucuuugaaugcaaacaugaaugaauguaaaaacaacugauugaaugaaggaaaauccauagaagauguuuucaaaugagaaaagaacucauagauaagaaauaaugggaaucugggagcagguauaaaaauggaaauugaacagagauuaauuaggccauuauucuauggugccacagaucugugauucuuauugacuguuuugaugggcauuauaguuaaugcuggucaccugccaaggaggugacuugauucuguuguuuagcagaccugcaaacaguacaaugugucuagcauccuacugaaagcaauuuuacucauuuguauuacuaagaaccccgaggagaggggaaauaaaauucaaauaacaagaaauuaucuuuaauguaaaaauguuauaauaauaucuagaaaauauguccuagcuggauuauugauuucaaaaauagaagcacucuuucuaaaucuuuauaaccuaugauauuacuuuuuauaauauuagaaaccccacagggacugaaguagagacuuguuaaauacaguggaaugaagugaauaaaagcuucuuccaacucuguucagugauugagucucagaaacuuuuuuguuggguuuagauuauguucuuuacuguaacuuuccaaaauaauuugccuuucuuucauuuuucuauuuugucauacaaguuuuuagcaacuauuuuuagugucacuauacagaaacagcaugauguuugauuuuaucuuguaacuugguuaggccaugguggucagacaucacucuggauauuucugugagguuauuuuaggaugagauuuacauuuaaguugcugauuuuuaguaaagcaaaucaccuucugcuaugaucugaauguuugcguaccucuaaaauucauauguggaagccuagucacuaaugugauauuaggaggcaggacucuugggaggcgauuagauuaugagaacagaacccucaugaguguaauuaaugcccuuagaggcccagagaauuggcuugccucuuccaucguaugaggacacagcaaaaagacaacucucuacuaaccaagaaaugggaccucaccagacacugaaucugccagcagcuuggacugcccagccucuagaacugugagaaauacauuucuguugcaugcuauuuuguuauagaagccuggagaaacuaagacauccuucuuauugaggugaggguagagggaggagaguucauccaaucagcugaaggccugaacagaaccaaagguugaccuccccaggcaagaggauauuuagugagcagacaagccuucagauuugauuugcaguagucuuucuucccugggccuccaacgugcuggcccaccugcaaauuuuggauaugcuaucugccauaauuacaugagucacuucuuuaaaauaaaucucauauauaugccauauauauguguguauauauauauaugccauauauauguauauauauauaugccauauauauguguauauauauaugcacguuauauguguaugugugagucuuauuuauauauaagauuuuacagaauuguaaauauguguauauguaaauauauaugcaugcauauauuuguauauauaaauauauacaugugugcauauauauguguauacacacacacagauacauauauccuauugguucuguuuuccugaagaacaaugacuaaugcaaacaaugaccaaaauuugaagauaaaagcugaaaggaauuggauuuuauucuacaaugaaauuuuuuuuuuuuuuuuuuuuuuuugagacagagucuuacucuuuugccuaggcuggagugcaguggcaugaucucagcuuacugccaacaugccacgcuaacuuuuguauuuuuaguagagauggggguuucaaccagguuggccaggcuggucuugaacuccugaccucgugcuccacccaccuuggccucccgacgugcuaagauuacaggcaugagccaccgcgcccagccucuaagaugaaauuuuauuugagaucuagaucaaugaaagcaaauggguuuccucucaagugcucccucuaguggacuggcaguggcugucuggaccaacccgggaugaaacagcaacugaugcucuguggaggcugagguggauugagggggccacagggcuuauuugcuaccccacagagagacgacucccuccaucccaguaauacacugaggaaggucauuuugugcacaaugcauucucuagagaauuccacuuuacaccgagguuuuuauuuuuaauuuuuuauuuuuuuagaaaagggauauuuuccucucauuuaauggcaugauuaaaauaauuccuucccaaaaugagaauuaauacucuucugagggccagcaagggcaaaaaagaacaauauaauuucugaguuuagacaaaagcaaaauuauuuuugaagucgucuaaguauuuggggaaguugcaaaauuaaaccuccagagguuuaaugucuucuaaacauuucccuuuuaauccccuaaggcccucuagaaauuucguuuucagugccuuuuguggccauauaauaaaaguuuucuacacugaggucacuuuacccagcuuuacuuucuagaguaaauuuuuuaauguuguggacucauauagcuuauuaaaaugaguaguacuaagaaucuaagaaauaaguaucuucuauaugagaaaacagucugagaacuaucucuuugcauuauauuuuuaaacaaaugauuaaaaaauauaugggcaauaggaagugauuacuuggccugaucaugcugacaccacaaaauuacaaccucucuucaaucaggucuuagcucacagaagucuuaaaaaucugcucuccaucuacuuacccugcuuaucauaucaucuaccuauuuguuauguguaucucucccacuaaaauguaaguuccugguggaucaucacuucaucuuucuuguucauugguguaucaucaggaccuaaacuggugccuggcauuuacauggaagaaauauuuguccagugaauggguggaugacuggacugcuuuauauugucaagauuuaaucagccauuaagagaaaauuacaaggaaaucugagaauuauauaucuauuuuggagacaaaaacuaacauuuaauauauauuuuuuuaacauauagggugcuuaguaaagucuacuccuugcaaagaaacgucauuuucuuuuuauuggcuaaugaaggcugcuggccccugaucucccaacgggagcugauaaagcggagauguucagaaguggcuuuucuuuaacccuuccacacucuguggagaguagguuggguuccuguguguaucagauaacuuuguauauuugaaauaggucuugccagacccaggaugaaauguacaaagagcaagaaugggaaaaugcagcauaguccccaaagggugaagugucuugggagagaaugacaguugaagaauuuagauuuauuaagucaagaauggaguccccaccuccaccucaggcagaaacgagugagaaaagucagacugauuauguguaaaggagaaaucuucacagaagcaaaacugucuaugucuucaauaagaccuauuuauuuuuauuucugugaggaaaaaccccauaauuauaaauuacaauuuuaguguguccuuggugccaacuagauaguaacacuguucaguuuauuuaaaaaaagaagaaacuuuguucaugacagcccuuugugaccugaagaucuuuuaauauuuugcaaaaugauauguuaaccagauaauggagauguggauaaaauguaucaaaauuggugacacugauuuguaggcuagucagugagcuucaccuaacaugaauauuuuuauccacaaauuuugcauuguuaagcaaugaccaggacacugaugaaaaaucagaacauaagcaauagauuaaauagauugaaucaaguugauuuguaggugagcuccuugaguacccacccacuauuuaccuuuacuuuucccauaauuauaaaaagcugugugaccuaaaaccugugcucaugaauauuaaaaagcacccaauuagaaaguuagaaagucaugugaauugggaaugaugggggaggaggaagggugcgugcuggaagaggacaggucuuccuguaaguccagacuaucugacacauaacauaaaaauagaaaauuagauaagauaaccaaaagaauucuaauuugcaacauuuaaaaaagcaaagcaggccgggugcgguggcucacaccuguaaucccaacacuuugggaguccagggcagguggaucaugaggucaggagaucgagaccagccuggccaacauggugaaaccccaucucuaccaaaauacaaaaaaauuagccgggcgugguggugggccccuguagucccagcucuugggaggcugaggcacgggaaucacuugaaaccaggagacggagguugcagugagcuaggaucgcaccacugcacuccagccuggcgacagaacaagacucccucucaaaaaaaaaaaaaaaaaaaaaaaaaaaaaugcaaagcauaguguggaauacaacauucaauacuuauaaugaccacaaauucaucaaaacauguuaaaguacauaagaaugguagccugaaaaaagaucaauggguugaucaaagucagugucucauaagugauuuuaaaaaguuaaugguaaggaaaggagaauuguuaacuuuuuacuuaggaggaagguagaguggaccaaacuuuugggauggguagagaaaugugcagagacuucuaguuagcagccuuauuuuuaaauaguuccaaauuagaaugggguauauugcgagucaaagaagaaauaauaaauggaagaauuuaaaguuuauauuugaucaaaagagcgauaaggaaaacuuugagguacaggcagcaaaacgaucgggguaccaguuuuuaaaaagcuggcaauaagaugcaaaauaaucugaaaagggaaaggcuagagaaucuaccagccaaaugaagacucguuuucugucauacuaccacagauuucaaggaauauacacauggauuauaauuaaacaaaaauucccaaauagaaguuacagaacuggacacauguaaagaagaagcggguacuacuauuuauuacagaguucugggugcauggacuacagcaaugauauuuguccuuaauguagucuaaacuuggcaaaggaaauguuuuucaguagaacaaagaccuguauuaaaaauuugaguauuucuuaacaaacuugugucagagaaaauacugagguaauaagcauuuuggaauucuuuuuucacaaagaagaaugaauggggaaauaaagauguugagguagaauaaaagaaucaggacacugaagaaacaaugauaaagucgauugcauuguaaggaggagagaaagucaaagaaaaacauuuacaaagcgaugaaaaaaucaggaaaagaaggaaauucaaauccaagaggacagucggcaguuuugcauggugcgaagaaauaaaagugaacauauuugaacucagauuuuuuuauacaucauucugcuuuauaaacguguuucaauaacuagauaugagauuaggcuugccagauuuagcaaauaaaaacacaguacaccaagucaaauuugaauugcaugggccauacuuacacuaaaacaucauuuguuaucugaaacucaaauuuaacugggccucuuauuuuaucuagcaauucuagauuauauuuacgaagacuucaccucucaguuguuucaacauugaaaugaggaguugcaaggauagagagcaacaacaacaaaaaaaguucagaagccuaagaauagggaagaaaagagcaaaacaauuucuuuuuuuuuuuuuuuuuuuuccuuuuuuugagacggagucuugcucugucacccaggcuggagugcaauggcacgaucucggcucacuucaagcuccaccuccuggguucaagagauucuccugccuuagccuccugaguagcugggauuacaggcgcaugcaaccacgcccagguaauuuuuguauuuuuaguagagaugagguuucaccaucuuggccaggcuggucuggaacuccugaccucaacugauccaccugccucagccucccaaagugcuggcauuacaggcaagaggcaccgcgcccggcagagaaaaaugauuuucuaaaaggagaaacaauuagagcuuguaucuaggaccagagaugccauugcuuugauauaaagagcucagggagaaugacccagaauucuaacaaagugaaaauuguguuuguccuugcucuuaaagacaguagcugccuccaugacagagagaaacguuguuaaagauugacuugcuucauucuuguaccuugaagcaacgucugauccuaacuaugcagucaaauuucaacagcuuaauacaaaucugauggucuuuuaaguacagaugcucuacugccugaaacugggcauugcaccugcauuaugauguuuauucaaccauacaaauaaacauggaaccauuuaguuuuacaaaaucgagaaaacagaugacacugaaauaaaagugucccaccucacccccaaauaaaugaauccaaaaggcucaaauauauuuucuuuuugguaccaaaugucuguauguuuaaaugaaaggagucauaauguagaaauaaugcccuucgacacagaauuuuuauauauaucuucaguauuuguuuucuuuuacaaauauguaauuaaacaaagugagguugggauaauaaacaugaugucaguacucugcugcuggccaaaccaaacauuggcugagaccuacucagugcugugggcuccguaacugcagagucuccugcagugaaaacuccuaagacaaugagaaaggugacacacugagggaacucgaacaccacagaggcuauggagauagacagcugagucaaacguagguaaugugaaaucacaguaaguaauuaacuuaauuguucacuccaaaauuggaagugaaacgccuggagcuugggaaggaaaauaggaaauaaaguuguuuuguuuuauuauguuuuauguagauguguagugagcuaaucaccuuguuuauugagauuuuacugugacugguuuaccuguauuugcucauugccacgacauuauaaaauaaauacuaugcauuuucuuuuuauuagagacagggucuccaucuaucacccaagcuggagugcgguggcacaaucauagcucacugcagccuugaacucuccaggguucaagcuauccuccugccucaggccccugaguagcaggaacgagaggcgcaugccaugacacucagcugauuuguuuuucauguuuuuuuuguagagacggcaucuugcuauguugccaggcuaaauacuaugguuguccucguucuauggauuaaaaaaaugaggcauaaaaaguuuaucagcuuuuccaaaaucacuuggcuaggaaguggcaaagaugaaauaauguacacuacuugcaggauggauacaccaaaaucucauaauucacugcuguauaauucauccauguuaccaaaagccacuuguaccccaaaaacuuugaaauaaaaaauauuauauaugaaaaagaugcauuacgacuuggagcucacaccugucauauucauaucgccacuugacucaguauuguggaaaauacuuucaauuacugaaaagaggaugaugauaucuauaaaaugaauacgguauguuguagauucauggaaaaucauguugcaggaauaguuuagaauuuacaauguguuuuguucuguuuaacuucuagaaauggcaaugaaacccuuaaauauuuauuaagcaagauuccuuaaacuguacuguauuuguccuucauaauauagucauuauuuucagaaaguuucuaugcccauuagagugguuauuaacuuuaaguauguaugcacagucaugaaugcguaccaauaaaguguccuuuuuuuuuuuuuuuuuggaaacggagucucgcucuauugcccaggcuggagugcaguggcgcaaucucagcucacugcaacccccgucuccuggguucaagugauucuccugccucagccuccugaguagcugguauugcaggugaccggcaacacacccagcuaauuuuguauuuuuuuuuuaguagagacgggauuucaccauguuggucaggcuggucucgaacuccugaccuugugauccacccaccucagccucccaaagugcugagauuauaggcguaagccaccacacccgaaagugagcagguuuugagauguaaacucaaaaaaaguacaaaaacacuuuugcaauguuuuuaucaagcagaguuuugcauaccaucuaucuacugacugagagaaucuuugauagguucuuaaaaacauuccuuuccuauaaaaugaccugcacucucacucucuuuuucuuucuucuuuugaguuggaugguaaauagauuauccauuuccuuguauauuaaacuacauugaauuauaaccaauuuaguauaguuuaguugcucuaaaucucuuguggucuacccuagggcaagacuuaacaauggauauugaagccagaaauaagaacaaaccuuugaaucaaaucuucuagaaacacagcaacuuaguggacugaaugaugcuuucauagcaauuguuauuaaucaggaaauuaauugcugaaucuguaucugauaacagaaagggagaauaaaugguuaaugaaagaaauaucugagagcuugaauuuaauuacguuuacuggaaauacaucuaaaugaagaaauaauaaguaggacuagaucucaagcuucuaguguggucauauaaacaggcuauauuaggcacagacacuaagaaauaaaauauauucucaaugggacgauuaagcaggagaguuggcuaacauuuauugauucugaugugaaaaaaaaacaaaaugaaaauuuucgauagcauuccauugaaaccaucacuaaaccuaucuccugcuucaucaggauuuagaugacuauuuagaaagaauuaaagcaacuagaggauauccagauaaaaucugugugugugugugugugugugugucugcacacauauuuguaggaaugaaauuuggacuauaucucgugacaaucauaguaguagacccuaaauuuugaaauucaaaauuugaggccgggcacgguggcucacgccuguaaucucagcacuuugggaggccgaggugggcggaucacgaggucaggagauggagaccauccuggccaacacggugaaaccccaucccuacuaaaaacuacaaaaaauuagccgggcgugguggcgggcgccuguagucccagcuacucgggaggccgaggcaggagaauggcgugaacccgggaggcggagcuuguagugagccgagaucgcgccacugcacuccagccugggcgacagagcgagacuccgucucaaaaaaauaaaacacaaaacaaaauuugaaauucaaaauugaaauucacaauuuagggucuacuacuauuuugucauuagcacuaucccauggaauuuaaauuucuagacuuuauauuaacuuuuuauuaauuuuuaaagugaguguuuacaaccugauaaaaaauguuuuuccaggacuguuucaaugaacagggauaaucauaacccauguauauuuuuuaacuguuucauaauacuucugcuuuaguaauaguugauagaaauguacauaugacugaauuuccaccacuguguacuuguacaaaugccagcaguaauugcuuauugcaugcuggaaguggauucagccauuauucuugagaauuuauuccauguuaaucuuuaauagaaacuggaaaugcacaagugaauagacaugaccccugaccuuaaagaaauugcacuucauuauaaacacaggcauucaaauaagcauucauaacgcaaagugaaaugagcugcauggaguuguagauaagauacacucuucaaaguggagccagcacuugaacuaguuagagaagacagguuacccugggcaugugcagaaauaugguggcacauuuggaaaacaacagagucuguuauugccagaguacaauucaagaggugaaggcuaggcuaggcacaguggcucacaccuguaaucccaacacuuugggaggccaaggcaggugaauuaccugaggucaggaguuccagaccagacugccuaacauggcaaaaccucaucucuacuuaaaauaaaauaaauaauaaauagccuggugugguggcaugugccuguagucccagcuacuugggaggcugaggcacgagaauugcuugaaccugggagucugagguugcggugagcugagauugcaccacugugcuccagccugggcaacagagcaagacacugucaaaaaaaaaaaaaaaaaaaaaaaaaaaaaaaaaaaagaggaggugaaggcuaaaggaaguggcaugauagguggcuagauacgcagacaagaaaagauuaagucaucauguuuuugacaauccaaaggguauaaauuuuaccuaaagccuuuuaagaauuuugggcauggcaaucacaggguaagguuuauuuuuacaucagucuuuagcauuguggaaggugagcaauagaggguugcuuuagguuacuggaugggaggauuuuaggaaguggaguuggaugaauugaguaauuggaugugggagauaaggggauaggagaacucuaaggugagucccagguuucugcuaucaaaucaaaauaagucauacaggaguugacuagauuguuggcagugcccccagcuccgagcagaauaaaauagaaauuucuuucuagagaaagcacucucaauuuagacaauugggauuuuuacagguuaagauuuaaaaaagaaaaaaaaaaccaaccaaaaagaaaaaaaaauugaaggaauacgacaagugagagugaguacaaacaauaaacaaaauuuacagacuccagugaaauuggaaugaucagauacagacuauuaaguacaugaaauguuuaaaggaggauagacuguuaaaaaaaaaaaaacaagcuuaaaauaaaauguaauuguugaaaugaaaacucaguaggugacacacagcagaauaggcacaguuauauagagaauuagccaggcauggaaaaucagagagccagugggguuuagggcaaccaaggaaugggggcagcccacacagcguaucagagucugagcaggugaagaggcuuucucaagugagaauggcuugauaugaaguguuagugaagacagcgucccugcaguagggggaguuuccugcaguggggaggucagugccugaguuagguuuggaggguauccagacauggagagauggcagcaguagugacaagaaauugcuuauaacuggggguuaaguauauaaauaaguauaucaaagacaaugggagccaggauuuuuccaguuggaaaagagagucaaauuaugucaaagaggaagacuggaaugaacccuaugacauuggguuggcauuggaaguacuugugugaauucacggucuuucauauuuaaaaguagcaaauuaaguauuguugugaauaaguauguuauucaucuacacacagaugugcauguagucccucgggcaucuacugggaggaccuugaagaaugggcuuauuauauuccaaguugggaaaauacaagaugauuuuggaacaacauuuacugccagaaagcaggaagacacucacgaaaugauagcaccauaaugaaaggacacagacaccugcuggaaggggcucccauggguuaaaucuggaacaaugugggcuucagugugaaaaaauagaagcgagaauggauuauuacaccuuaaauaaaauaggacacuuuuaauccauaccgauauaaguacauaaagaaauaaaugugagaucugauuaggagaaggcauuuauauuucaaaguaccuccacaaaaauacuaauugccaagggaaaaggcauucucauaguggggaagucugguacacaacaccuguauuagucaggguucuucagagaaauagaacaaauaggauacacguguauguguauauguaaauacacacacacacacacacacacacacacacacacaccaaaaacuccaucucuauaaaaagguucauuguaaggaauugucucagguaaucacagaaccucgcaagucuaaggaucuuccaggugagcuggaaagcuggagacccaggaaagccuauaguuuaauacuaguuugaguccaaagacaggaaaaaaaaacaaugucuaagucaaggccagcaagcaagaauucucucucacucggggaagagucagucuuuuuguucuaaucaggccuucaacugauuggaugaggcucuuccacaauggggagccccuucugcuuuacucagucugccaauucaucaggaaacacccucacaaaagcacccagaauauaaugucuggcuaaaugucugggcacccuguguccuagcucaguucacauaacauuaaccaucaaagcgucugcaucaaauaaucacaauaaugggauggcuugaaacugugcagcccuuggcaugaugaguaugaaacaggaucacuccugugauauuccugccaaagaugcaaaacuugaaacuaaccaugagagaaacccaaaugaagaccaagucugcaaaacaaacggccucaucgauaaaauuucagucuugagugucaaggaaagacagcaaucucccaggcugagggaaauuaaggaucaaugaaacucgcugcaacaugugacucugaacugcaucguuuugcuauaaagaauacucugggccgggcgcgguggcucaugccuguaaucccagcacuuugggaggcugaggcgggcacaucaagaggucaggagaucgagaccauccuggcuaacacggugaaacccugucucuacuaaacauacaaaaacaauuagcugggcauggugucaggcgccuguagucccagcuacucuggaggcugaggcaggagaauggugugaaccugggaggcggagcuugcagugagccgagaucgcgccacugcacuccagccugagugacagagcaagacuucuucucaaaaaaaaaaaaaaaaaaaaagaauacucuugggacaacuggugaaacucaaauggaaucugaggauuagaaagaacuagugaaauaauguuaauuuccugauuuugauggauguaaucuggauauguagaauaauguucuugcuuguagaaaacagacacaaaaguauuuggagaugauggauggaaacuugcccacuuacuugcaaaugaaucaggagaaaaguuuauucuucaguauucugugaguuugagguuauaaaaucaaaugaauaaaauagcaauuagauuuucuuuugaguuuuuuuuuuuuuuuuuuacuguggauagcucauaguuuguagcaugcuaauauuuuuuacacaaagcaaccccugggaaacauagguauuuaaaaguggaauauuuucauuaauaauuacaaagagauguaauaaagacagugaauuuagagugaauauagcaaauaauuacugucauggaaauaauaugaucaagacugauaguaaaucaaaauauuugauaaaagaugaaaauuauuuuaaauuauauaucuuuguuuuagacauauacauuuucauuaauucaucaauguuuuuauauaagacuuuuuuccuuuuuucaaauaagguauaauuggaucacugcagcauaguauuuaaaaaauaaauuacauguguauguguauguguguguauaauauuaacaauuucuuuagagugugaccaguagucaacugucucuauuaauuuuuguugcauuuuuuuuuuuuugcuuuuuuggucaaaauuuuaugguucucacaccacaauacuuuaauauaauacuuaaauaacacuuuggagucuuuacaaaucauuaaaguagguguucaugacaaaguuuguuuucucuacauaucacauuuuauuaggguuauguuauaauuuguuaaauuguggaauuaaaauagcaaguaaagauggcuuaaauuuaauguaagaaaagaaauauugcagacucugugagucaacaguucagcuggcagaagcagcagcugcgcacaggugacuagggaucacccuguccaucaagccgugucauggacccaggcagccuaacuuauggaagaaauagggaacguuuguuaacccugcuaaaacagucaugagagcuuuaucucuaaggugggauccugaguuauuuuguucuccauuuucuguucacuuuuaagucaucuguuuauaaagacaccaugcuaacuaaauaagggaaacuaugagugauuuuacugaaggaauauauaaaccuucguuuugauuuucuuuagguagaaucaaucugaaaagcccauguacaguuacagauuggaagauaauaguuuguccaauuuguucauaaauacagaaauaauagaacuaauuuucuuuaauuaugaaauuuuaauguuaugauugaacuagagaaaccacauucaucuacacucaaggcuucuccucuuuuacaugguuuauuuugcuuaccaguuacagaucacccugaaauggugguuucaauaauuguucuucagaaaaagaaaagauaaacgcuuuuaaaaaagucauuaccaagaucaaugucagaaaguuucccccuacguuuuuuucuaggaauauuaugguuucagauauuucauuuaagucuugaauccauuucaguuaauuuuuuacauuggauaauacaggagucuaauuuuauucuuuuacauaugaauauccaguuuucccaaacaucauuuauugaugaaacuauccuuuccccauuguguauuuuuggugccaugucaaagauuaguugauaauguguguguaaauuuauuucuaggcucucucuuuuguuguauuucugugucugugcuuaugccagaccauacuguuuuacuaccauagucuuguaacauaauuugaaagcaaggacugugaugccuccagcuuuguuauuucccaggagcguuuuggcuguuugcagucuugugguuucauuaaaacuuuaggauugucuuuucuguggcauuucugugaaacggcauuuccgugaaaaacgccauuggaauuuugaugacuaguuugaauuuguagaucgcugugguuuauauguacauuuaaauaauauugauucuuccaauccauguauaugggcuaucuuuucauuuaucugugccuucuucaauuucuuucauaaaugucugauaguuuucaguguacagaucuucaccuucuuggauaaauguauuccuaagucucuuguucuuuuaaugcuaucuauuauaaaugggaucauuuucuuauuuucuguuucaguugguuuguuuucaguguauaaaaaugcaacugauuuguauguugauuuugugucuugcaacaaaagcgcaaauaaacaagcaggacuauauaaaacuaaaaaguauccacacagcaaaaaucacaaacaaaaacaaaaaucaauuaacaaaauaaaaaggcaaucuaugauauggaagaaaauauuugcaaaccuuauaucugaugaggaguuaauguccaaaucauauaaagaucucacacaacucaauguuuaaaaauaaccugauucaaaaaugggccaaggaccugaagagacauuuuccagcaaagacauauaaauggccaacagguauaugaagagaugcucagcaucacuaaucaucagaaaaauacaaauuaaaaccauaaugagguaucaccucauacuugcugggaugguuaucaaaaagacacgugauaauaaauguuggcaaggguguaaagaaaagugaacucuuguacacuguuagugggaauguaaauuuguacagccacuauggaaaauaucauggagcuuccucaaaaaccuuaaaauagaacuaucacgugaucuggcaaucccacuucuggguauauaucaaaaggaaauaaaauaguaugucaaagagauaucuacucucccaugucuauugccacauuauucacaagagccaagauauguaauagaaacaaccuaagugucagucacagaugaauggacaaagaaaaugugcuguauugaauagaauauuauucagccuuaaaaaagaaggaaacacugccauaugugacaacauggaugaaacuggaggacauuaggugauaugguuuggcucuguguccccacccaaauuucaucuugaauuguaguuggaucgugaagacgguaucccccaugcuuuucucauuguagugagugcguucucaggagagcugauguuuuaaaaguguuuggcaguucccgcuugcuucacucuucucuuuugucugcugccauguaauacgugcuuugauuccuuuuugucuucugccuucuaccaugauuguaaguuuccugaggucuccccagccacacagaucugugagccaauuaaagcucuucccuuuauaaauuacccagucucagguaguaucuuuauagcagugugagaauagacuaauacauuaggcuaaguaaaaugagccagacacagaaggacaaauaguguauaaucucacauauauguggaaucuaaaaguucagucacaaaaacaaagaggagaauagugguugucaggggauaggguguggaguaaaugaggagauguugguucaaggguacaaacuuucaguuauaagaugaacaaguucuagaggucuaauguacagccuggauuaauuaaugcaggauagaugcauuaauuacuuugauugugauaauuauauauguauaucaaaucuucuuuuaccccuuaaauauguauaaucguuaugucaauuaaauauuucaggccauccaccaugguucaugccugcaaucccagcucuuucagaggcugacauggacgaggucaagagaucaaauccauccuggccaacauggcaaaaccccgucucuacuaaaaauacacaaauuagcccagcaugguggugcaugccuguaguuccagcuacucaggaggcugaggcaggagaauugcuugaacccaggaggcggagguugcagugagcugagaucgcaccacucuacuccagccuggugacagagagagacucugucucaaaaaauaaauaaauaaauaaauaaauucaaaaaauaaaaaauaaaauguaacugaggcuuugaaaaacagaugaaagauuaaauccuccugagaucuuggaugcaaaacaaacucaguaaauaacaguuuaugaaaccucagauuucuucaaaagcguguucuucauuuaacaugugguaaauguaugaagccuuuggaucauuuaauugcaugucaguauuaaaauuuuaaaaauaauuuguaaacaacauuuuaguaacuauauuuuugcuuaaagauuggaaacucguaguuugauguauaguaaguuucaacuaugucccccucacuauuuuagcagaauuuauauuuaauauuuagaaagaugguuuuaagccacaaaauauaaagcauuaauagagccauggauuagaugucccguuauuuucuuucaaaucugaauagcauuuauuuuuuaauuuauuauauugcaauuucaguuauaauauguauuuguuacaucaggagaaaagauaaaaaauaaucuaccuuugcaaguuuaauuugaugccuuugucgacauagacaagaacauauuuucaaugcaauggugacugagaauauugauuacuaccuaggaguuuucacuaagcuugaguaaaacauuguucucaauuguaaguccaucaacccaacaugauaaaauaugaauggccuuuucuaucaaguuuauuugaaaccugucacugugucugcauuaauacuuguagauaccaacuggaaacacuguguaacuuauaguauagagguuucuguuuugauuuguguaaacacuuucuuuuugucaggucagaguuuuauuguggcuuacauggagauaacaaagcuuuaccaaguggaccacccaucugcucaacugccacauccucaaugcuuuuauugauucaaaaccaaaggaguuuugaaacaguugaguuaaaagauugacuaaggaguuuaauucuaacagcaauuuucaaggagagaugaaccaagcuguucauucuugaguaaagcuauggaucccaguucaaaugaauaagcucauuuacaaacuggaguugcuggauguccugucaggcauaaggaaaaaaaugaauuuugugcaucccaaaugggcuacuuuuaaccaguguaaugguuuucccagguuagauuugcauauuaggauuuaagaguuucuaucuagucucucucucuauauauauauauauaaagaaaauguggcacauauacaccauggaauacuaugcagccauacaaaaggaugaguucaugucucuuacagggacaugaaugaagcuggaaaccaucauucucagcaaaauaacacaagaacagaaacccaaacacugcauguuuucacucauaagugggaguugaacaaugagaacacauggacacagggaggggaccaucacacuccagggccuguuggggggugggggacuaggggagggauaacauuaggagaaauaccuaauguagaugacggguugaugggugcagcaaaccaccauggcacguguauaccuacguaacaaaccugcauguucugcacauguaucccagaacuuaaaguauaauaaaaaaauaaaaaagugaguuccauauccuaauggaaauucuucauuuaaauuuacugaaaugauaugauuagauauuucguuacuuaaauaguaucuuauaucuaaaugagaaugcuccaagaaaggcugagaggcuguuuacaucuaaccagugagucaucugcucagucuucccucuuuuaacaagauuaauuguccuugcuccuaaagcuggauccuucucuugugcaccagaucuuauagccccuuuccccuuccugcucagggaaauuucuccagcaauucccccuuucuccuacauuacugacuguuuuagccuccacugauucauuuccauuaucauacaaacacguuucuuucauuaaaaauaaucauaaccauguuuuccucuguaccuauuacccaauuuuucugauccccuuuguagcaaaacucacuuucaaaaguaagaaucuguauucucugguuucaauagcuuuuuacuuucauucuuucuugaaacuacuccauacaggcacaccaacucauuucuuaggcucaucauuauuuucaguccucaucuuaaugacuauucagcagcauuugaccuacuuguucaucuacuguuccuugacacgauuuuauuugcaggccuuuacaccaauccuuagccauuccuccaucaucugcuucuacucucugcuucuuccucucucaccaaccgauuaauauuagagugcaaaugaagaucagccucagacuuuccaccuuuucuuucuacacucacucccuuagcauucuccuucagucucacaacuucaaauaucaucucuauauugggaauucuucaaguuguacacccccagaucaugucuccccugaauuccagauuucuauauucaagugccuauuccacaucuucccuggaaucaugaguagagagcccaaagucaacaugccuaaauuugcaguccugauacugaacccaaaagcaggcuguauguaaccuuugccaucucaauuuaugacaacuuugaacuuucuaauacuccagggcaaaaaccaaaaaccucuauguccuccaugacccucacugucacuguucccuuucguccaucuguuaacacgucguauucagaguccaaccacuuccuucuagcccuaccaauaaaacgaccuggauauuuguaauauuuucuaacuggucagccuuuuucaacuugcuuuccuaucauccauuuucaacguggcaguuagaaugagcuuuuaaaaaaacacaagucagaucauuucacuucuucauucaaauauucaaauguuucccauccuacucagacuaaaggccaacauuuuuuuuuuucaguagcuuacaagagucuagauauucuccaggucccuccacaccagcccuauucaacuucaucuucucugaucuaaccagaagggcuuccuuuaucuucuuggaccaugcagggcaucuuccugccuccuggccuuugcacuugcaguucuuccuuccuacauugcuuucaccaugaauaaccuccugacuugcaaccuugguuauguuacuaaauugccaucuucucagggaagcuguuucuaaaaaauugaaacucuacuucccaguauauuucacuccccuuccuuacuuuauuuguuuucacagcccuuauccuuuucuaauauacacuauaauuuauuugguucaauuaauugucuguaucuuuccaccaaaauauaagcucagugaggacagaacuguuuuugaguuuuguuuccuguuauauguuuaacugguacaauaaagguagucacuaaauaaauauuuguuaaauuaacacauaaaacuugaauaaauucuggguuaaguauacugaaguagcaugaauuguaaaggaacggaauaguaaaagagcggaaggcuaauuucuugcugugugcagagugaagaggauaguucugggaaaaucuccaaaagaggcaauuuguaaagcuauguagugggauagguuuaugaaggagaguuggaggaucuaaaacaguuuucuuuaaagcuguccuugaccuaaagaaaaccugccaacgauauguugaauucaaaaugcacaugggugagagaaggaaaguuuccucuaaugauuuuuuuuuuuggcuucuuuucuuggcucccaaugcuccucauugaucuccuaccaccccgggaagaguucaugccacauuuccaugauauuuccaagccauggcaugacguuucaacuacacgaugaaguccuaauauaaaugauuguuuuuagaccauguucucuaauaacuuauucacuuuacugaggacuaauuaggaagaaggaaaugguuucuuagagcaagcaguagaagguuuucacugggucaguaaagaccucgaucauauugcaacagcugcaacaacaaccaucuuuuauugagggccuauggugacaauugcacuacaucuauuauuucuaacucuaacaagaacauugcaaagaagggauaaugacaccuuaucagauaaggccguuugggcuuugcaacuuaacaugcucaaagacauugaggggcuaagugcugauauuagaauugaaauccuuguuagaauccuugugugcccauucuguuguacaaagcauaaauaacuucuuaguuuucuuucuuucuuucauucuuucuuucuuucuuucucucuuucuuucucucuuucuuccuuucucucuuucuuccuuuccuuccuucuuuccuuccuucuuuccuuccuuccuucuuuccuuccuuccuuccuuccuuccuucuuucccuccuuccuucuuucccuccuuccuucuuucccuccuuccuuccuucuuuccuucuuuccuucuuucuuucuuuccuuccuuccuuccuuccuuccuuccuuccuuccuuccuuccuuccuuccuuccuucuuuccuuccuaacuuaaaguacuuggagugaaaagaauuccagucuccaacaccggaauguuaagaguaugcagguguaaaacaaagaagcacaauguccuaaugcuguuucauuuuaaagcucaauauaaauuuaaagccaauuuaauauguucuuuaaaaguuuuugaugacauuacuggcagcaugauaaaauguagcauagaaaauggaucauuccagggaaaggucaaacugcaaaggguacuuuaaaccuaauuaaaaacaagagucauauuauuuaggugggauaacauuuaucccuacaccgaaagggacaaaagucacuuucagcagguauuguguuuguuccuagcacauuuuuuagcuagaacgaaaauauuuuaggaaaauaauuaaucagguuauaaauauuuaaaacuauaaaacaaacggcaacccuaaaaacauuuccaguucagcuacaagacagaacauuugugaaguucucuagauucacaaguggccacugauaauugaauuuguaauugacaguuguacuuuauagugagcaauauggugcuguaauuauuuuagaacuuuuaaauugucacuucuauuugaaaggccuuaggacaugguaaacacagacaagauaauugaggguucaugauuugggauguuuuacuuaacugcaaguaauuuaauucaagucacuaagucuuuaucaaauguucuacgcugugcucacaacauacuggacaaggaagggagauuugcuuuuaaaaaguguauaagauacaguugucucuaaagucauuagaggacuugguaagaggguucagaaaauagcccuaucuacuaauaaaaaaacaaaaucaagaaacuuugguguuaaauaaaguacaggaauaauuaauauguuucauuguagaggauaucacugguguauauguguguuuauguguguguauauguguauauauagagaggggggaaacauggauaauguuaacaguuaugcaaauucaaacucauucauacuucacccauucauacuucacccauucauacuucacccauucauacuucacccauuauauacuuucugggacuaugaaagaaauuauuucuaauuuaaaaauucuaacuaaagguuucuuaauaauauucugcuuuacuugauuuccuggaaaacauaaaauaauuauuggauuauuuuaguauucuagucaagaaggguagaaagugucacacuguuacgguagcacacauagcccacaggucagcuacauuuuucucuaaaggguuauaguaaauauuuuaggcuuugggccauauuuaacucugcuguguguguuccaauaaaacuuuauuuauggacccuaacauuuugauauuguguagcuuucauaugucagaauauaucauuguuuugauuuuucaaucauuuaaaaauguaaagccauacuugaaaaaugguauggagacuuguaguuucugguucuucauguaaggagcuuggaaguugccauucuauucuaacaacacauaaaaagcagagcaaauugaaaaaccaacaacucuucuuagauccaaaacagaaguaaggucacagggcaaacugcugccccccagauuaaagagacagaugagggauacagagaaucacaacaugcugaagcaaaaaccucuaugggaacaagcgcuggcugacaguucuccagguggccuugggccaacccaacucucuuugauuucuugcuuguaguuauuuuucuuuuuucuuuucuuuuuucuuucuuucuuuuuuuuuuuuuuuuugagauugagucuugcucuauugccaggcuggagugcaguggcuggaucuuggcucacugcaagcuuugccuucuggguucaagcgauucuucugccuuggccucccaaguagcuaggacuacaggugugugccaccacacccagcuaauuuuuauauuuuuaguagagaugggguuccaccauguuugucaggauggucucgaucuccugaccucaugauccgccugccucggccucccaaagugcugggauuagaggcgugagccaccgcuccuggcccuuguaguucuuaauagcuguaaaugugcugggaaugcaacaucuugagauaaggaauaacuggcuagaauaucccacacugcguuccuguuccuccuagagcagaauauccuacaaugcuuuuccccagugcaucacaaugccucaggguauaaagccgaggacaggcugcuuuuuggggucccuuagcugcagugugacauaaguugcaugcagaugagauuccauccaucucaugaagcuuuccugaaccuugggggacagcuuugucaugaguccuaggcuucuguugucccuugcugccuaucuguaauaaaucugcuucauggaauguguugugugaaaguauucugucucacuauagauuugugcacccaaagugcaguggguggaaauguuuagaguccucccuuugaaauaguaacuagaaugccaugaaccuucuucacagguuggguauagaaacuugaacuguaauugacaaauugcuagaggcuaaguaugaaggagucugagaguuaaaacuccaggaggacccagucaaaggacgggucccacacuuugugaguuuugcuccaagggacucaaccagguuuucacagcaaauauuggagaaaaaucuuuuuguccuucuagcaggaaaagaugaaaaugaaucauuuugcaauaugccagaacgcuguguucuuaacaaggucugccuucaggagaaacugguuaaccagaauucaaccuguugggguucuaucauaacccaacuuuccuggaagaaaggaaauaaccaacuccagcccaauguaaccauccugucccaccuaacgaggcagaaaaaaaaaaaaaaaaaaaaaacccugagaaacacuugugauguucacaguccaaaggcauagggguacuaagagacugagaccuaaucagaguacuguagaacauauucccuccccauauaccuuaccaccacauuacuaaaggccuguuuaaagugcucccuuuugcccaguacauugugucuggcuauaaagaaaaaaaauuacaaagcauacaaaaagacaaaaaacaguuugaagggccaaagcaagccucacagauagacauggcagggauauuggauuaucagacacggaauuuaaaacaauuaugauaauaugcuaagggcucuaaauggauaaaggugacagcaugcaugaacagauagguaaaguaagcagagagauggaaaucuuaagagcuaaagagaaaugcuagagcuaaaaaacacuguaacagaaauaaaaguaacuuugaugugguuaacaguauacugaauaugguccaggaaaaauucucugagcuggaugguaucucaauagaaaccuccaaaauugaaaagcauaaagaauaaaaacugaaaaaaaaaacuauaacagaauauacaacaacuguggggaaacuacgaaaguguaauaggaauacaagaaagagaagagacagaugaaccaaauaaauauuucaaacaagaaugacugagaacuuucucaaauuaaugucugacaugaaaccauguauccagaaaccucagagaacauaaagaaggauaagugucaaaaaacuguauguaggcacacaauuuucaaauuauauaaaauuaaagguaaagaaaaaauccugaaagaagccagagagggggugggugacaccuuaccuacagaggaacagcaacaacaaaaauuacaucugacuucuucucagaaaccaugcaagcaagaaaagaguagagugaauuauuuaguguugagagagaaaaagcccacaaaccuagaauccuguaccuugugaaacuaucuuucaaugguuaaggagacauggagacuuugucuggccaaagaaaaaaauuaaggggacuugucaguagaccugcuuugcaaaacauccuaagucauuuggagacaaggaaaaugauauaggucaaaaucucaaauguaugcaaagaauggaagagcaucaaagaagaaguaaguaaagauaaaauuaaaauuuuuucuuaacuucuuuucuguuucuucuuuagcacccugccuugacaagagccaggacuucacacaagggcuucaccuucucggguccuagggagggcugguggcuugagcugagagaacccaugcuaagcuugggcaccugagacagcagaagcauggaccugauauuccuugcaaugggacggcacucucagcugcagcccagcaucacugcugcauaucaaggaacaugacauugacagguauugcuggcugcucaguuucccugcaugccuggccccauuuucugggaucuuguguugguuucugagcuuucccaugcucuaguuuacuuauucuuaauugauuuaacaaguaaauauuuguucaaaaaaauaccaugaaaaauguauuuaauuauguauacuuaauguauauauuguguauguguguguauacuuacauauaaguaaaaugaaugacauuaaugauacaagggaugggaggaagaaauuaagaguuuuuuuuuauuauaaguuacucacacuacccaugaagugguauauuguuacuugaaagugggcuuggauuauauauaaaugcauauugcaacuccaggacaacaauuuaaaaaaaaaguauuaaaaagaaguguggccaggugugguggaucacgccuguaaucccagcacuuugggaggaggaggcaggcagaucacagaucaggaguuugagaccauccuggccaacauggcaaaaccccaucucaacuaaaaaacacaaaaauuagucagacauggugaugaaugccuauaaucccagcuacucgggaggcugaggcaggagaaucacuggaacuugggagguggagguugagagagccgagaucaugccacuacacuccagccugggcaagagagugagacuccaucucaaaaaauaaaaauaaaaaaaaagaaguguaauuuguaugcuaagugaggagagaacacguaaucauacaaaaugcucaauugaaacuacaaaaggcagaaaaaagacuggaagacaaaaauaggaacaaagaaaggcaacaaauacaaagcaguacuaaauauuaauccaauuauaucacuauuaauucuucaacuauaucaauugguauaguugguaugcugguagauauuauuacaacuauaucaauaaucaguuuugaacaucaauugucuaaaugcacuaauuaaaagauagagauugucagaaugaaucaagaaauaagacucaacucuguguugucuaugagaaacucaguuuaaauauaaagacacguguagauuaaaaguaaacggauggagaaagaaguaccuuguuaacacuaaucaaaagaaagcaagaguagcuauacuaauuucagacagaguagguuucaaagcaauaaaauauauugggaauaaagaggaaaaucucauauugauaaaggagaaaauuauuggccauaacugcugugguuugaauuugucccuccaaaaguauguguugaaaacuuaauccccagugcaauaguguugagaggcaggaccuuuaagaagugaugcagccugccggguguggugguucacgccuguaaucccagcacuuugggaggcagaggcaggcagaucacgagcucaggagauagagaccauccuggcuaacacggugaaaacccgucuccacuaaaaauacaaaaaaaaaaaaaaaaaaaauuagcugggcgugguggugggugccuguagucccagcuacuugggaggcugaggcagaagcauggcgugaacccgggaggcggagcuugcagugagccgagauggcgccacugcacuccagccugggcgacagagaguccgucucaacaacaacaaaaaaagugaugaagccaggagggcuuugcucucaugaguggauuaaugccauuauuauguaaaugugaugguuaauauugaaugucaacuucauuggauuaaaggaugcaaaauguuguacauagguaugucugugaggguuuugccaaaggagauuaacauuugaaucuagacugagagaggcagacccaccuucaaucuggguaggcaccauuuaaucagcuaccaguguggcuagaauaaagcaggcaaaagaaaguggaaugaagaggugugcuuagucuucuggccuucaucuuugucccaugcuggaugcuucuugcccucggaacaucagacuccaaguucuucagcuuuuggacucuuggacuuagaccagugauuuaccaggggcucuugggucuucugcuauagauugaaggcugcacugucggcuucccugcuuuugagguuuugggacuccaacuagcuuccuugcuccucagcuugcagauggccuauugugggaccucaccuugugauccugugagucaauuauccuaauaaacuccccuucauauauacauauagccuauuaguucugucccuuuaaagaacccugacuaauacagggagugaguucauuacugugaaaauggguucauuauaaaagaauggguucagccccuucuugcucucucacccucucuuugccuuucugccauuggauaaugcagcaagaaagcuuuugcaggaagccagccucuccaucuuggacuucccaaccucuagaacuaugagccaauacauuucuguuuauuauaaauuagucugugguauuguuauagcagcucaaaaugaacuaugauaauaagaauucuuaacauguaugugccuaacaagagagcagcaaaguaugugaggcaaaaacugauagaauugcaagagaaauagauaaauccaccauuauaguuggagacuuuaacaccccucuaucagaaauagaugaccauggcaggcagaaaaucaguaaaaacauaguugaacuuagcaauaucaugaaucaacuggauauaaugaauaucuacagacuacuuuauccaacaacagaauacacauucuucucaagcucacaggaaauauucaauaagacacaucauauucuaggcaauaaaacacaccuugacaaauuugaaauuacuuuauaguccggaaugaaauuaaacaagaaaaaaaaaacagaaaaaaauagcuggaagauccuaaaauacauggagauuaagcaaugaaaaccauucuaaauaacacauggauaaagugggaaauuucaagagaaauuuaaaaauauuuuuaaauauuuuggagauuaaaauacauggagauuaaacaaugaacacacuucuaaauaacacauggguaaaaugaaaaauuucaagagaaauauucauauuuuuaaguaaauaaaaauaaaaauauaauuuauuaacauuuguuggauguaguaaaaacaaugcuuugagggacauuuacaguauugaaagcaucuguuagaaaagaaauaucuaaagucauuuaucuaagcuucuaaauuaggaaaugagaaaaagaagagccaauuaaacucaaaguaagaagaagaaaauaaauaauaaaacauggagaagaaaccaaugcaauugaaaauaagaaaucaauagggaaaagucaaggaaaccaaaggcuguuucuuugaaaagauaaauugaaucaauaagccucuagcuaggcuaacuaaaaagaagagaggauguaaauuacuaauauuagaaauuaaaggugggccauuacuauagaucucauggacauuuaaaagauaacgaauauuaugaacaagucuauguccaaaacuuugauaaccuagaugaaauuaaccaauuccuugaaagaaaauaaaaucuaucuaauaaaagcaaaaauagagaauuugaauaggucuauauguauuuaauaaauuaaagcaauuauuaauaaucuuuccaaaacagaaagcaucagguccguaaguguucgcugguaauuccaccaaacuuuuaaagaauaaauuauaccaauucucuacaauuacuuucaaaagauagaagcugaggaaaaacuuucuaccucauucuaugaggcuagccucaucuuagcaacaaaccuagacagagacaguagaagaaaacuaugaccaauaccuccuauaaauauagauacaaauauccucaacaaaauauuagcaaauugaauccaaauauauacaaaaagaauuauacaacaugaccuacuuagauuuaucucagguauacaagacugguucaauauuuaaaaaucaauuaauguaauccaucacaucaacaaacuaaauuuaaaaaaucacauaaguauauuaauaaaugcagagaaauuaucugaaaaaaaaucuaucacccauuuaugauaaaaacaaucaguaaccuaggaauaaggggaaacuuccucaacaugaaaaagaauaucuacaaaaaaucuacagccaacaucauacuuaaugguaagaaacuagaagcuuucccucuaagaucaagaacaggcaaggaugucuccucuuaccacuuauuuucgccauuguacugagaguccuaucuaaugcagcaagaaagaaaaagaaaaaaggaagaaaucauguuuuuucugaugacaugauagucuauguagaauuuuuuuaaaaucaacaacaacaaaaauccuccuggaauuaauaauuauagcauaguugcagaauaugagguuaauaagaaaaagucaaaugcuuuucuauauaccagcaaugaacaaguagaauuugaaauuaagaacauacuuccauuuacauuagcaucuccaaaaaugaaaugcuuaugaaaaauccaucagaauuacaaaauuaauaugagguaaacuacaaaauucugaugaaagaaaucaaggacaaacuaaauagauggauagauaauguauguucaaggaaaggaugacucaauauuguuaagaugucagcuuuuuccaacuuaaucuauagauucaauaccaucccaaacaaaaccccagcaaauuauguuguagaaauugacaaacugauucuagaguuuauauggggaugcaaaagacccagaacauuuaacaaaauguugaaggagaagaacaaaguugaagcuuugauauuaucugacuuucagauuuacugugaagcuacaguaaauaagacuguaaauaaguuuaguguuuaguguuggugaaggaauaggcaaauagauaaauggaacauaacagagagucuagaaauagacccacaaucaucuuugacaaagaagcaaaggcuauacgauggagcaaagaaagucuuaacaaaugaugcuuuacuacuggacauccacacagaaaauagugaaccucuacauagaccuuauauccuucacaaaaauuaacucaaaguggaucacagaccuaaagguaauauacaaagcuagaaagcuccuagaaauuaacacaugagaaaaucugcaugaccuuagguuuggcaauaauuuuuagauaugacacccaaggcacuauucaugaaagaaacaguuggugaacuagacugcauuaaaacuaaaaauuucugcuuugccaaaagacuauaaagaagaugaaaaaaaaaacacagacugggaacuaauacuugcaaaacacauaccagauaaacuacuguuuuucaaaacauaaaagaaacuuuuaacacucaucaauaagaaaacaaauuacuuaacuaaaauggaccaaaacccuuaacagacaucucaaaaaauauuuacagauggcaaauaagcauauaaaaagauguucuacaucauaugucaucagggaacuacaaauuaaaacaacaaugagauaucauuacauaccuaaaauggccaaaauccagaacacuuuaaaaaccaaauauuggccaggaugcaaaacaacaggaacucucauuuauuaccagugaaaauacaaaaugguccggccacuuugaaagacaguuuggcaguuucuccuaaaauuaaacauacucuuaugguaugauccagcaaucucacuucuugguauuuacccaaaagaguugaaaacauauguucacacauaaaccugaacaagaauguuuauaagcagcuuuauucauaauugucaaaacuuggaagcaaugaagauuucuugcaguaggugaauggauaaaugaacugugcuacaaacagaccagaaaauagaauauuauucagcacugaaaaaaaugccaugaaaagacauaagguuaaacacauauuacuaagugaaagaugccaauaugaaaaggcuacauacuguaugaguccaaccaugugacacuauggacaaggcuaaacuauggagaaaaacagaguucaauuguugccagagguuguggggagugagggaugaauagauacagcauggcagauuuuugggguagugaaaacacucuguaugcuacuauaguguuggcuauauuucauuauauauuugucaaaacccauaggauguucaauacaaaauaaaucuuaaugugaacuauggacuuugggugauaaucauguuucaguauaggcucaucaauuguaaccaauuuaccacacuucauugauauaauuugcucuggguccccacccaaaucuuaucucaaauuauaauccucacauguugaggcagggacuuggugggaggugauuggaucauggggguaguuucccccaugcuguccucaugauagugagggaauucucacaagaucugauuguuuaaaagugucuggugguuuccuucuuugcucgcucucucugucuccugcugccuugugaggaaggugcuugauucccccucaccuucuaucaugaccguaaguaugcugaggccuccccggccauguggaacugugagucaacuaaaccucuuuccuuuauaaauuacccagucucaaguaguucuucauagcagugugaaaauggacuaauacaaggauguugauaauggaggaggcuaugcaugugugggggcaggaaauauacaggauaucucuguaccuuccuuucaaauuugcuuugaacuaaaacuguucuaaaaguaucaaaucuuuaaaaauauugcaaagagaaacaggugacuaccugccuuugauauaaccuguuuuccugaucccaaucacaaaauaucucuuauggcuauaugagauauaagcaaaccaucuuuaauaagagauauaauaauuucaauuaaucauuaaguacuuacaggccauuguucaauauacuuauuaacauacauaaguaaauuuaaucaucauaccaaucauauaagguagaaaauauuuauuaucuccauuuuacaaaggagcaaaccaaggcagagagguuaaauaacuuagccaguguccuauauuauuaaauaacagagcuaggaucaaacuuaugcagugugaaccuggagucugugcuccuaagccacugugcuuugcugucucaccguaugguguuuugcuaacauuccuaguuauaaaagaaaaaaauugcaaacaauuuaaauuccuuugaacuccuacguaugguguuuuuaugugaguggguaaagguaaacgcaaauuguucaaaguuauauguuucugaugguuaauuuuagguguugacuugacuggauuaagaauuaccaagagaaccgguaagggauuauuucuggguuuuucugugaaggugcuuccagaggagauuggcaggugaguugguggacuaaguggggaagaucugcccucagugugucugggcaccauucaaucaucugaggacgaggauaagcacaaaaaggugaugcccucuuucucuuggagcugggauauacucuucuccuguccugggacaucagaaaucuaggaucuucuacacagacacuccaggauuuacaccaguggcccccugaguucucaggccuucagacucagacugagaguuaugucauagguuucccuaguuccuggggcuuuggacuuaaacugagucaugcugccagcaucucaggguuuccagccugcagacaaccuaucacgggacuuugccuccauaaccaugugagcuaguaucccuaauaaaucucuuuaaaauaucuguauucacauauaucuuuuugauucuaucucucugaagaacacugaccaauacaauguuauuuuuuuuuuugcgaugagggcauuuaagagaugaagugauacaauuuacaggaaaaagggcauuugugagaaaaaugcauuguggauaucuuugcaauaauacuaacaugauuuccuugguguuaugguuaguuugaugugucaacucaacugggcuaagagaugccuaaagugagguuaaaauauuauuuuugggugugccugugacaauguuucuggaagagauuauuauuugaaucagcaaacugaguaaagaagauggcccucaccaauguggauagacauuauuuaauccauugaggguuuggauagaacaaagagacgaagagagggugaauuugcuucuguuugaguugggacaucccuccucuuccgcccucagaaauugccuucccugauucuuaggucuucagauucacacugaauuacagcaauagcuuuucucauuuuucaauuuguagagagcggauugugggacuuaucaguauccauuauugcaugaacaaauuccuacaauaaaucaccaugcaugugugugaguguguguguauauauaucccauucuguugguuauguuucucuggagaauacugacuaauauacuggauaacaaaauuuaaaugucucagagauuauuaauuuaacauccugauguuagggaaacuucacuuaaaaacacaccaggaauuugagaauauauuuuaguguaaguuaacucuuaguguucacauuucauuuuucuauuuaagaacuguuaauauuuaaacuacacacaauccauuuaaauuuguuguacucauuuuuaaugcaagaauacaauuuuguuuuuaauaauuucaacuuuaauuuuagauucaggggaacauguucaaguguguuguauggguauauuugugaugcugagguuugggauacaacugaucccaucaccuggguugugggcauaauacugaauaggcagcuuuucaacacuucuccacaucccuaccucuucacucugauuguccccagugucuacuguugccaucuuuuugucaaugaguaccaauguuuagcucucacuuauaauugugaacauaggguauuugguuuucuguucuguguuaaucuaguuagaauagaggccuucagcugcauccauguuguagcaaaguacaugacuucauuuauuuaauggcugcacaguauuacaugguguacauguaccauacuuuauccaaugcaccauugauggguaccuagguugauuccaugccauugcuauuuugaacaaugcuaugcugaacauaugagugcauguaucuuuugguaaaaugauauguuuucuuuuggauauauauccaguaaugggauuguugugcuggauaacaauucuaaguucuuugagaaaucuccaaacugcuuuccaugguggaugggcuaauuuauauuccuaccaacagcauguaagcauucccuuuucucugcagccucaccaguauguguuguuuuaugacuuuuuaauauuagccauucugacuugugugagaugauaucucauugcaguuuugauuugcauuucucugaugauuagugaugucgagaauuuuugcacacauuuguuagcugcuuguguaucuuauuuugaucagcaucuguucaugucuuuuguccacuuuuuaaugggguuguuuuuaggaugcauaguuugcaaauauugucucccauuuuguagguuguguuuacuuuguuaacaguuucuuuugcuguacacauuuucuuuaguuuaauuggaucccaccugucaauuuuuguuuuuguugcaauuguguuugaggacuuaguuauaauuuuuuucccaaggcuggaguccagaauguuguuucuuaggucuucuucuaggauucuuauaguuugaggucuuacauuuaaaccuuuaaucuaucuuuaguuaacuuuuguauauggugaaaggcagaggucuaguuucucauacgguuagucuaucccagcaccguguguugaauagggaguuguuucuccauuccuaauuuuuuggugacuugucaaagaccauauuauuggagguguguggcuuuauuucuggguuaucuguucucuucuauuggucuaugugccuguuuuugugccagugcuaugcuguuuugguuacuuuagcuuuauaguauaguuugauguugagcuauggcaaagaagagcauuacauaaugauaaagaguucaauucaaugagaagacguaacugucauaaacauauaugaacccaaccuuggaguacccagauucauaaaacaaguacuucuagaccuaugaaaagaacuagacagccacacaauaauaauaaggcacuuaaacaccccacugacagcauuagacagaucaucagggaauaaaacuaagaaauucuagacuuaaauuugacauuugacuaauuggaccuaguagacacauacagaauacaucaccuaucaacuauacaauacauuaucaucugcacauaaaaccuacuccaagacugaccacauguucagccauaaagcaagucucaauaaauaaaaaaaaaaaccuacuccaagacugaccacauguucagccauaaagcaagucucaauaaauacaaaaaaaucuaaaucauacgaagcauacucucucagaucacaguggaauauaaauagaaaucaauacaaagaaaaucccucaaaacuacaugauuacauggaaauuaaaugacuuguuucugaaugacuuuugaaugaacaggaaaauuaaggcagaaauuaauacauuuuuaaaaaauaaaugaaaacagagauacaacauccagcaagagcagugugaagaggaaacuuuauagugcuaaaacuuaccucaaaaaauuagaaauaucucaaauuaaugaucuaacaucacacuuagagaaaggagaaaaacaagagcaaacuaagccuaaagccagcagaagaaaagaaagaacuaaaaucugagaacugaacaaaauugaagccaaaaaccauuacaaagaaucaaugaaauuaaguuggcuauauuaaaguauaaauaagaucaauagaccaauaacuagauuaacaaaugaaaaucugagagaagauuuaaauaagcauauuaaaaaaugacaaaggugacauuacaaccaaucccucagaaacacaaaagauccucacagacuguuguaaacacuccaugcacacaaaacagaaugucuaaaggaaauggauaaauuccugaaaacauacaaucucccaagauugaauuaggaaggaacugaaacccuuaacaaaccaauaucaaauucugaaacugaaucauuaauaaaaagccuacuaaccaauaaaagcccugaaucagauggauuaacagcugaauucuaccagacauccaaaaaaagaccugguagcaauucuccucaaacgauuccaaaaaaccaaggaggagggguuccacccuaacucacuguacaaagcuagcaucauccuaauacccaaaccuggaaaagacacaaugaaaaagaaaacuucaagucaguaucccugaugaacaaagaugcaaaaauccuuaagaaaauacuagcaaauuaguauuuugugacuccagcagcacaucaaaaaguuaaugcaccacaaucaagcaggcuuuauuccugaaaugcaaggcugguucaacauacacaagucgauaaaugugauucaccacauaaacagaauuaaaagcaaaaagugugugaucaucucaacagaugcagaaaaaguuuauaauaaaauucaacaucccuucaugauagaaacccucaacauacuaggcaucaaaggaacauaccucaaaauaguaagauccaucuaugacaacccacagccaacaucauacugcaugggaaaaaguugaaagcauuccucuugagaacugaaacaagcagaggaugcccacuuucaccauuccuauauaauauaguacuggaaguacuagccagagcaaucaagcaagagaaugaaauaaaaggcauugaaaaucagaaaagaaaucaaaugaucucucuucacugaugaucugauucuauaaaagccuugaggacucugccuaaagucuccuagaacagauaacuaauucgauaaaguuucaggguauaaaaucaauuuaaaaaaucaguagcauuucuauauagcaaaaguguucaagcucagagccaaaucaaggaaauggccucauuuacaauauccacacccacacaagauaccuaggaauacauguaaccaaggaagugaaagaucucuaccaggagaaggacaaaacacugcugacagaaaucacagaugacacaagcaaauagaaaaacauuccuugcucaugaauuagaagaauuaauauuguuuaaguggccaaauacucauauugcccaaagcaaucugcaaauucaaugcuauucuuaucaaucuagcaauaucauuuuucacagaauuagaaaacaauucuaaaauuaauagggaaccauaaaggaccccggauaaccaagguaauccugagcaauaugaggauuuuaaacacaauauacauaaaaacaaacagauuauauaucuaacuuguacauaaggggaaacuuuucaauuuaguaaucauuuuuuguauagcacuaugcaauuugcaaugagauuaauccauuaaaugaaguuucuuaauaauggguuucacagauuaaaguuuauuauuuucuuuaaugugacuaauuugaauuguucauuuagcaagaauaugacuauuauuuuucaaauccuaauauucuuauaaucaaauuacauuauuguuuuuugaauuacauugauuaugcccuucauaaucauacacacaguacuacuugcauauauuagaaacauuucugaauauaugugugcauaggugaguguaucuuaacaacuauuauaaaaugguuagaauuauaauuuuuaaacccaagcccagaauuuauauggcuucauuacuuuuuaaugcuuuuauucaaucuucauuaagcuaggucuuucagauagucauaggggacaguaaauaaaacaauauauagugauuucuacauggucuuuccuacuagacccugcacuuuuccauagagauuuucugcuucuccaaacugaucugcuuaaaaacucuucccugaccuuuaaaugcucuuauggaagcugaagugaggauaaagagagauaauugcauuuugaacaaaaguuaguauaaaaauauauccuggaauucuuucuagacauuaaaucaaaacaaaauauugacaauuuaggaaaccugaggcaaaacagaacuaauagaagacagaguggcugaguaauauuaguaaggagagagagaccuggaaaacaccugggacucacauuccuaugcagaccccccagagugugccucuagaguaaauaacuccauucuauuaaaauaccuucucaaacaacaauuagaaauaggguauaaacucucugcaaaggaaaggaauauguucauguacugcuuguuuuguuuuaaaguauugacuguuugucaaggcguguucauccaacaauagcccauaguguccaucuugauaauuacaucuugauaauuucguaaguacaaagaugauuacagaugauauuucaugaaguacagacucaaagcacuaugucuggagaaaagcaaccuauuucuccacuauuauggccauugagaaaacauuuuuuaauuuuaugguuuauaagugaaugagaucuuuagaauagucaccugguuauuacaaaaccuagccauaaaaaaugugcuuucuuuuccaacuuagcauuuauuuuaaaaguaacuacaacuagaauacaugacaauaucacuggacaauguaauauuuuagauuaugggcucuuaauguuacauuaagcuaaaaaaacuuauagaacuuuguuuuccagguauucuacauauaccuuaacagaacuucauuuucuuuccauagacuuuuaaaaauggaauuuuagaacuaugucuagaaaauugaauuuuggauuuagaaaaucuuuaguuuuacuauaaaguugaacuugaauagaaugaugcuauauuauauaauaaaguagguuuguacucuacugcuuuaugaacuacauuuucauccaauuaauaguaaaaauguucucauuuuauuaaaacauaaugauacaugauuuaucauguauugcagaauaggauauuuaaugacugcauacaaucucaucaaaugaauacuccaauguaguaaacuauuccccacugaagaguauuggcauuuaaauugcugacuuauuuuuuccauucuugcauuuuuuguuaacaguacagugccacuaccaccacuuccccauacacauuuauauuuuccucuuuauuaaaaggcugggagccagagaacuauguuuuccagaguuccugacaacaguuuuucacauuaaauucugccaacgagaggcauuucagcagaauuuugaagguggagugaaggaagucacuauugcucuagggacugcagugggcagguguauuaacucacuuccuuggugcaaauaugagaucaguaacaguuuucuguaacuuccccaguuucugauuuacugaaaugagcaguaauuuccgucaccuuugcuccaccaguaguucugaugauuuuguaagcuucugauucucuguauuguaucucauucuauuuaaaauaucuagagggguuuguggucuucugagaaaauccgaagcaaaauaaauagucauaaauaaaaccaucuaaguuaaguccuguuuuguuuuuaugauuguuuuaaugagguagauuacaaaaaugagugagucaaaaaauaggaaucuuuuuaagguuucugauauauauugccaaagaggcuuucagaaaaugugugauacuuuauuaacacuauaauauauaaaaguaaccuucccuacauuaaugccacuguguaauguagguguuuaaaagccucugcuaauuuauuuuauuuuauuuuauuuauucauuggagauagagaacccaggcuggagugcagugucacgaucucgacucacugcaaccuccgcugcccagguucaagugauucucgugccucagccaccugaguagcugggauuacaggcauacaccaccaugccuggcuaaauuuuguauuuuuaguagauuggguuucacaauguugcccaggcuggucuugaacuccugaccucaagugauccgccugccucagccucccaaagugcugggauuacaggugugagccacugugccugguccuacuuuuuuuuuuuuuuuauacagguuuaaaaaguaaaucuaagcauacuucuuuaaaguugcuuuauguguuguuucuuucagugaauggaaguguuuaacaaagaagcuuguaagcaugaguugagaagaaguuuuuacguuucuuuuuuuucuacauuagucuuuauuaugaagaguuuacauauacagauuuaaaggauaauuauaagcaugcuuccuugaacauuuucaaauauuuaauuacugauacauaauaguuguacauauuuaugggguaaaugugaaauuuugauguaaguauauaauguguaaugauuaaaucaggguaauagggauauccaucaugucaagcauuuauuauuucuuuguuuuaggaacuuuccaguuccacucuuuuagguacuuugaaauaugcaauaaauuaauuguggacuauagucaaccuauugugcuaccaaacacuaguuuuuauuccuucuaacuguauguuugacucauuaagcaacucuucuuaaucaccuucuccucuuucccuucccagcugcugguaaguaucaucuuacuaucacccugaguuccuuuuuuuuuuuaaaauuuuauuuuuuuuagcucccacauaagagugagaacaugcuacuuuaucuuuuucugucugccuuauuuuacuuaacauaauguucaccacuucccauccacuuuguuaaaaaugacaggauuuuauucuuuuucauaguugaauaauauuauauuagaaauugaagaggacacaaaaauguaaagauauuccauguuuuuagauugaaagaaucaaauuguuaaaauauccauacucaaagcaaucuacagaucuaaugcaauccguuucaaaguaccaauaacauucuucacagaaauagaaaaaauaaucuuaaaguguauauggaaccacaaaauacccagaauagccaaagcaacccugagcaaaaagaacaaaguugaugggcacucaaagacauagagugguauaaugcacacuggagacuuagaaggagggaggguggcggggggaaugagagauagaaaacuacauauugaauacgauguacacuacucuggugaugggagaacuaaaauaucagacuaucacuauccaauucauucauguaacccaaaaacuuuuguaccacaaaagguccugaaauauauauagcaaagcuggaggcaucacauuaccugaauucauauugaacuucauaguguacuacaaagcuauaguaacuaaaacagcaugguacuggcacaaaaacagacacagagaccaauggaacagaauagagcacccagauauaaauccacccauuuauuacuuuaauauguuaaacaaggcaacuuauugguacauuuguuucaugcugaagagauuaaugauauuuucuuaccuuagcaauuucuauuacuuguaauagauuuucugaauugcuuaguauuaacauuuuccauuuuuuaaaaugaguuauuuuaagagaguuuuagauuuacauauacucugcacccaguuuccccuaauauuuauucauuacauuagcgugguacauuuguuaaaauuaaugaagcaauauugauacauuacauuaccuauaaaaucauaaauauaaaucaucaacacuagguaccuagaaacccaaauugagaaacacugauuugugguuuuuaaauauuuuuuuaaaaauugauuuuguguuuaauugcuccuuucauggaguuuacuauggauuucacuguuucauauagcaugguguuccucaucuugagacccaacaaaugcuuauuaagauaaguuuauuuuccaguuuauuuauagacacacauuuaaucuauuugcuaaguacuuuggaaaauugagcaaauaaucuaaauuuaccuuccccuucauugugaaacacaucuuccaggauuauguauuaaauaauuaauuucaucuucaauuuaaaugcaacauuuuuauacauacuuuuggacucuauuuuauugauugaugcuauucuauuuuuguuucaauuccuuacuauuacauuuauucuauaugcauauauuuuuucauauauauuggcauaagcugcucucuuauuuucuuucagaauaaucuauaucauccuauuauucuucuagauuaacuauagaaucaauuugucuucaaaaagucuuuuugaaauuuuuauuauaauauaauuaaacauaauaauuacuuuguggaaaguuaagagcuuuacauuacacacucuuaugacacaaccuuucuuuuuaauuuucuaagcuaucuuacguccuucagaaaaacuaaguuauucuaaacaacauaucuucacauccccucccuacuacguuaauuaucagaucuaauuucuuacauuuugcuauuauaaucuauuguugcuuuuuauucuagcugguacaauuaguaguagagcuuaucagggaaacucuugauacagcauugcaacuaucagugucagguauacauaguucagcuuccauaucauuugcaaauuugaauucuguuuuauauuuuuuucuguuuuuguuucaauaguacuaucuugauacccaugguaauauuaaugcaaaagcaaacauuggaagguauuuacuuuaauaauauaguuuuaaauuauaucaagaaucuauguguauuaaaguguuauucuaagaaguauuucuggacuauucucaugguuucugucauuagacaauuaaaauuaaaauuaagagccugggcgugguggcucaugccuguaaucccagcacuuuggaaggccgaggcgggcggaucaccugaggucaggaguucgagaccagccuggccaacaugaugaaacacuaucucuacuaaaaauacgaaaauuagcugggcauggugguggguaccuguaaucccagcuacuggggagaauugcuugaaccugggaggccgaguuugcagugagccaagaucacaccauugcacuccagccagggcaacagagugagacuccaucccaaaauaaauuaaaauauuaaauuaaaugaaauaaguguuccccccucaguuacaaaaaauuuuaaucagaaaugaguauugaauuuaucaaauaacuuuuugugucaauguaaauaauuuugcaaacuaaguuuaccuauuaauguauuaaagugcuauuuuauaugucuauacagcucaauguaacuuacuuuuucuuuauuucaaucuuagcaucuauaaucaaaaaugaguuuggcuugaagcuuuuuuuuuuccugugguagacagauuuuaucauguguaagaaucagacuuauggaauauuugaacauaagaguuguucauauuucucuacagucuggaaauguguccauaacaauauugaucuauuccuugaaagauugacuauauauauauauauuuuuuuuuaauuauacuuuagguauuucuccuaaugcuaucacuaccccagcccccuaccccccuacaggcccugguguguuauguucccugcccuguguccauguguucucauuguucaacucccaccuaugagugagaacaugcgguguuugguuuucuguccuugggacaguuugcuuagaaugaugguuuccagcuucauccaugucccugcaaaggaugugaacucauccguuuuuuuauggcuguauuccaugguguauaugugccacauuuuccuacuccagucuaucauucuuggggccucuccuaauaucucuuagaggacauuaauuuuugaucaaugguuaauggacaguuugauacuguaccuuucuucaucuauaaauguuuuuuuauuuuauuuuggcaaccuauauucccuucagaauaacuuguuucacacauuuucagauuuguaaaagaaucaugcauaaucucauugugcaugauacuuuuuaccauuuauuuucauuuucucaugcuuuaaauugugucuucauuuucucuacuguuucagauugcauguuguaguuccaucacuauuuuggagcauuuagauuucuuuuuuuuuuuuaaaucaggcuagcccgauuuuggauguuagacuauuuuauuauuuuggcaacugucuuuuaugagaauuaauuuuuauucuuuuucauuaauuccuacuuuuaucuuuacuauuuuuucuuucauucuaucuugagaauuuucuuacccccauuuaauaaaguauugguuuauuuucaucuuuauucucguaaugcaaauauuuaugguuagaaauuaguuuauugguacagauaugcuaacauuuuauguaaaggacauucguucuauuguguaagcucaaguccuugcuuuuugcuugucuuuuugcauuucugggguuuugcuacaggaaaaauauuguauuaguuuuccuccuuuucuaauguauuacuuuaauguacaaugcuagauuauuucucccucuaucucuaaaaauaaaaagcaaacaagaaaacaaaaaugacacaguauuuauaucuuacugaacugugaaagugaaagggacacccacauuuugcccugcacugauuucuaucacccugccccuauccaauuccuauccacauuaggaggguuaauaagcuucuccgaguuuaucuuccaauuaguucccagugacagugcuggugaggaugucaagagguguuacuguuugauucucccucuccuaugucugugcauuagggaagcuuuuuucuaacaaggagcuaugcagaagacuguguuacugacauugcuuaaguaguguaacugcagaaaccaggauauaauauuucuaaagaauauaauaacuaugagaauaaaaauaaacugagcaugagaguuaaauaaaaaagagcuuuucuuagcaucauucccauugucucgguuaaugagacauucacgccuucaaaauaccagaaacagacuggguguuugggacagggauacuuauuuuaacauucuuuacugaaauguguauaauaaauaucgaagaucccugaaggaauucaaagaaauuguucaguauuuccuaaaaggaauguaagcaaauuaauuauuguguucauuauucagacaauguuuuagauauagaguaggccuccauucuuuuggaguaauuucugugaaaaggccucucucugacccucaaaacacugccccacauccuggccgaugacugaaaucauguuagaauuaggcuuuagccuccacugaauguaaacaucccuguggauaaucggugauuaagccaguguuucucuaccuuuuaaauccaucuucacucuucuaaaauaugccaauauuaaaacacuaacaugacccucaguugaaaauacuucaauuacauacacaucucaaccaugcauuuuuugagcuuuauguuuuauaguucaucuuacaaaaacaagcagacaaaaacaacgaagacuuucucuucuccauacaaauguaagauuacauuauuuuauuggguaggcuuuauagaaugcccuauuuuaacuuuacacccaugaauuccucccuccugcauacacagaacauaugcauguugggagagacuucuccaugagucuguugcuuuucugcccuugugagcagagacacuaaucaucuuuuguucuggacauuuucuaaaaaacuuuuuauagugaaccacuuuggaagguagaaaugguggcgucugccugugcagaaugaagguguauuugcuguccacuagaacaaagauaaugucccucugggguguauguugggcagcuuugguugcaguccuuuuuaaaggauugugguuuccuaagcuugagaccucucuccugaaauccacccugcuguaugcagacccucugaauuagggcucagggaauccaugaaaauguugauauucuguccacuauugcuacgagcaauaagcuguccuucaucccagacccagaagccaugucuucugccagcauccguggagcuguugcaggaguuagcaagcuuguugguuuguaagcagagugaaaucucagcccucucacaagucuuggcauuacucugucuaaaccggaguuucaagaugcuuucauggaagucauuuacuauuuuuuuuucuugagcacugguugucucuggagcaacaggggagaagcagcaguggguaaagagaacaccaggugccagagggaagaaaacaggguacagcaaguggugagaaaggaggagggggagggggagggggaaacuggcugaggaucugagagccaacucaacccacuucaugguugugccugaguguggcugaaggugaagaacuugccccucauaagcauaaagcagcccuauuagcauguguuuauauuaauucucacuugaauccacuccuucaaauuaaaaauaagacaacccucucuagcuaauuccacauuucuugagauaaugaaacaaaauuuuuuuuuuucaaaagaaaagaaaaucgggaacuaauuuucuaacuucucaaaaauguacaggcuuuccuagauguuucuguauauccucugcuuuucucaaggaagcaugccaguguaauuguaacagacgaacuucauuucucuaaagaaucucaauauucauccacaaucuccaaggaaccacuuagcuagcaauaaaaaacaacaacaagcccuacaaaaagacuugaucuugaaaaaaaaaaacccauucuauucaaucaaaacuuagaaaaggccacauuugaagagaaggcacauaauguaaaacauccauuuaaaaaccagcaggagauuguuauauguuugaauaauuacuaaaugaguuugaaacguaguauacuguuuuagcuuucauaguauauuaucugaaaaugaaaguuuugcauuucuuaauaucuaucacuuaaguugaauuuauuuucauagggcaucuugcugugaaauuuuaauacuauuaauuauucaauuaauagcccuuagacugugaggagaaccuguauuugcccuuaacucaugcuaugaugcuaagaucuugauuagggccgggcgcgguggcucacgccuguaaucccagcacuuugggaggccaaggcgggugcauuaccugagcucagugguucaagaccagccugggcaaugcagugaaacuccaucucuaauaaaauacaaaaaauuagccagccaugacggugugcgccuguagucccagcuacacgggaggcugagacaggagaauugcuugaacccaggaggcgaagguugcagugagcugagaccacgccauugcacuccagccugggugacagagcaucauucugucucaaaaaaaaaaaaaaaaaaaaaaaaguccuuugauuagcuaguuagagggcaauauuccaggccauugcucuuucuuguuaaauucuggcucagcucugguauccacaaucacccauuccuucuuccuauaaaucuuucaaaaguuuguuguugcaguuucuuguuguaauaaagacauuucaaugaauuuauaguagucuuuccuugauaaauacaaaugauucaggguuuuagguucauuauucauaugacaaacuaucacugaaaauuacuauaaauguauaaaauguacaggauuaggaggcaucugaguaagcuuccagaaaguaaauuuaaaguucguuugguaaacaacaaaacagcagugaugguaaaauccgcaaauugcaauuugucuuuguuuccaaauaacaacaacagacaauuucaacaaagaauauuggaaaccagccuggcgcgguggcucacaccuguaaucccagcacucugggaggcugagguggguggaucgccugaggucaggaauucaagaccagccugaccaaaacggugaaacccugucucuacuaaaaauacaaaaauuagccuggccuggugacaggugccuguaaucucagcuacccuggagacugaggcaggaaaauugcuggaaccuggguggcagagguuguggugagccgagaucacaccauugcacucuagcccgggccuacgagacuucgucucaaaaaaaaaaaaaaaaaaaaaggauauuggaaaccaacuaugcuggcauuuugguuagccaaguuuuacuuaaagcuuuucuuuaggcaguguuaacacauuuuauauauuccauuuuauaaauaaacguuuuaaauagauauuuuuaaaguaaaauagauuuaucaauaaguuuuugaaauaaucaaguuuuucauuugucuuuaggcaugaacuuucaaaaaguauuuuuaaagaaucauaggaauuuuucaaguauuuaggcaugcaauaccauauuaccaaguuucugaagucgcuuuugcuuaagucuuaguaaaaacuuucugcaaaagucuucaaauauuuuaaacuuuagagcucaaaauuuuuggacaauuuuaaagaaaaaacaaaaguuacugaaagaauacugaauuaccucaacaucuuagaaaacaaauauuuucauaaagauaucuuagaaaccaauauaaagcuauugaagaaaauguuuuaauauccuuagacauuguuuauaaguuagaagagucaggcaaaauaugugcacuucaaaaaucaguuaaucacaccaaauguucuaauucacgcagaguauuacuggauauucuccaucuucugagaaaaaccuguucauugguuuguuaauagcagcguagaugugggugaauugucuaauuucuugccuauugcuuccccuuuuuuccggcaagagagaucuccuauuauuuauauuauuaacgauagcucuaauauuacuccuuaucuuauucagagauaguguuaccaguggaggauguacagguucuuggcguuuugaacaaagagcuggacgaaacacacagagcaagaaaagaaucaagugacaaaagcagauuauuuaucgaaaacgaaaguacacuccacggggggcgggggggcaggcccgagcauagggacucaagggccaguuuacagaauuuacugggguuuaaauacccccuagagguuuuuccauugguuacuugguguauacccuacguaaaugaaguaguggccugugcaacuagucugauugguuguggaaagcaaccaaucagaggcugaagugaaguuacaaaguuauacuccuaugcaaucaucugauugguugcagaaagcaaccaaucagagauacuuucaauuuucuaucugccacacagaaaaggaggggggauugcaaagggcguauccuccaguccuuuuguuacuuagguguggaaaguugggguuuuccuuuugauuuaguucuagaaguccgcguaaaucagccuuagguucccugccuccagacccuauucuccugccucaacagcaguauaguaguaauuaggaagucagcugugguggcaaaucuugaggaucacacuguguuuuacccuccaccaagucuuuugagccucaccauugcacucgccugcacacucuuagcuguauauuuuucgcgucauucaguaguugcucuuucacgcuugugccauucuguaauuugugauacugcaggaaagugacagaggaaguuguauuuucugguagcuguagggauggcugguuccagaugaccaguucucaagugggcaugaaagacugucaggagugcuuaggcgagguuuuauuccuuuguguucaggcagggaugcauguuugcacucuucacucaagaagagauuuaaagugaagauuacauugaacuuaaugcaguguuccuucaucuuaaggcuucaaaugcuuuauaucauacuaauucauccuuuagaaaagacaguggcaaaaauggaaagucuuugguguuugugucuuaacaaaaguauuaaaggaaaacaugguccauuccuagcuaauauuuuacuuuuagcaaauucagcacacauuugcuaggugggucugauguuaucuacagaagaaucuguccagcauauaguugucauucugaucuaaaaugguagccaucaaugaaaauaugaaauuucaguuuuguguguuaguuggugugggcugccauaacaaagcaccacagcaggugauuuaaaccauagacauuuauuuucuuaugauuuuugaggcuagaagucugcgaccaaggugugagcaggguugguuucuucuacugucucuccuugccuuuuagaugguaaccuucucccugucuucacauggucuuucaucuguaugggucuguguccuaauuuccccuucuuauaaggacucuaguuuuacuguauuacaguauauucauaugaccucauuuuaacguaauuaccucuuuaaagaaucuaucucucacuacagucaaauucugaguuacuggggcuuagaguaccaagcucccuuuaauauaaauguuguggugggagagacaccauuuagcccauaaaaucuagaauccagauagcuggcuccucuuaaaaccccaucaucucauaccaaaaacuccuuaaauugauaagcaacuucagccaagucucaggauacaaaaucaaugugcaaaaaccacaagcauuccuuaacaccaacaauagacaagcagaaagccaaaucaugaacuccauucauaaucacuacaaagagaauaaaauaccuaggaauauaguuaacaagggacaugaaggaccucuucaaggagaacuaaaaaccacuuuucaagaaaauaagagaggacacaaacaaauggaaaaacauuccaugcucauggauaggaaauauugugaaauuagccauacugcccaaaguaauuuauagauucaaugauacucccaugaaacuacuagugacauucuucacagaauuagaaaaaaaaacuauuuuaaauuucauauggaaucaaagaagacgccauagagccaagacaauccuaagcaaaaagaacaaagcuggaggcaucacgcuaccuaacuucaaacuauccuauaagaccacaguaaccaaaacagcaugguacugguaccaaaacagacauauagacuaauggagcagaauagagaccuuagaaaucacaccacacauguacaaucaucugaucuuugacaaaccugccaaaaacaagcaauggggaaaugaucuccuauucaguaaaugguaaugggaaaaccggcuagcuguaugcagaaaaccgaaacuggacugcuuccuuacaccuuauacaaaaauuaacucaagauggauuaaagacuuaaauguaaaaccccaaaccauaaaaacccuugaagaaaaccuaggcaauaccauuuaggacauaagcaugggcaaagacuucaugacaaaaaugccaaaagcaauuacaacaaaagccaaaauugacaaaugggaucugauuaaacuaaagagcuuccacauagcaaaagaaacuaucaucaaagugaacaggcaaccuacagaacgggagaaaauuuuugcaaucuacccaucugacaaaguucuaauauccagaauuuacaaauaacuuaaacaaauuuaccagaaaaaacaaacaaccccaucaaaaagugggcaaaggauaugaacagacacuucucaaacacauuuaugcagccaacaaacauaugaaaaaaagcucaacgucacugaucaucagagaaaugcaagucaaaaccacaauuagauaccaucucauuccagugagaagggcgaauauuaaaaagucaggaaacaauagaugcuggagaggauguggagaaauaggaacacuuuuacacuguuggugggaguguaaauuaguucaaccauuuggaagacaguaguccucaaggaucuagaaccagaaauaccauuugauccagcaaucccauuacuuuguauauacccaaaagaauagagaccauucuacuauaaagacacaugcccacguauauuuauugcagcacuauuuacaacagaaaagacauggaaccaacccaaaugcccaucaaugauagacuggauaaagaaaaugugguacauauacaccauggaauacuaggcggccauaaaaaggaaugagaucauguccuuugcagggacauggaugaagcuggaagccaucauucucagcaaacuaacacaggaaccaaaaaccaaauacugcauguucucacucauaagugggaguugaacaaugagagcacauggacacacggaggggaacaucacacaccagggccuguugggggguggggggucaggggauggaacuuagaggaggggucaauagguacagcaaaccaccguggcacauguauaacuauguaacaaaccugcaccuucugcacauguaucuccccccacuuuuuuuuagaagaaaaaaaaaacaaucuaagauaauuauuggcauucauuccuucuaaugcuuaaauccacuuuccacaguauugucauuaugagauuucuaacucucauuuugucuuaaaaguaucccuacucuccuccucuugccuucuagacauucugauuccuuugaagggcauggaaguuuuuguaaucuuaccucugccuauuuauuuacucucuccugcuuugcaacugguauucuuuaugucugagguuccuuuccuacauuccuuucauucaauuuauuuccuggcucuuguuucucuaacaaaacacuaaggucacugacccuagcagggcuuccaugagcuccccaucccagguuauguaccucauauagucuccauguucccucaaugcucugugugccucuaaaucaugacucuuacaaaaaucuacuuaaauaguuuaguuaucuguuguuucaccagaaugugauuccuugugggcuguaucuuucuucucuguguuuccagggcuuagccuagugcaccccagaaagcagaggcuuaacacugcuuuugaaugaacuaauaaaauacauaaauagaauaaucuacacaacaacuucccagaagguuucauuagcagccuguucgacaggcuuagacagaccuugguuggaaauccagcucauugccuacuuuuagcuacauuaacuuggacaaguucccuaauagcacuaaacuuccauuuauuuaucugaaaauugauauuaaauauacuucacugugcuuuaugaggcuuuagauagaaaaauacaugaauaaccuugaauuuugugagcaagcaaaauaauuacuaauagcaacgaguaauuaacuacuaauauuauugugaagaauaauuaaguauuauauuauugucacacaaugaagaagccaagaucacaacccagguuguccagcuaucacuacuuugcaaggcguuuuuuuccaagauaucuagugauauaauugguagacugcaaaaauacaauucuguucacuaaauaauuuucuggacuagucugggguaaaaccaguaaguugcgcccauuacagucaaauagagcuacaaagaagaaucuaaucauccacuagucacaacuguauuuccaacuuuagaaagcauuguaguuauuuggcagcacaaaaaucaauccgaacauguaauuccucaaaaugccaaacgacacugaguaugaccagugaguuggaaaacaaauguaauaagagaaaggaaagggaacaaguacucugaggaauuugacaguucagggaagaaggaaaguagaagggaaacccagggcugcaguaccauuuuuuuuuucucuuuaagauagaauauauuagagcugugguucccaaauguuagccuguuucugagucacuuggagaggguggggaaaacacagaauacuggacuguaccccagaguuugugaugcaguagguuugcaguggggccagauaauuugcauguuuaacaaguucccaggaccacacugagaacuaauggaucagaauauagaaguagggagguggaacuuuuaggagaaagaggguauaguccuuggguaaaauuucagugauaugugacaaaagacauaaagaggagaagaagugguauuaaaaaagagaaggaucacuucuucaugggaggcuggaggaacggaccagggaaaggcagcugacugggauuuuaucagaaggugaagaguaaaauguuuccgaccacuggagaaagcuguaacagcuugaauagagaaaaggacauuacuuccuucaugcuuuggcugguguugagagucuugcugagaccaaaugacuauuuuacuucaauuuucuuuuaauuaugcauuuauuuauuuacuaauugacauauaugaagcaaccuuagaaauugugguucauuuguaaauuauuauuuuuguacauuauaaucauguuuauaccucaaacaauauacacuccccacucccaaaguguuggcacucauuuuuggcagcguagcuuacaaacaggacaggacagaaucuucuggaauaaaauucaguuuugcuuuuuuaaaaacagaguugcccaugcucuuguuaucuuguuuacacuuuucuaucuguggcaguguuaugcagauggaguuaagaaauuuguaggguuuacauuuuuuuuaauucgugaaggguuuggagacuuggagaucuuuugagcugauuagaaaucuaaaagcaaaaaagaaaacaaacucaagaagaaauagaaaaccuagacuuaaccguauuguucuuuccccuccagaaauaguguuuuucacuguccuauauauaaaugucuuccauaaagcagaccagaaaaaaucuccaggauaucaaaucauuaggcaguuuccagagaccuaagacaugacuguacccuuucacuaaaauuguggcucauaccacaugccaccaggaaaauaagccacagccuccacuccuguuccuuccaagcaguggucauagacuugugagcacagccuguaaagcccaugaacuuugcguuuuuacacaggguuauuuacuuugacuucaggauuugaucuuacuuuugucuucucauaaaaaugauauuuaacuuuaacgcaaauguuaaugaaaacuggucuuuaucuuacucccugaauuccauuucauuuaggcuccugugaaaauauacuauauucgagguuagggacccaccaccuucuagcuaugucuugggcuagacacuuaaccuucuccagacuuugguuucuaauccacagaaucugaggggugaaauauacuggacccuucaacucucucugggccucucccacccugucucuaugauucuagacuguacauggugagucauuuuacagcccccuuuucuucuuuucuuucuuucucauuuagaguauuucaucuaauauauauaugucuuuacaucuuccaaguuagaguccugacuuuuuucuuauuauuugaauauaguccuuuggaaaccauaaugggcuuacaccaggaaagugacaauauucaacccaagcauuauaucacaaucauuuuccugucuucugagaucgguucaguuaacauuuuucauauuuccuucacaaagcacuuuauguaaguauaauguuacagugaguuuaaucuggcuaacggugacauaguuuaaugcuucauaaagucaccaguuugccagccaacugaaugcugcaaacuaacugacaaggugaugaguaccucauuguucauggugauuuaugcaaaaugauuauaauuaauuuuuuuuucuccaggaauugccaugacuggaaugcacaucgguauauccagcccucaagccaacaccauugcgaagcuaaugucacauucacuguucacugcuauggaaauuauaugcagaugaugugugacaaugacccaaagaacaacugauaaaaauuucuuacucugacauucuguuagucagaauauugcaauacaucuuauucccagagaaacucucauucugugacaugguuccaguaacacaagaaggcuaaaaauaauguuaauauuucucuuuugcuuucugaacacaauaagaaaacaaguuuugauauuaucaugcaaguuucuccaaaacuuacuccagacaacuuaaagggaaaaaauacauuacauaaguagugauuccuuuaaauuuaauuacaccacaacaugacuaggaagaugaauucggccucuuguuuuucugaggugcagugaaauggucaugaagagaauguucuuuugaugcuaggauacuggaagagcuucuugcagcucuauaugugacagaugaugugccagacaauggacugaauauauuugggauacaaauaccccuugaagguaaagauaucuucaaaaagugguguuaagggugggcacgguggcucacaccuguaauccuagcucuuugggaggccgaggcggguggaucacgaggucaagagauggagaucauccuggcuaacacggugaaaccccaucucuacuaaaaauacaaaaaauuagccgggcgugguggcgggcaccuguagucccagcuacucgggaggcugaggcaggagaauggugugaacuuggggggcggagcuuacagugagccgagaucgcgccacugcacuccagccugggcgacagagugagacuccgucucaacaacaacaacaaaaaaaagugguguuaaugugagcccaagauuggaagucauagaguaaggagaagauuaaaaauuuuguuucuuuuuuaauguauuucucaaaaugauuaaucaaacuuuuugugguauaucaauggauguuaauaaauguaugcauacagaugugugcauuuauacuuagagauguguauagaguuauuuauauauaaacaauauauuaauguuaguacaaaucaccauuuaguuguuucugauauguuuccuguuauguuuccugauacuuucucagcaaaguuccaaggacagaguauuacccuaucuguacauuguaggaaaucaguauuacaagcauacuacauguaauucuacaugugauuuuccacacuauuuccauauaucaguuagaaaguacugaggauuuguaauguuauuugccuuguagaugucauguggaaagaagucaaaacguaauauuaauguuuuucuguaagaugauuauuugcauuuaugccagcaaaauaaaauacuauguauaguuuuauaauauaaaauuuuguccuuuagauuuucuaauucuuaaaaaaguuauuuauuuugcuuaggagagaaauuucacauaacaucuguggaaaauaacauguaauaguaaaagaauuuaauaaauaaaaggaaaaaagaauguaggugccugacaaguugucaaguguucuguuuucuuuacaacugcagggaauucugugcaaaugaguucaccugaggauuuacagaaagugguaauuaaucauuuuggaguuauuuggauuccuuuaauuggcaaaacaacacaaugcuucugguaauuuugugaugcuagccccuaaaaaagaaguguguauuaacacaauuuauaaaaggaauaaucucuacaauuauuauucacauuuuuuucaauuuuuaaauuauuucccuagcucauaucacucacaucaaauuaaucuucuuuguucccaugaugcaaacccuacugcauauuucaguuuacuuuugcucuuauccagauuaccuaacugcauaugacuccuguggacuucuuccuucuccacuucagaauaucuuugcaccuugaacuacuuccuccuucucuuuacuuucuacuuugagggacaaccaaagaaaacaaaccaaaagcuuccgcugucagacugagccuuuauuucauccuguauuuugcauuuacagaagcccaaucuggugcuuucucucagggauaggagaggauaauucacccuauaauucuuguuugcuacuuggggauagucaauuucauagcucucccucuucuaucaauauuacauccuuacuauuaccugccacaaaauaucaugcguguaugugaaguaccuuguaaauaguaucaaaauauccuccuugacaggcuucgaacuucucaacuggcugcuguuuucuggacucuccuacacauuuccuucacugauaccaugcuguccuuggucuugcccuauccugcccacacacaucugcaaacccauguuguuuauguuaaacucuuguuuccaaggggagagacaauuaauucacacucuauuuuuuauaaaucucuucuaaaaguuacuauuauguauccucuuucuagugcccucuuggaggaaaagaguauuuguuuguucuuuuuucucucauuuuauuuauuuauuuauuugagaugaagucucacuuggucacccuggcuggagugcaguggcacaaucucagcucacugcaaccuacaccucccgggcuuaaaugguccucccacuucagccucccaaguagcugggaccacaggugugcaccaccauaccuggcuaauauuuuauauuuuugguagagacaggguuucaccauguggcccaggcugaucucgaacuccugagcucaagugauccaucugccuuggccucccaaaaugcugggauuagaggugugagccagcauaacucuuuauuuuauguaucgauuauuuuucuuuuccaaauuuuauuuuagcuucagggguacagaugcagguuuuuacaaagauauauagugugaugcuaagguauggggugugacugguagugagcagaguauccaauaggcaguuuuucagcccuugccccaauccgucucucucugcuguagcaguccccagggucuauugcucccauauuuauguccccaauguuuaguucccacuuacaagugggaacauguaguauuugguuuucuguuucuagguuaguucacuuagcauaauggccuccagcuacauccauguugcuucauaggacauaauucuguucuuuuuuauggcuaccuaguauuccaugguauuugugaccauauuuucuuuaaccagucuaccguugaugggcaccugaguugauucucuguugucccugcauugauuaaugagucuacucuucacucaguaccucuggcaggagcuugggagccucucuaucuuuaugcccccaacucaugccuuacuacuuuauguucauagacuucagacaugccucaacugcagcacucucucuccaucuccaccaccacuguuucagaccuaccugagcuccugcaguggcuuaacuauacucuccauguucauucuuucuccccagcccauucuccacagcuucaccaucacugacauucuaaaagcaauccuccuuauaugccagcccuaaagcuuugcuuuucaaagugauuuccaccugagcauuuguuagaauggaaauguuuaggcuccacucauucuuauugagucugaaauuuugagaauggggcucagcaaccuucaguuuaacaagucugccaggugauaacaauaugcacuacaguuuaagaccuacuggucagcccgaaaagaucaagugccuucuucaacuggaccaaaccugcauuucuauccuuagcacugcuguucccuccuucacuucccucugcuucugccaugccagaaggcccacugugcucacauccuccagguucuugguucucuccacaucucuacguggacaguuuuugguggugaaacaucuuuucuaccuucuguuugccuaaguuuaugugucaauauuucugugaaaauuuuccacucuccaguguguacuuuuuacauagcucucucagcaccuccuacuccaaugagaacaggggucagugcugugaucuucccucuauaaaggguccaaauggagaaagacaguguaaugguuaaaggaaggggcuacgguacagaccugaacucuagcuaugucucucaagaacuguguuucuuggcuucucuaaaccucagcuuccucaucuuuaaaaugagggcaauaauaaaugccucaaaaguuugcuucaaaguaaaugagauaauuuauaugaggcacagaacagaaaagaucuucuaugccuuuaaaaauauuuuauuauguaauacuugauacagaagaacccauauauuauuaauaauuagauuauauggcauaccaauuaaacaaauccucuugagucuaugacccaacaagagaauuuaguguaagcauuaagauugaugcucccagugucuccuuccauucccaucuucuucacuuucacccagaauaacuauucugaaauguaauauuuuccuucucuucccuuucaaaaugucguuuuaacauaugcacauguuagucuguucucauacugcuaauaaagacguaccagagacugggugauuuauaaaggaaagaguuugauggacucacaguuccacgugguuagcgaguucacaaucaugguggaaggcagaaaagaagcaaagucaugucuuacauggcagcagacaaaaacaaagaguuugugcagggaaacucucccuuauaaagccaucagauaucaugagauuuacucacugucacgagaacagcacaggaaaaaccuguccccaugauucaauuaccucccaccagguaccucccucgacacaugggaauuaugggagccacaauucaagaugagauuuggguggggacacaccuaaaccacaucauugcauaguguuuuguuuuauacucauuugaguuuuauaaaaauaguguccuaguguuccuaguauucugaauuuugguuuuuuaaaguuguugcuuaacauuagauuucuaagauucaucucuauuucuguauguaguugugguuaauucagucuuaacacugggucauauucuauaauuugauuauuccauaauuuauuuagcauucuacugcugauaguauaaugauauaaacaguuugguuguuuccagguuuuauuauuauggagaauguuaauaugaacauauucauacaaauuuucugugccuccauccaagaauuucucuaguauauauaccuaaaagaaguagaguugcugauuuguagauuacgugcaagcucaacuuuauuugauaaugcuaaauaauuaucuaaagauguuaugauuauuaaugaauauauuuauaccaauuggucuuuaugaaauaauuugcuuuuggucuuuuuauuaacauuuaucuaauguucuuauuuauauuacuucuuucuauuuuccugggauuuuguugcucuuuuuuacuuuuuaagauuaauauuuguauaauuaauuuuuagccuuccuuuuguaauguaaguguuuuagcugauaacauuccccacauaaaccauuuuagauguccuccugguuuacaggguauuuuugcccauuuaaguggcuuuuuccuccccuauguguuagauauuauuguuauuuuauauagacaguauuuacauggcuggcauuaccaacguuuucccaauaguaccaauguuuuagcuuugauuuguaguagauauggaucacuugguuccaagcauuuuacauuuccauuguuaauuguuuucagcauuuagaaguguugaauuuucccaacauguucuuucuuuaacauuuuugguucguuuuggacauuuaaguacauugcgaucccuucuuuucuuuccucccauccccuucuuucuucuccuuccaacuucucucuuuuucccuuuuccuucccucauuuccucuccaauuaaugugcugacucacaauuacuguuuaguguacuuguugcuaucuuaauuugaauuucuacaagccaggagaugauuggaauucugcaccugaugcuacuagucccugucccuggugugggcuguguuuucagucugguucagucauuuuguucuuuaccuggccucugucuuaaagaauccuuugccauaguuuauacaagagucuguaagaguauauaaguauacaagaguucuauauacucucuuaaugcaucagaugaaacuucaucucaauuuugagaauuuuucugucugccucagauaaaauaauucugauuuaaagcaagagaaaauccaaauccaacgacuuaaaugguaaagaccucaggcauuggaaaacccacaaguugggcagccuuaggagcgauccagucccuccagagaaacacuucuccccagcuccuauuucaguuucaaaguaaaguauuuccuauguaucuuugaacagcccacauuuguauuucaggugaagaauguagaagcuaugaaggcaaagcuucccgaggccauuuuacaggaacucaggcuuaucaauacucauuugggaaguauagucacucuuucuucuaauaauuuuuaauggguaauuaaauaucccauuuucauuuauugcaauagaugacaucccugugauguuuuuaaagaccuacaaauucuucuuaauguauaguaaauacaaugcaucacugaucacuacugccagauuauuuacuuuguguuuagcuugauacagaaauaaaaacuauaguaggcaccacuuuacugggcaaguaccauguuucagccacaauaggagguggcaacaauuuuagcaggcagagguagcauuccccuccugcagcucagguaguaaucuccauucugagaccauggagacuauccccagagucagucugugacagagaagggucacagaacucaacugugaccaaucccaagcccgugauauugaugccuuugcaccaagcuucagacuaagaaaauagggaauaggggauuagugcuuucacacuauuuuguuacauuuuaauuuuucacucaacuuguaaggaaaaacacacacacacacacacuuauuuaacaaaguggcugaauaugucaaugaauagcucuggcaugcugaaaaggcaacuaacgagaaugaaguacagauuggccaucugugucauggagugguuggacgagaugguguaaaggacuccuccaagucugagauuugcuguauaauuuaacuuucuaauuauaaaucuuaauuaggcuuuaguagacugugagcugcuuaaagauagugcuuauuuaugauuaaucucuuuauuuagcuguuagccagugacuauuucuguccaguuuucaaaacaguauugaugacuuaaaaaucagaguaucugagauacaauuuugacauaaaauaaaaguagauuuuaaugauuuuuuuguauuuuaauuuagauuagaaguagcuuaauguuuccuuuuuuuuuuucuaaccauuggcagucauccacuguuaguuugaaccuuauucaagcuuguucuaagcugcuagccaguuagaguaacuaugauuagaugacacacuaacauaaacucuuacaacauucaagaaauuccagugaugaaauuagauuaaaaugaaucauugaugacuuuaaaaauuucuuuagcucuuaucacauuuauuuuuauaauauccuugggagauaaguucaauagucacaguuacugacugaauaauauaaguauuucuaauaaguaugaagaugauuaaauuauuuucaucuuuguguacugaauacaugcugucuucacaagcauuaaaacuauucccauuauaugauauagaaaguagaguaugaagcuccaguaaaauggcuuauuaaauuguaaagcagagaaauaauaaaaaaauaaaguuuaggaagagaaugaacaaaaauaccauuuaagaaagcaagguucaagauuagcaaacuuccuaauucuguucuauagccacauaaaaggguuuuuuuuuaaaaagauacuuagguuucaaucuaaggcaaugaguagaguuuaguaaagaauagagaguaaauauggaaauuuaaauauuuggaaaggacugcaaaucaaauaccaagguucaagguucaaaaaugaaacuaaugugcuuaguauaggguuaauaaaguuacaaauauuauuuuucucuucaaaguaaugugcuacaugacuauaucuuauuuuuagguaauguaauuacuccagcaucuauaaugaaauuuauuaaaacaguaauuuaaaaaauaacaaauuaacacaaagaccccaaaaaacauuuaccaauaaaaaagaggagguuaauauugauuauuuucuuauuaauaauuaaugggcuguacuaucacagcugugcaaagcugguuaauuagaguuaacaggcuuugcuuagacaaagaacuuugcuuuuguuuuuauuucucuuguuuaauguggaaguuacuuucuuuuuuuuuuuuuuuuuuuuugagauggagucucacucucuugcccaggcuggggugcaguggcacgaucucaggccacugagaucaucugccuccuggauucaagcaauucuccugccucagccuccugaguagcugggauuacaggugcaugccaccaugcccagcuaauuuuuguauuuuuaguauggacgggguuucaccauguuggucaggcuggucucgaacuacugaccuagugauccacccaccucggccucccaaagugcuggaacuacaggcgugagccacugcggccagccugaaguuacucuugaccauauauggcuucaguaauuaaaaaaagaagagcuacauuugacauguaacuuuaaauucuucuauaaagaacugccuucaaguauuuuauauuuuugaaaggacugaauaugaaaaagccuuguagaaauucugacaacucagauagugaaaacagcauuuugaugaaguuuuuaauuaaguaaaauggccuccaucaaacuucuuguacuucaccugcuuaaaaacaaaacaguucaccuuucuguuggaauauuucucaguguuguuaaacucucuucuuuaguaaauaucagugauagguuaugaaaguuuacaaauauuaaagguaauacuuaguuuacuuuucaaaaguauauaaacauuuacauuaucuaaacuuuuaaaacuuaccaaagauuuuaaguaauuuugcuuuaaaaaguuuuagacaugagaaaauguuuucuaguaaaauaauauaucuaugugaauucuaaucuuuaaaauaugcacugagauccaccuuccucaagaaaggugugaggucuaauucucuccuguucaguccauucacucugccucugugcccuuuggagauguguuuucccggaucuccggcuucuggucucucugggccaccugcuguccccccagcucaaacuauuuuacuuugcuuccagguuaaccuuccuaaagucagcuuuaucaugaagcuucuuggcuuauagugacuuacuucaaauugugcccucauugucccaugcauauacuauucccaccugugaaauauucccugccauuuccuuuucaaaauauuuugaaaauaguuacugacauauuuuaagcuauaauuuauuuuuaauuuuguguucuagguguuuguuauagaaaugcaauuggcuacuauauauuaauuuuauauuaaccauuuugcugauccauugcuauuuuauaauguuuucucuguauucuuuaguagcuuccuauguaaauaauuuuaugaucagcaaauaaugacaguucauuuucuuuuuucccauuuuuauuccacuaauuugauugucauuucaaucaguacagcguacaaguaugcuggcuuggaucucuaguuaaaaauugaaugaagguaacuucaguaggcauuccugucacauauuuaauuuuaaaugaaauuauuaauauauacaauggcauuuacuaugcauuuuuuuaauggcugcucuuacuaagguaaagcucuauuucuaguuuacuaaauuuuuaucugguacagguguuaaauuuuaucaacuauauuucuauaucuacuuaagugauggcuuguuucuucuauuuuaagcuuguuucuccuauuuuaaguugguaauucuauuuuaaguuggaaauggggcagcagagggacuguaguaugaacucaugauuuucugguaucuaauaacaaaauguacuaaauuggaguugugauauacuccaaaguauauguaaauaggaagaguaauuuccaaaauuauaaaauaugcauacugucaugugcuuuuuugauuagucacuccaaaaaggguuggaucaccagauaauaaaaaucucuagggcuuuguauuuauagaaagagaaucagaaagucucaaacuauauauuggggaaaaauuaaggaauaagaugauuucuucaaggaaaugaacaugggugauggcagcuggagucuugugagauugugugcaccuuccuggucccuuaguccauggcaccugccucccucuuucaggacuacuccaggccuguuccuggguauucuuuaacaggucacccuucguaaaaugacucaucaaguuuggcuucucagguccugauacccucccucaaacaaccgcauccucuaucccugacaccuguuccuauggacucaauucacuuuugucacaaccuggggcaggggcacaucuugcaucuucauuucaaacauuuucuucucaaaaaugccucuuguccucaagaucacuuacucuaguacccauauaacuaucauuguaacccuuuaaaguuuuuguuuugaaucuauccucuuucccaaaaccacuggaguuuuccuauauuucucucccuccuugucuggccuagacuccauuguuuacugaguuaccaacuacuuaauauaggcucucaucuccugugcccacucuuccauccuucauauuuguaaauaaaaccgauuuugauaagacuaauuaccuacccuuuuggugaauuuuaucuguaaaagauaacaaaaugggucaacugguuucacucuaaguuuauaauaauauuauucucacucacaugccaagccuggguguacaggucaaccauuuguuccuagaaucugguagauaaucuuauuucaaaaccuuuguguuuagccuccucuuugucuggaguuuucuuccuccaauauuugcaagacugggagcuucuaauucuguaggcuuguuucauuauaauauugucuccucagagaggacuucccuaaccacuuucaauaaucuugaacauaacauccucuuuacuuuucuuuaucgcauauaccacaauauccaacuaagcuucuagucuuaauauuuuguuucuuaaaauugaagaaccuuuugcuguuauuccaaguuugauauauaauuguucacuauauaauuguugaaagaauuaaugaauuuauuggaauuacaggcauagaaaucuagaagacucuuaagacggcacuuaacagaguaugcuuaguuaaaaaguaaggauauggagucucagaaagguuagaugacaaucacaaggccacagcacugcaguugggaugagugcucagcuagccccugaacuccagcacccugaucagucuucugaugaaaaugaaagaccccugcuuuaucuggaguccuuaauccuaacagagucaucuuuccacaaugaacuugccaaaacagauggaauaugcuaacaaacagugacuaaaaaauuuaaaaauaauaacuacugccuuaaucaacgguuuuuguuuuuucaaacuaaaggucgaacauaaccuacaucaagaaauuaaaaauuccucuacuuugucauaaaacagagcaguucucuuagcuuaaauauggucaaaggcacuuuauucuugcauuauuuucuccuccauguuucagagacccggacacugcacuaaugagaaaaucaggguagccauuccuagggcauagacaguauuuggguaagaggggcagagugauguuguaucauuucuuucuaucuuuaaguauccauucagacucuuaaacuccagaauguuauacuacuacaaaauuaguggcuuaaaacaacacacauucauuaucuugcacauuuguaggucagagguccagcaaaagucagacuggacuaaaacccaguguuggcaggacuacauuccuuucuggaggcucuagguaagaaacuguuuccuugccuuuuccaccuucuaaaugggguccacguuccuuagcucuuggccaccauuuucugucuucaaaccagcaguaacagacugaguccuucucacacuucagauuucuucugccuccuuccuuugaccuaucauuuucugaccacagauaauaaacagucuccguuuugaaggacucaugugaugacacucagcccaccuggauaaacccaauaaucucuccaucucaaggucuguaaucuuaagcauaucugcaaagucccuuuugccauguaaggcaacacauucacagguucuuggaguuaggacauggauaucuucguggugggggggcggauggggcauuauucugccuuccacagauagaguugagggguaagcuagaaauuaguggauucucugcauguaaguauuauagucaggugggugaucaggaucauacagccuagacguaagguauuuucaauuuuuauaaguaugguggauaugagcagaagcaaaaaaaucccaccucaguuacccauuuaggguugugcuacauaauugcuuuuggauauuagaaauugaaguaagaguuacgugaauuagccuacccaugugcugaaacuggaucucccucaacccugaaugggcuucacauacugcaagcagaaagcaauccauccuaccaacaaacaccaagucuaugcaguuuccccuauauuuugguuugaagagaagaauaugaaguugccuacauauuuuuaaaugaagagaaaggaauauuaucuuaaaguguuagaagaagaguauguauccagaaaucauugacuacagaagcuagaaguacauauuaguauguucucaugcugcuaugaagcaauaccugagaacggguaauuuauaaagaaaagagguuuaauggacucacaguucugcauggcuggggaggccucagaaaacuuagaaucacggcggaaggcaccucuucacagggcagcaagagagagaaaugagugccaaucaaagaggggaagccccuuacaaaaccaucagcucucgugagaacuuacuaucaggaaaccagcaugggggaaaccgcucccaucauuuaauuaacuccaccugguuccaccuuuaacauguggagauuauuacaauucaaggugagauuugggugaagacacagagccaaaccauaucaaaguuauuuuuaaguugcuucccucagcaggauuaaagaagauauggucuuuguaaaggaguaaaaugacacagaaagagauagacugaagugaaaagaugacagaauaugauucuauuauauuauacguguguauguauuauacagaauauaauucuauuauauauuauauaauucuauauagaauuauauauaauuauagauauagaauuauaucuauaauuuuauauauagaauuauaauuauauuuagaauuauaauucuauuauauauuauauuauuaaaauuauauauuauaauuauuauaauauauaauuauauauuauaauuauucuauaauaucuauuauauauuauaauauauaauuauauauuauaauuauucuauaucuauuauauauuauaauauauaauuauaauuauauauaauucuauauaauuauaauuauauauuauaauuauaauucuauuauauauaauauauaauucuauuauauauaauauauaauucuauuauauauuauauaaaauacagaauauaauucuauuauauuauaaauauuauauuauacguguguauguaaguauauuauacauauguauauaagauauaaucuaucuuguuuauuucacaaaacuaguaaaaggcauucugggaaagaggaaaaaggcauauaauaugcagcacauauuacacauuuucuauuuugaagaauuuaaauauuuugacuuaagaagaaaaagucauugaacauccaucugcacaauaucuaaauuaucauaaauucuugguaaaugucuguuuaaagguugauuaaauuaauugcaauguccuaugacagaauaagagggaaacuguuugaaauguauauuaaaacuauaauacuaacuuaauccguagcacugaagggaccacauuuaauuaucucucuauuuugaaaaaugcuuauuuuccaacugaugagguaaauggaucuucaauuccuauucaauuaugucuugaucucaguuaggcuuucuggccuuagagccaaguaacuuccaaaagguccucauuaaaccgaaucauuacccugcaggugagaggcuccuuucaggucuagccauccuuaugaguacgggacuucuguuaaauacucagaccagccauacaaaaagcuuuaaggaucucguuuaaaguagggacacacaaaauguccuucuuuacuccagguaacugccaguauuugauauuaggauauguuugaccaaucauugguccaguuguucaucaugucauccugaauacuuggugaaaagaggggggaaguuugauaaagguucgcaaauugaugcugauuauagagcaguuagagagcuuguuuuauugauccuaacagauagagacauuuuaugcagcuggaucugcugagaaccaugaugaacacagauaccaggaaaggcuaaccauuccaucaaccuucuacucccacacaaggaagcucaaggaagucauggggaguuaagagguauuguggcugcauacucccucaugaacucaucccugcgaugcuguggguggaccucagggccaucuuuaaauagaugugugaaguuauuucuuucucugugucccucuuccuucuucaacacuauuuuucaccucauagugguuucacugggagggaagggcagguucugugucuuggaagggaaaccaauuaauaaauauauaaaauuaugccuaacaagaaauguacauauaguuugaaacaaaaauugaguaguagcauuuaauagaagaugaauuguucauuauuaaaugaauauuuaagcuaaaguguaaagauuucugaugaaguacuucaggccagaguagucuagaaugguuuaaacugcugaaugguuuaaaugaaaaauaauuuaaaggauaggagggaauauaggaguuacaaaaaaagagcagaagggcugcauauuucaauuaggugaaauugauuagaugaaauccuuaaucuuggaagauuuaauccugggugauuuaagacaaauguauccuagauauaauauuuaacuuuucuguaaauggcuaaugaaguucagcuguuaaucuaccuuucccuacaugcccuccuuucaaaugaaguuugggcauauacauguuuuuaucugucuuuuuucucuauauagugaaauuuaccccauuaauaaucccugagauguuuccucauuaugauggagucggcgguaugguugauguaaauaguauuucaacuugaauuucagggaacuaugacaguuuccauuauuauugucucuuauagugcgaucuaucuaugaaaaaauuauauauuuuaccauguucccagugcgacaaaggaguacuccaaagguuuacagcauauauaguguuugccuauuuuuauuuccaucaugaauaaaaauacaauauuaauuaucauauucucucuugauguaucacaaaaauaacaucuuucacauucuuuuuucucuucaaaggcauaagcagucugcaggcuccuuauuuugccaaaauggcccagagucuaaauucuagaaagcaccguaaagucaguauaguaauaucaccauaagcauauguauaaucuauguggauuauauuuuauagaguuucuaagucacgguuccuuucucucuuauuacauauauccuuucuucaugggaauguaaggauugagagacaauaucuguuggguguugucuggcucucaguuuugcuuucuuaauauuugcaauggaguaguauugaaaaugauaagcaggagugucacgaugugaucugugcuuugaaacuacuacagguaugucaaaauuaggaaggauugaaagaauggauaccuggauaagaaauugcauuguugaagcuaauucauucauuuuauuaaaagguaaucagaacuuggauauggugaccaugggaaaagacaauuacauauguaagggaguuugggagggaggugacaaguaaucagauauagggaagaaaaugaaaguuuuaaaaaauucaguuuuugagacagaaaaacuacaguauaaugcugcuauuaauaugaaaaaggaggcuaucaggauggacugugguuugcugguuuuuuugugcugaugggacauuuuugaggacauacaugauucagagggaggaauauagaggaccugccucuguuuuaggcauaaucaguucccuaugcuugcuauugaugcccuugaauuauaggguguuuuacaugauucuguaucauuuucugguuaugaaauuguacucaaaacaaauuuucuccauguauacucacuccccaauucugugacagaguuuacagcggucagaaccaccucaggugccgcugcaguuagcagcaacgugugcagaguccccuugcuucccgggaugcaaugucccacuugugauguccccaucccacuucacuuccucauuuuugucaucucugaaugaaauucggaagaaaguuuuauuuaggguggagaaaucacucuggcuacuucagaauaucagcauccaccaggugaaugccugucuaguuguacgguuuauacagaucgagcauuucugaagugggggucaguagacgaaauacacaaaauguuuuuccuuuuacuaacaggugucuaugccagcugggucucuuucugguagcaacauccugaugauccccauuuguuuuuauaaaucuaaucucaucugcuuuauagguaauaacauucccuccauacaauggauucaaagucaguacuaguucuggaucucauuauaaguuucaaauuguuucuuagguacuucauaaacacuuuuugggaaguugggagauugucagucaggaaauuuaaaauggcaauggcaucuggaggagacaggagaaaggauuuguuaaaaaaaaaaaguaggacuuggcuuauguaaaugguaguucuaaacauuugucaucagauuuaagaaauccauuuuuaaauauguuauuauaguuguugggaauaaugcucauuucccuguuuuaggacucaagugagaaagugcagacuuuaauaccaucaagacacauuuauuucuucagguaugguucuuucuuuuugagaagaucuauguaaauguuguguuuucuuguguaucuugguugccauaaaguauagaguugaauauuacaucaaauuauagccuguguguuaaugcugacaaucaauauguauucuuucuucuuuccuuucuucuugauuugucuuucugugacaguuauauuacgauauuuugugguaaaugauaacacuuaaagaagcaggguuuaaauauaccaaacaaugcagauauuaucucaccugcccuuguagucaagacuaggagugggaguagcuccugcaaggaacucgugcauaugaguccaauauuaaauuacaaaauguccugagcucauccuucauuuuagauccuugaguuuagcuccaagaaaucuuucuaauucuguuuuuagcucaauuuuucaacugaaaaaucuugauggcuuuuuuuuaaagguagguaacuauuuucucuuugugccuaauuauacauaauuaccugaacaauggcauaucuuacaaagcuuacauuaacaugaauugagaaauuauaaccaugaaguuacaaaugacucugaaaaaauauuugauucaauuaauuaucaacaucaaaauuaaaagguaagugaguauauggcaaugauucuacugaauaacagauuaaaugaguuuuagaaucaauaauauuaaucaauauuugaaaugaaaagagaaugcauaaugcauuauuccauaauuaucauucagucaaccaauucaauauugcccuacagagaauuguacccuuccuuugacauuuuuaaaguuaaauauugcccauuuggaauaaaugugauuuagguaaccuuucauggaacacagauacauaggaugcuauaaaugucaaggaaaagaaauaaaccuuuguuucuuuacccagacauaacaaaaauaaagcuauuauugguaugcauuaaauagucaucgagaaaucugcuuaucuucaaaaucaccgacugagaauaucaucauuaagaaagguaauaaaaguggaaauuacaaugaaccaguauuagugaagaucauauccagagagggcagaaacaucauguuaaucaucucuguauucccgacagugucuugcauaguaucuugaaaauucugggcauauaauaaauguguuuuaaaugaauggcauuuugaguuauuuaauugcagguauucucguuuuuuucauagaacauauuucacugguaaguuucaugaucacgauguaauacccaauuuacagggaauggcaaaugaaaaaaaaaaugccugacucaguuuccugaugcuauuuuaaucagaaacuaguuagcucacaugaauuauuccaagcucgaaacuucuuauuugguuucuuaaauauauaagguaauuuacaugacauauaccacauguauauuuggagaaggcagaaaugaaauuauuacagagguauuucacgauccucauaacaaagcugaaccaacuacaugauuuaagucccacugaaacacuguaccuauaaacugaauuuaccaguuaggaguaaguaaacugaccucuguaccauuugguuaaccaacagauucuagucuauuacagguagcuucacuuuuuggucuuuuguguagcugacacugaauggugucacagcacuguuuugauuuccuugcaggcauuuguucuccucauguuuccauaacauuuucuuuucaggagaggaguuuuaagauggccaacuagaggcagccaggaagggccgcuaccaccucuaaaccacuguaauuuaaaaagaucuucagagagaaaauaccgaauguggaugaagaaaacacgcagaugcuaaggcugaagcaagaggaggcuggaagcccugugggaggugccugaaugcuaaagcugauuccgggccucaaauggcuccugaggaaggggugagugaagagccugggggacagcccacgcucaugcagacuucugggauccuagcugcagggaaccccaaaaccccaauggauguuugagcuggcaggggcaucuccugggagauuugauagaggcggggauucagcagacauggagcuggggacauuuguguguggaacagaucugacagagcccagcuauaggcacccgucucucagggcucuccaucucccucugagaggcccuggccccagaaaacuccuggacugggagaaagcagggcgagcuuccccacggcacugaggcacaucugucccgcagccccgccugccugucagccccucccagggcuccugccuggcugccccgcagcagcacaugcacagugaagcgucugcugcccagccugggugcuguguuccacuggaguguguucuggcagccugcggccccuuagauccccagcacacccagaacccaacccaacccaguccagaggagggagccgugagcagguucuggcacugcaggguuggauccuauggcucaggagugcugagcugguaccugugcucggaacuugaguaggagaggagcccacacucagaagggugagaugcacagguucacaggcugguguggcaccuggaaugccuccuuccacagagcuggcccaguaagggcguggucuaucccccugcccaacaccugccccagggaagcccacagccagaaacaucaaacaaacaaacaaacaaacaaagccacggcacagugccggugaucagcaguggcuuccgaaggccuauuaguggaacuggugaggggguuaccccucucccccucacacuucagagcacagcugcacacgcgaggauacacaguccccagcgcugaguauccaucuaccacccauagcucuaaagcaccaucuacggauugcaccccaaacuacaccaccacaaaaccauucacccgccuuggaagccaaggacaagaauucaacagcaaacaaaaaccccugcacagagucuuguguggccuucugaaaauguccagaaaugaagucaacugacuauacucaauuucugccacaguuaaaggaccagagacccaccaagaugagaaagaaucagcacaggaacucuggaaauucaagaagccagagugccuccuuacccccaaacgagcccacuaccuccucagcaaugguucuuaagcaaucuuaaauaacuauuaauaaaaugacagacagaugaaauucagaaucuggagagcaagaaagcacaucaagauccagggaaacguugaaauucaauucaaggaaaccaagcaauccaguaauaucauuuaagagcugaaaggcaaaauagaaauuuuaagaaagacccaaacuuuauuacugauucaguuuuagaaguugauauuggucuauccaggguuugaauuucuuccugguucagucuuggcagauugugggcuuccaagaauuuauccauuccucuagauuucccucccucccucccucccuuccuucuuuccuuccuuccuuccuucccuccuuccuuaaugaaauuguguccuuuacagaaauauggauggagcuggaggccauuauccuaagaaaauuaacacaggaaaagaaaaccaaauaccgcguguucucacuuauaaguaagagcuaaacauuggacacacaugaacauauaaacaugggaacaguagacacugcagaguacuagagaggggaaagagggagggcguugauugaaaaacuaccuauuggguacaaugcucacuaccuaggugacaggauccauacugcaauccucagcaucaugcaauauuuccauuuaacaaaccugugcuuguaccugcuguaucuaaauuaaauguugaaauauuuauaaauuuuuuuaacuugaagcuagaacuucgcauuuaggcaaaguucugugauucaauaauaaagacuuuaccaccucagaucuauuaguuuucuuaagccaagaugcuuucauuagagucguauagauaaauggaaaauguaguguuuggagcccaauuuacagauauauacagaagaguaacacauauauuuuuauuuuauuaguguucaugaguauuauauauuuaguggaguuauuugaaagggugaaaaugccacuugaacgaagugcuuugcauuguuuaaucugagauugauauacucauuuggucuuauaaaggcacugauuuaucuuauugaugguauagccuauucuauauucuauaugucauauaugauacagaaugcugacuauacuuuugcuuuuuccauugcuggagucaauauuuauagaagagcuuuaggaaagggaauaaacuaaacuucuagcuuauuauuuguuugcaguagucuguuggaaagaugaaaaguguauuaaaauuaauuucucaauaacaauuagggaaaagauacuucuaaaacuuaacuuuaaguauagaacauguauaaauuuaauuuuccuaauaugauagcaauggaaaaaguaacuucaauauaauggaaauggaauuccaauauaaucuauuaaaauauuuuaaaucuucacgaguuuuguucuuuuggaguuagagccugaaaaugcucagauguuuuagaaagaaagugaaaucaaaccuaaccuuuaucagaugggaauauuaugaagauuauaaauauuuauauuccagaagcaauuuaggaaaaaaguaggcaauuaguaacuuuuuaaugucugaauuaauuaggagaaaauccauauuuacuauagcaacugcuuccauuugaaaaucucugacauaccaagcucuuaaaauaacaucaguaauucccaaauaucauuuuaaaugucuacauugacaagacccaucacuggaaacauaucuuugaauugaguuuuauacauauauuuuauauacacaaauuuucaagugacaugcauauguaaugucaaauguagacauuaauauauauguauuuauauaucuauuauauguauaaauauaugcaugacauuagauauagaaauacauuaugucuaaugucauagauauauuuauacauauaugugucauauauauguauaaauauauauauguuuauauacauuuuauauauacauauguaaacacacauauacauauauguauauauaugcauguaaauuuauacauauacuauauacauauauguauauauacacauauaauguaaauauauuuuuaaaaagauauuugaaauacaacuuuauucugauucuaaaugaaaaggaguagaaauggcaguaacaagaucucaccccugaauucacuaaugugauugcagcagucuuacauuugaaacucaagaaggaaucaacugcauuccaaaacagcucaauaugcagguccaaacaaugaagguauuuuucaaacugccacauucacuccgaagcccacucaucuccuucagcaucccacagaugaaccacaugccccaccuagcuagauaauaauaagguggcccauacccugcuccgcugauaucacaggacagcugcauauaaaacuagacuucugaugcugggcuccagcuucauucucacaggucaucaucgucaucugggagagcaguugucugaagaaccucuaagucaugcuuauaaugcucugucaaagcuggguccauggcaaccuccaguggggcaggggcaggcauggcaacaaacuccaaguuagggucuccaaugagcuuccuagcaagccagaggaagggcuuuucaaaguuguaguaacguuuggcagaaaugucuuaguacugaacauucuucuuucggcagaaacagucaguguuauaauagcaccaucuugucaagaaguuuacagugauuauaaacguuaaagaaaaaucaacuccauuaucaaaauugaccaguuaauauuaaagggagcaucuuucugggaauccuggcaaagaacaugaagauccuugcaugugagagcauaauagauacaggaauaacaagaaucaaugauauuaaccauucauguagaugucaaagcugcauggaugagcaugguugagaaaggaaaaugucaguuuccauccgauuuuugucaggguuguucagaggaaaagagauuaaaaaaacaaagcagccuuacagugaugggguaauucuagauauaacaaaacuacuacuggguuuguuuaaaaacugggcaaacaauuuuacuuucagauuuuguuuuauuuuauuaucuuaaugucaggccucugagcccaagcuaagccaucauauccccugugaccugcauguacacauccagauggccguuccugucuuaauugaugacauugucuugugaaauuccuacuucuggcucauccuggcucaaaagcuccccuacugaguaccuugugacccccacucugcccaccagagaaaccccccuuugacuguaauuuuccuuuaccuacccaaauccuauaaaauggccccaccccuaucucccuucacuaacucucuuuucagacucagcccgccugcacccaggugaaauaaacagcuuuauugcucacacaaagccuguuugguggucucuucacacggacgcacaagaaacuuaacauuuuuuauuuccacagguuuuuggggaacagcugguauuugguacaugaguaaguucuuucguggugauuugugagauuuuggugcacccaucacccgagcgguauacacugaacucaauuuguagucuuugaucccucacccgccucccauccuuccuccggaguccccaaaguccauuguaucauucuuaugccuuuguauccucauagcuuagcuccaacuuaugagugagaacauaugauguuugguuuuccauuccuuguauacuucacuuagaauaauagucuccaguuccauucagauagcugugagugccauuaauuaauuccuuuucaugguugaguguauauuccauaccuaucuaucuaucuaucuaucucauaauuucuuuacacacucauugauugauggucauuugggcugguuccauauuuuugcaacugugaauuuuguugcuauaaacuuuuguguccaaguaucuuuuucauguaaugacuucuuuuccucuggguagauacccaguaguaggacugcuggaucaaaggguaguucuacuuuuaguucuuuaaagaaucuccacacuguuuuccauagugguuguacuaguuuacauucccaccagcaguguagaagcguucccuuuucaccacauccaugucaacaucuauuauuuuuggauuuuuuuaaacagcaugguacugguauaaaauaggcaugcagaccaguggaacaaaacagagaacucagaaauaaacccaaaugcuuaaagccaacugaucuucaacaaagcaaacaaaaacaucaaguugggaaaggacacccuauucaacaaauggugcuggauaacuggcaagccacauacagaagaaugaaacugaaccuuauacaaaaaucgauccaagauggaucaaggacuuaaaucuaaaaccugcaacuauaaaaauucuauaagauaacaucagaaaaacccuuccagacauuggcuuaggcacagauuucauggccaagaacccaaaagcaaaugcaacagaaacaaagauaaauagaugggacuuaucugcacagcaaagggaacagucagcagaguaaacagacaacccacagacugggagaaaaucuucacaaucuauacaucugacaaaggacuaauauccagacuuuacaaggaagucaaacaaauuagccagaaaaaaaaaccaacaaucccaucaaaaaguagaauaaggacaugaagagacaauucucaaaagaaaauauacaaauggccaacaaauaugugaaaaaaugcucaaugucacuaaugaucagggaaguacaaaucaaaaccacaaugcaauacccccuuacuccugcaagaauggccauaaagaaaaaaaaaucaaaaaauacuuuggauuuuaaaucccacuguuuugauaaaaggauguuggacuuaaccaguacuuuuuaaauagggaucuauaucaggaucucuuguucaagcuuucaaauaauauguagauugauauuccaacucaauagauuuccuugaaacaacuaagucaaguaauugucuuauaagauucagucauucuuugacaaguguuucagguaaugaaauuaaguguauaaagaaauuauuuucccaucaaaagaaaugaaaaugauuucuaaaacaucaaauuuucuucucaagcauugggucucauuugaaaucuuuaaaguagcagaagagauccagccuggagcauuaaaacacaacaaaaaucacagaggggacaauuguagccaguugauguggucgccccucaauuugaaaagcgcauauuuagaaucugcaacaaggggaagggaauaaaguuuaaacugagaaaaacuaaccucuuaaucccucuugacuuccacagucuaauauuuaaaaugaagaguguuaccuaagcaaccuuaaauuucgcuuacaauucuaaaaauccaugagaccuaaauauugcauuuauuuaaauguauuccuccuuauguuaacuaucucuuaugguucacaguguacuccauaaauauguacaauuguuaugugucaauuaaaaauaaaacauaaaaagaauaaaugcaauaauuauuuuaguacuuuuuaaaaaauaaaagcacaucugaaugggaaccaugugcuuucuauaagucuuuucaaguccugcuuggcgcagagccuaacuacuugguuuaugcauuguaagacaagucaccauuuaccuggaggcagcugcaggcaugaugucucacaaugaauaagcagccucuauugggucugcuuuauaaacucaguccuaguaaauaaugucaacugucacaccuggcuuucaaaauauaagaaauaguuacaaacaguucccuuuguuucuuaacuuaccaaaauaggagaaugaaauaacguucuuucaauuauguuuuugcuuuuuccacaugaguaugccaggaucacuugagaauaaagucuuccauuuaucuguggaacaguucaggcauaaacaccugucacguaagucucugcuaccaaaaaagucaauauguaucucucuaguuguggagggauuuaugguagaacagauuuucauuuucuccuugaauuuugcuuuauccugaguuuucgaaugaaucucauuuuuuuguaaauucaaucuuauacaagugaaugucugaugcugggaaaaacuaagaugauuuuguucaaaaacagaaaauguagaaaaugggaaaagggggugugagccaucuacucuguucuuccauuugagauguccaauuuacaaaucccagaacucaugaauuucauugauaugguacauacuuauuuauagaaauuucuucacaccuaacuugugagcucucuucuagauaccauagaggaugucacacauugccugacuuaaaguuaaauuuuaauuggaauaauaagauagccauauaaaaauugcauggcaaaauaagaccuaaagaauuuuaugucagaauaauaaagaggauuuccuaagguuguaguuguucccaaaccauaggagauaggagauuaaggaaccauuuagaaggagaaauuggguaaguaacuugaagaaaagaauaauaaaacucauuaaaguaguuauaaauauuuuaaauucacugaaacaauuaaaaauagcauacuaaaaagauaugccacaucuuuuaaguuacuaguaauuggugcuguguuauuauuuauuucuguuuaauagacugguuuccaauuuuucagaccuuuuaaggagauaacaguuaagauauuguuguuguucuucuuuuaugcacagccuagccauccauuccuuucugaguuuucugacaugagacucauuguccucugucuucugguucuugccaccaucaacuacacugagacucuccuuaacuuucuguguucuugcagauauaacagccugggaugugaugcuucuacagccugaauuucauuucccuggcuuuccuucacccuuuccuaguuuucaugacagaggcucacacuugugagauuuggccuagggcacugcauguuuaucaucgccacgagaagagcacuccuggagaagcugcugguccaggaugaagugcacauggagcagacaugaacacaaccccagccgacgugaaaacccaagagcgagaagcaaagcuccauugcuagaagucacugugcauguguaacaugauugcugagaaacauuauuaauauauauacuuaaguaagagaguggguggcucuucuuuuccuaaaugucagacauguuuuuaugcuuacuuaguucagcugacauacauuagccaaaauuaccgaugcuuaugcuucuagaugugcugaaacugaguaaugcuuugagggugcugguuaacuacuacaacagcucccaaaccuaacaugcuauccaaccuaaauucugugguuugauuucugggugggaacaaagaaaauaaagugggcaguaaauacuguguaaaaggacuauuauaaacaaauauuuucagcauaauuagauccacagaagacauuuucaauuucuaaguuaauaccugucuacacccaugugcaacacauggaggaaugcugaauugccuuugccauuaaugauggauugacuaauuauuaacagaucagagggaagaacaacuauuagcuuaugaaaacagucuuuuuuuaauuuuguacuguacaacauuauucauaauaauaguuaaaagacaaauugcuauuuuucuuuuacuaaaugugcucugcagauaaccuaaagauuaaauuuuaagcagugauauauggagucacauaaacacuaagcuaaauaagaauacugguggaccauuuaguagaccaucuauaaauggguguucccacaugucccagaguugaauauugauaaaucuuuaguacugagagauagaauauuugugagugugcaaaaagugaguugagggauugcccaggaugccuuuugccuuaaggguacaagacacuggguaugguuuuuguuguugaucuguuuaagaguaaagauuccauucauagcauaggccuugguagcauauaggaggcaauaugcaauuucaaggccuugaagaaguauuaugauaaaauauccacccuuucugugcucuccuuuuguucuggaacagaaaggaggucaaagcauauuggucauaaaaauggaaacagcauuagaguuccuggaaugaaugcucaucacauaaacuuguaagguucuccugggauaaaaucuauaccaucacagguaagaaaggacaugcuagaauggauagauucacaggaaaauauuucaauuuugagugaagcaaaauuaaccucuucaaacugugaacagagguucuaguaaagagauuagcagauacuucagugaagaugccagcguacccuaugagagagagaauacugaaugaugagucagcucuuuucuuuuaaguuggaaucaaagcaagagaacuuguaccaagacagucagcaaaauccuucuuagggaaaaccacuggguggauccccacauacauucagcauauugguauugaguuccugcugagugccagccaguauacuuggcuccaaguauauaguuauaaacagauacauauuccuuaauuacacauaaacauaucuauauguuaauauacacauaugugcucaaaagauaggccagcugaacaacaguacccaggauauaaaacagccucacaggaggaggcucacuuauccuuaucccacauucuccaaauuaugguuauagcaaaucugaguugcgcuaugcaacugguacuucauauauugcaugucuuaagcagaauucaucauccccauagagauuucuuuuucuauacuuuguaucucuaauauuaucaucaacaucacuuaccaaguuacccaagucuuaaacuagggagaccucauuaucuccucuuuacuugcuuacccaccccuugcaacuggucacuacguucuuucacacuuaccuguucacugucucuugaaugucccuuucuggccaugucuaaugucgcagcuaaaaaucuaaguuauuuccaaaauauuucaauaguuucccaguacuuuuaggaaauaauccaaauuuauuuaguaagcaagaaaaagucuuuaggaucagccucucuaguuacucagcagauucauugcuucuuucuucucuuaggcuucugaguaugaaauuaucucugugcauuugagcauucugugucuauugauggcauuacuuuucaucuuuaauuccuuuaugccucugcauauuuuagcuuaaauauuacauccucaacaacaauaaaaauaaguaaacaaucuccccuuuaagauuuaguugccucuaaaugcauacauaugcagacaguacuuaacacaucauauuacaauuuuauaucuuguuuauuaaaugcugaacucuauuaggguuugaaauaucuaaauuuccuauaaugggcauauuguaugcaauaaagcugcuaguguuuaauaaacauaugcuuaauuaauaaaaggaggggguuguaauuaaaauaaaccuauaauaauaaaaaauaaaaucuugacagugacagaggcaccuagcaaucugguuuguaaucuggauaaaacuucugcaauuauaaacucccagcaacauuauuauccucugagccagagguuaacuggggcauuuuauuccauauuuccauaauuugauaaacaaauuugguuccugagaauaugaacauaaaugaaauaaauggccuggauauaauaauugauaagcauccacuaacaucacguaugguucuguauauugaauauuuauuuuuacaucaacugaaauuauccuggaaacacuuccuaguuuuaugauagcauuuaagaaaacagcuaucucgcuuugcaauugcuugugauauugacaaaccaauuugucagucacagugguucaguggcugcauaguuaaaaauaauauuaaacuuauccaagcaaaccuuuuauguuucuagguucuuaccaauuauauuuucucaaccagguaaccaaaaccauuggauaauuuaugucacuucuguuuugcaacuuuuguaccaaaaaaaaacuuugauucauaucauauaaaaaaguaugauucauagagaaguaauagauauaccaauuucuuaauuaagguuucugcacuuuauuugaagauuuaucaguuucggaggcagugauaugcccuccucacauauugugaguugguaggcgugaccauaggguuagaugacucaaaaugaugacagucuauuagauacaucauuaauuggaauuuauuuguacaccuggguaagucauauuacauaagagaauucauaaguauggaaaaauuauuuguagaccaugcagugauucuggccuucagaacauaugguugacuaaaacgagaugagacuacuuuaccuuguuccgcauauuuaaaauauuaauaugaagacugaugcauuuaaucuguguuuaaaaaugaauagaguugguuauauguuuuaaaaaguuauuucuuaaaagauugcauccaaaucaaacaauaucugaacaucaaagauaaauagguauaucugacuuuccaaauacaugauucaccuaauuuuauuuuaguucaacucuaaucucagguguagauauguuaauaaugcauauuaucuuuuaaaaauuaaaaacauaaaaguuaagaaugccagaauaaucguauuucugaaaugcaaauucgaucauaugauucucuuaccuauauacuucuaauagaucucgauagaauaaaaucugaauccccuaaaagauacacaugacuucccaauuugaauucauguaagcccuuucugcucuuuuuccuuauggcccacaugcuucagaaaccucuaaaauugcccgaagauguugugcaguuucauaccuugucaaugcuguucccuuugccuguuuagacugacucauccucuugcccaaaucaagaacccugaccuuucccuuaugucucagaucaaauguuacuuccucugucaaauaaccacugaauccucagggaagcaaguuacucuuuccuuuauacauaaaacaacuuuuauacaucaguuuuauggauuuuauuacacuguauuguaauuuuuuguuugagaucuguuuucuccuuuagagaauaaauucuuucugcucagggagccuguuuuauuccucuccuuaucuucuaaguguauugcuuggugcauggccucuaguaguugcucaacaagaacguaauucauucuggcacauauaggaagggaaaaugauagagacagaaaacuccaucauucagguuuugcuuuagauuuaggcguuuccagugcuuuuugauauugaagaaaaaucacucugagacacaaacaccuacauuuauuuuucagaugugguaaugcuugcauuaaaccaucacuugaugucccauuuuacuugcaacuaaugaacagguuaauugugcugaaucgcaggucagcugaauaagaugggauuuaacuuagcagugugaaaaaaguaguuccuuuucacaaauacagucgauauguguuccuuuugugcauguaauccauggugcagaauaaagucacugaagaacuauuaucauaaauagcauuauuaggaaugaguugaacuuaauuuuuuucagcuaucauucaaaauggcuuuauaaaaacauuaaagguguuuuuuaagcuugguggaaacuuacuccauuagcaguucauguaguuauuauuagauauuuccauaugucuguuuuuaagagguccaugaaauuuuaauuuacuugaaaaccuaaaauguagaguuauuuguuuugacauguuuaaucacuuuuccauuuuaaacuaaagauaagaagucacuggggaaacagggaaacagaagacaaugucagagugaacucaaagaaacgagagauuugcaaaugaaacuucaccuuauuaaauugucauuuagcugaguguuuuuauuacuucuuaaggacaugaaaagcauauaaauuguuuuuguuauugcugauuuaaugugaaauuauuaaaucccuuaaaaaucaauaaaauaucccacuauguccuacuaauugaauuacugauaauaaaaacaucaauaagaauauaaaccuuugaauuaaaguuuaauaauuuauuauaucauuucugauaaauaugguacauuggaaucuggguggacuaaaaagcauaugaaacuuauucauaccauuuauucauucauuuguucauccaucuagccaagugcauuaagcacauauaucugugccaggcacugggcuaggaucuugcaaaacaaugacaaaugagggauguggaagccuaauuuucaaaaaguuuauauuagugcuagaguuaaaaaggaaacacagaaaaauauaauaccauugcacaguauuaaaauagauguuaaaggaaacgagcagaguucaauaagggaaauaaaggugagccuugacuacacaagagugucuuugaggaagcaccucaacccugguggaugaaaagaaacuugacaauuguucugaaaaaguacauuuaugggcaggcacuggccuuugcaaaaacaguuauauuuguuuccauucaggcuaucuuauuugccucucuuuuaaguagccucuuccuccugaucacuucuuauacaauauucacaucaaaauuggaucucagggaagaagauguggaacuucuuucagaaauauuugcaugucaacagaggucaaaacccccauuaucaccauagaaagaaauagugcucuaaugugaauguuucuggcaucaugcauucaguauauuuuggggaccuggagggugucauggagagcuuucccugguuaccaagaaauauaugccaaugaggcaacaacugaaggucacuccugcugaguuucuugaaaauauucuguuuucuugggcuacugucagggcaucaaaaagccaugccuggagacaaauggagagugaagccaggugaguuuaggcuuucugaccuuucuggauuuuuaaugaagcagaaauguggauauggggguaaacaagcacaaguauuuucuuuucuugugauucucuauauaggguaccagaguugugugauaucaaaggugacauaugcuugcaaccauacuagugugaagguaaaaguaacaaucuccucuaggaagaugccauaauuacuuucauuuuugguacagaauaugaugaggacauacccauggucaguccaguuauuaaagcucaauguuggggaagaacuguaaaggucaucugucccaaauaaaaaaucuucucuaccauauccuugacaguccuugacauauccuuguuugcccucuuagaagagcuguaccuuuucucauugccucucaaaauucuuuuaagacucagaugagaugacaucaaugacagcacauugaaugguuuaaggcacagugugcauaugcaggguuuaugcaaugcagcaaaagcaagagaagucaggugagaauuccuaagagaagggcaaagaccauuguaauauauuugacaauuuugcauugauuuuucucuggcaaacaaaggaaagccuuugugagguuuauuuaaaugucagaaugagaacaaagcauaucuuucuguguuuauucaguacauuucccacauauacgguaggugcugaauucacacaaaugauccuaaaaucuuuuuugggucaucaauuuguguaauaccaaaaguggcaauucaacagaguuuuaaccuaucaauggaccaaacacauauaugacaauuuuaguugaauaacaaaccauugucucucaguucaucacuucucuuauauuuugcuuugugaugcuggguaugaggcuccgaaaucuaccuuucuccuuuaccagcuggcucugcauuacacucuaugauacaaguacuggaggaagacuguaaggcgugaggaaaaaguagggacuuguuccuguugcauuuccuauucuuuccaguguugccacaaaaaugguccuuuaauccaugcaccuacuaaaugguaucaguagcauuugguuaccauuuccagauuuuucccacacucugagauauauuagcacacauggcaggcaccuguacucagaggucugaucuaagcuccucagggucccucuuccaauuucuuaggguauuagcacaagcugggcaacaucaacuucucaggggcaccuuuccccacuaauauauauacuacuacuacauaggcuuaguuuuacauaguacauacuaugugcuaucacccauacaaauuguagaauacaccaauagaagcauuaacauguuauucaugguaaaauacaauacaugucauauauuaugcuuaauuguguacaauauugucucuaugaauauucuuuaccaauggcucgucuuccauuuauauugggcauuaaaucuuuaauuguaaauagugcacucuguuaauuacaucccugccaacauucauaucagcuaugcagaagucuggguaccgguucucuagggggccuccuccaaaugucuauguucuaauaguucaaacucuuccccuuuguuccuucaguaacuaugcuaccugcugucuugguuuguuugggcuacuauaacaagauagcauagaguggguggcuuauaaacaacagauacuuauuucucacaguuaggaagguugagaaguccagaucaaggcacuggcagguucagugucuggugagggaccacuuccucguugaugccugucuucucacuguguccucacauggcagaaggcucaagggaucucucugagcucucuuuuauaagggcacuaacaucacucaugaggguuuuguccuccauaccuaaucaccuugcaaagucuuaucuccaaauacucucaccuccgcgguuaggauuucaacaugacuuuuggcagggagcgggagugguggggagaaacauucagaccuucacagcuguggugcuccaguguuccucuugagccuuuucagucugccgaugucuuuuuagccauuucucucuauuaaauuaucucuguugaaauaacugggugauuuccacuuuccugacuugccccuuauuaauuacaacaauauauaaugaaucgaagacauaaucuaacuauauguuuuuguuucuuuuuuuuuucuaucagaaacuauaucagagaaauauuuaccuguacuucaaguauuuuaaacauucaaugauuaguaguuugaaaccuucuuggagacaaggauaguuuuagaaguugcugauuucaguucaguaucuuuuaggggguggcaguuuaaaacagaacucuccauuuuggugugcuaugugcauuucauuucaauuugugagaagugguaaugacagcugccaugccuuuccugagaaauaggacagacugucauuuuuuagagacuagagugcacaaaauuaauauauaaaauggaagaugauuuaaaagucagcaaguauuaucuaucagugucuacaauuguuuaugauaaacaaguaaguuuaaaauguuuuuaaauuugagguaaaaauccauacuuccuuuaaacaguacucaauucagaaaagauuaaaagcacuccauaauuuuguauaaccuauuggaucauuccauugucaaacauacacucucuuuaacugaaaaauaaucauccuaaauuucccauccugcuacucauuucuuuuaugcccaacgucucacaugagaugguuguacucugucucuaauuacucugaucuugcuuauucucguuuucaauuaaaaccacuuuauccagguuucaccuuuaccaaugcauagaaacuguuuuaucuuaucaaugccauuaugaauguuauuacaucuaguggguaauuauucuucuuuuuuuuuguggggggagggcgggcaucuuaauaguaucagaucuucuccuugauguaauuucuuuaccuccucacacugcacuuucuuggaagagcaauccuugacuuucuugaaagagcaauccuugacagcuccuagacaguauauccaguccaucaggaaauugccuucaacuuauacuccaaauccaaccacuucucagcacuucaacucuucuucuacuaccacacaaucagcucucaaauggauuuagcaacucucuguuucuauuacuggauuugaaaaucuaccuuuuagcacagagucagaaugaccuuuuacaaugugaaacagauuaugucacuucuaugcucaaaacuuuaguugcuuccaguuucaugaagagugaaagucagcguuuucaagguggacuuuugugugcucagccuuacaugcgcuguucacugcauuauguuucuucuguuacuacucucucgucauucacuuuuguucaggaaacauuuacucuuuacuguacuucaaacacuuaagucaggcuccuauccuugggccuuagcuuuggcuuuucucucugccuggaauguuuuucccccagauaucuacuuaacuaacucccucaucuguuugaaauggguuuaucaccuuuguuauaagguuuaugcugauguguuuugcacuguugagggcccucuccaccuacacuccaaaucccucuuauucuccuccuuucuuuuucacgguauuuucacuugucaucuucuaacauucuauaucauuucuauauacuuuauuuauauauaacaauuauaagcuauguuugcuacuucuacaacaguuuaagcucucuauaguucagaaagcuuuuuguuccccaauuuauauuauaugcccagaacacaguaggcuuacuauagagaaaauguuuaguaaauauuuguuacaugaguguagaaacuuauguaaccacucauucuccaugaaaagucucugcuucccucaaaugauguccuaauuuuuuuuuuaacagaggagacgguagcauaccuaucuuuaugauuuucuuccuaaaugccuuuccucccucacccagcugaauuguaaaaguacuccagagcucuacucugauccacacugaccuccuuguucucaguuuguaaagccagcaugaaccaauggaaaaagcucaggaaugaacaucagacuuacuaugcuuugggucaugucagugcauagccguguaauccugggcuguucucugaacaucugagccucaauuuccccauuuuaaauaauacagugaauacucugaucuguaagauuucuuuuaauucuaauuuuuuaugacuuuaagcauaauuuaaacacaauguuuacaguauauauuugucuaauaagaaggcauucuaaacugguuauuuuaccaucaaaucuaauaauguuuuuaaacacauaugauaagcuaaauguuccuuuaugcaguuaucuccucaacuauacuguaaacacauuacuugagguauugauuauuguccuuuuuguuuucguacuaccaagaucaguaccaauaacauaauaacaacaagaagucuaauacuuguaagagccacuuacccuccuaaucauuucacacuuaauucuuauagcuagccuaggaauucagauacuauuuuuauccccauuauaccauuuuacaaaggaaaagccuguggcacacacagauuaaguauaauucauaggcauuuaaguaugugguagauuugaacccaggcauucagguucuagagucuauguaauuaaccaccacaaccuacugcuccuaauuuauuacucaauauauuuuaguuauuuaagcaagcagaaggcagagaacagaaccaaugaaucauuaggugcuuuucugacuauaacauuuuugaauacgacuagauaauuauguaguuuccagaagcagauuuaauccccuauguacaugagucauugucuuugcuauaaacugcuuaggcuggguauuggcuaugucagcauugcuguaauuaucaaauucaaaauacacauuugggggcagaagacaugaugcuuuccaccauuuuccauugguaaaguacaagauagcacauuuuuuuccauaacuagaucagggaaaaugaauuuggaugcaaaaguacauccaaucuuagcaauuaacaaggaaggcuucccaaagacaguuccauuuccacauuagugcaugaaagccaaagauagacccagcugcucuucccagcucugugcuguguuuguaacugcucaggagcagugaaaacauguuggaguaacacauuaaaaaaaucccuaaaaggaacuauccuuuuuuggauuugcaaacaaaacagacugccaaauacauguuaaauaaaaauuauguuuuauguguacaugauuuuuuuuuuaguuuuguuuuuacccuuuagaaaaagcuuuccauaaaauuauuggcaaagaaacaaaacaauuauguuuacacaggugaaagugaagaauggaaacacuaaacuuaaggccauuaaauuagacuuuugccugaauugcccaaacaagaugugaauauuugcauugucaucuuuaaguuauuucuagggauuagcugaaaaaaauuauaguuuauauuuaguuauauuuggcuauuuguuuuauucaauaguuugcaugcuagauauaugugacuuuacuaucauuuugucggccuauuucucacuuuuuucacagccuaacauuacaaaagaguaauuauacucauguuuaucauucccguuacaccaguucccucuuagcguuggguuuacuuaacauuuucccuggcuuuggaacauuugccacuucauuguuuuucacuagccuaggguacuagaaaguauaggaguuuaaaaauaaagccaaauucauuucaaguaccaacucggccucuguaaaacuuggauacucucacauauccauggcuaucaucacagauaaaacuaugagaauuugugugaccuuuuaagcuuuggccuucucuuuacaaaagguugaucauaugcauuucacaauguguugggacaauuuugugaauuaaaauacaucaagcaccucuuaguugccacagacugccccuuagccgauguuaguucugagcuuucuguuucuugguuuucauuaaaaacaucccuuggcugauauucuauuucuuuauaguccuuuggguuucuuuugggguuuugucugauccuuccaucuccccucaauagucauuccaaguaguuccaguuuauuuucuuuauuauacagugugauuacuuaccuacucuguugucgucuuguucuguuuuuuguacuuucaccauuuugagcagauuucucauaaggaguggggaggaagggguugaacaaggaguagacaauaaaucaacauucauaauucauacguauauaacaauauuuuucaguuuucaaagagcauuagccuagguuuucucuaucuagugaaauuaguaucuuuccugucuaagccuuccauaaaauuaguaagcaguagauguuggaaaauaauucuuagacuacuuacaauucugccuugcacuuagucaagaucuaaguugugaauuuccuauuauguaguugccugcuuagguuuauuacuuuuuuuucuauuaucuucuuuguacuucugaacuauacucuacucuacauuuuuucuuuuaacaaaauuacaauacuguucuuaagacgugcuccuguuccuuucaguacucuuugaguucuucuuaucugauugcccauucucugucuuuuugcuggcuuuuccuccucuuaccaaauuuugaaagaugaagcuccuggaggcuuggcuuggaauucuuuccucuucucuguuuaucuguucuuacuuaguaaauaaucuauggcuuccaauaccaaugccauccucaugcugauaacauaagccuugacucuucucugagcuccagacucacaucccuaacugacaacuugccuuguccuccuaaauagguagcagacaucuaaaacgugacacguccacaacaggacuggauucucuccaaacucuuugcauucuuuuccauaucagcuaaagggacuguuaccuauaaauaaagugaggaaccuacaauucagucuugauuccuaccuuucuuucacacucugcauagaccuauugccaaguugugauaguuauaucuuuuaacuauuucucacauccuccaacuucucuucauauacauggcuaucaucauagauaaaacuacgauuacuuacuccuggauuaugcaaugcuuuccaccuuaucucauuuucccuguucucaccucccacuccauaaucuguauaaccuucuguucuaucuauguaucuaucuauccauccauccauguaccuauccacuauccacacaguagauagagaucuaucuaccuaucuauccauccaucuaucuauccacuauccacauaguagauagagcuaucuuuuaaaaaucauaucauucaauucccuuaaaagaaauccuccagugggcuugcauucuaauuucuuaccauaguuuauuauaccuuccauaaucuggccucuaccuaccucuccaaacuaauuucuuucuuuuugcccuuuuuuguauucauugaauagugauauguuuaugagaggugaagccagcuggacuuccugggucgaguggggacuuggggaacuuuucugucuagcuagaagauuguaaaugcaccagucagcauucugugucuagcuagaggauuguaaacacaccaaucagcgcucuguaaaaacacaccaaucagcacucugugucuagcuaaaggauuguaaaugcaucaaucagaacucuguaaaaaugcaccaaucagcacucugugucuagcuaaaggcuuguaaaugcaccaaucagcacuccauaaaaugggccaaucagcacucuauaaaauggaccaaucagcucucuguaaaauggacuaaucagcaggaugugugcggggucaaauaacggaauaagagcuagccaccccagccagcagccaccccagccagcagcggcaacuugcucguccccuuccaugcuguggaagauguguucuuucgcucuucacaauaaaucuugcugcugcucacucuuugugucugugcuaccuuuaugagcuguaacacccaccacaagggucugcggcuucauuccugaagucagugagaccaugaacccaccuggaggaacaaacaacucuggaugcaccagcuuuaagagcuguaacacucacugcaaagguuugcggcuucacucccgaagucagugagaccaugaacccuccaggaggaauaaacaacuccagaugugccaccuuuaacagcuguaacacucacugugaaggucuguggcuucacuccugaagucagugagaccacgaacccacaggaaggaagaaacuucggacacaucugaacaucagaaggaacaaacucuggacacgccaucuuuaagaacuguaacaaucacugugaggguccgcagcuucauucucgaagucagcgagaccaaaaacccacuggaaggaaccaauucuggacacauuuacaagucauaggacuucuguauuuuagguuuuuccuauccaagcgugacuuuuucuuaucuuuucugucugagucuaaauugaauacccaccacuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuauuuuuuuguauuuuuaguagagacgggguuucaccguuuuagccgggauggucucgaucuccugaccucaugauccgcccgccucggccucccaaagugcugggauuacaggcgugagccaccgcgcccggcccccaccacuuuuuaccauauaauguugcaugauuucuuuauagcuuuuuucuaaucuauaauguuuuauguauuuaucuauacagugagggcacucuguuuauacccucagugcuuaauauauuauguacccaaaaugaaagacucugugggguguguguguguuugcaauauucacguaugaauaaaaucacagagaugagaugauagucauggaggacuguuacuuuuuuucucucauuauauaauuuuuucaucucauuuauuacucucacaggauacuggguacuuuuuuuuguagcgaucaaagagcaaguuaguaaagguagaggaagaaagauuguucuccucuguucggcuacuauagaaaggcaguagcaugucagguguuaucaguagcaaaacaagaggcccacuugggagcugguaauagaaaggaggaacacaugaugaggaggaggaacuucuaagcugacuacugaaagaagaugcaaaaucauccugaccacaguccacgcagaggaugcugagccguggaaggacaaagguguucagugcucacucuccuugcucuaucaugccuucagcucucucccacuuagagcucuaagggacacacuuuguuuuuguuuuuuuugcugaaaaggaaucauuuauugaauuaaauaauagagguuuuuuguguaaguaguugauguacauuugauuuuaaaaagaaacuguuugcauuaggucaccacaaagcagauuuauauacugauaugguuugguuguaucuccacccaaaucucaucuugaauuguaaucccuauaauucccaagugucuagggagagaccuggugggagguuauuggaucauggggcaguuucccucaugcuguucuggugauagugagugaauucucaugagauaugaugguuuuauaagggggucuuuccccuucgcuacucacucucuuucuucugcugccaugugaaaaguuccaaguuugcuuccccuucgcuucugccaugauuguaaguuucccgaggccuccccagucauguagaacugugagucaauuaaaccucuuuucuuuaugaauuacccagucucugauauuucuucacagcagugugaaaauggacuaauacacauacaaucaucaauugugggaaaacaagaaauuaagcuucuaugugaucccagcagaaguacucuuuccuugaucauaagaaaauuuauuuuuuagaaaguaaagcuaauaaguugacagaauugcaaaacacuaaagcacuuuaagcaaaaacucuuuauuuuuaagaaaaagguacgauuucucaucuucuauucuuggcauacauuuuaauuguuuccgaugaaagccaaaccuccugaacccacuucaguguuauucaaaauuuaaacuucuucuauauuuagauaaaaaaucuguucacaaaugagcugugcaacuggaucacuuuuucuuuuuuacuucaaacuuuccuugccuaaauuaaacaguagaacagcaacauuuccucuauaaucuucaaguaugauacuagccauacauuuauaaucuguuuugcauccaagccagaacaaggaguuacucguuuauaacacccagaagagcuaucugaaugucuguuuucacaagagcuuccuccauugguggcauuuuauaguuguagggacuguccaggucauagccugugguccccacggaccccugggucaggaccauggccuccucccagagcuaagcaaaguggagcuguuugucacucugcuccacaggcuagguggcuugcuggggcaaaugaugggugccucuucagagcagggcauggcagacugagaaggugagcagaggagagagacggaagaacaagaaagugcagaaugagccccuagaacacacuuugcaggcuaacacaggcuaguuaaggcuccuuuccccgcucaauuuuuuucucaugcuguaauauaauuaaauuuucauaacaccugaaccuaauauuggcaaucuguuauguugaccagugcgauaauuaucugcugccucaugucaagcucacacaaaguugcauaauuuauguuugcaucuacuaaugauaaaaaugguaggaacaagucauagugaugcaguguacuagagagucaaauauuuagaaaaauagagcuugacaucuguagaaaacaaauaacaaaauaugccuuagaauaguacauaaaguguguaccgggagaacucucuuaucuuauacuuuauucugaccauacccaagaggaauugacaacgucucuucauugcuuugaaauacaaaauuuccacaaagaaagcaaaagugaaaucaaagaaaggagucuggaauuuuucuaaauauguauguugggaaaggaaaacaggaaaccauaacaacauagagcaaaaugauaaaacaggagaaaagcucuaaacaaaccuaaaagggacuacaggaaucagcuugucuaaacguguuaacuuguuauucaguaugggagaaaauggaaguccguggaguggggugggugggaggucuaggcuucucccucuggggcacucaacuuccagagugcaacagaggagcuccuucaggucaggguggucaaccugcaugcuauugacauuuggugacaaauaaaccuuuguuuggugggaggugcagguggguagguauuguccugugcuuugcaggauauucaguaggauuuuuggccucuauucauugugugccaguagcauccuaccccccacucuccagcugugacaaccaacaaugucuccagguauugccaaauauccccugggggucaaaaucacuccuagcugagaaccaccgauuuugaggauucuucacugaauauuucuucuccuuacuugccugcauuauuugucaugguuuuauuaagagaacaaaaggaaauuagaaaugguaggaauugcuguauuuuguugcuuaacaguuaauaugcaaauguuugagaagaggaaugaaagaaaucaaacacuuaauacaaguuuuagaugagcuauaauucugacuugucuaaugucauaucaucuuacugauuuaaucuuuucuauucuaaaucauucaaacguggcaaauggagacauuauagcacucaauuagaauuauugaauuuuaacguuuuuuacuucaucaaagauuagaggauuuuuuaaaaagcaugcauguacuccugcacacacccacgcacucacacaauaccgaucagccacacaacauugcugagaaugcacgcauguacaggaauacagcucacauucucuauuuuucaauauugaugccuauuggcuauucuauguaauaaacuuauuguguauuacaaaacugcuaugggcaguaaaacaauacauauagaacacccucuuuuucuuucaguuuccuaauggaaauaauuccuauagagacuaucaaggguuuauuucccucaucaagcuuuuuuaugaacaaaccauuugcuauguaugccgaugacacugauuauccugcaugaaauaggauacaguagauuuuggagagaaaaagauuagaaacguaccugccaauagaucuacaugugauccagauuucacauuucccuauagaauauugcauuauaaagaauacgugguaaaaguggagaauguguuagcucuauucugucaaccauagcugaacaaagugugcuggaaguguaguauguguaugcuguauggucuuacgugaacccaagauaaaggugcuggggucaggauggaaguauggugggggugaaauuuacuucuccguguccacacguaaugucucguauaaaguuacucuaaaguuuauguuuuucuguuugguuuucuaaacaguaaucuuauugcuuggaguuuucaaauaaaauacuucagagacaacaugauuugaucaucaauagaugccauuucacuuaacaaagcaagucagacuagacucccacaauaaagggacagucucuguuuuaaucguguagaacugacuagagaucugagaucucaaguagaagguacaaaaaaaauuuauucucuuguuuuucccuggaguuaaucgugucaaaugcauucccaagccugaagaaaagaauaaaacuaaauuaguuuuaaucaugcacauuuauauuuuguauucugugugaaaaaaauaaauacaaagggaauaugacuaauuucaaggcuuuacuucacgucaugcuccugagaauacauuuucuggcaaauguauacacgcuuucauuuuacuccugaaauaguuuacccaguacaucucuaggcuuuaauaucuuuaaaaaaaaucucuuauuauaaaaguaucaaauuaaaauuuaauuccugaucaauuucacacacauuagccucccacagugaagcaauuauuuccuuugagauauuugcuacucuucuuuuauaaugaauuugguuuauauaaacugaugaagauaacagaauuguaaaguuauaguuuauaacaucuugguaucaguacauuaaaaaaaucaaucaacuggauaucuagaaacaugccauaaguaagacauugugcuaaacucagagguggacagacaaaggaaaagugggauuguuguucuuaaaaaaauuuagaagaugaagcauuuuugaacagaguaucaaauaucuuaacaauauaauaaaucaugucaaacaaauguaaacaauaauuuaaaauuuguaaaggauuugagaucgccauggaauuaguauucaggcuuuuuguagaggacaugugagaccaucuuuaaaacuuggggguucaugaaagauuguugaaugggaacaugacucaauggaagcagucauuuugaaauuguaaucaggaggaaauguguggaauggacuuguuuagagaggcaggaggcagagagaagagcaaggaaacugcaacagucuaggugugaaucaaaccaaaaaagcaaagaugaaaguauugauuaccuauuuccugacacaugaguggcguuaggaguacagauaugagggagacauaauaguagaggaguaugugauuuaauauguaacaaaaaauaauuguuauucaagauacaaggcacuauacuagaggaugguagauuguuuccugggguuuggggaaggaaaguauacuaaaauugggcaauaaaugauaaauggcaguuugcuaggauggaauauagagaaggaaauccuugucagggaguggaaaguagucaauaugacgcaaaguaggagaaaugaggccaaaugcuccaguggagcauaguuugugcauguucuuguguggcaugcuaagaaaucaggacuuauucuuuuuuuguuuaauuauacuuuaaguuuuaggguacaugugcacaacaugcagguuaguuacauauguauacaugugccauguuggugugcugcacccauuaggaggagcuggugccauuccuucugaaacuauucgaaucaauagaaaaagagggaauccucccuaacucauuuuaugaggccagcaucauccugauaccaaagccuggcagagacacaacaaaaaaagagaauuuuagaccaauaucccugaugaacuuugaugcaaaaauccucaauaaaauacuggcaaacugaauccagcagcacaucaagaagcuuauccaccaugaucaagugggcuucaucccugggaugcaaggcugguucaauauaagaaaaucaauaaacauaauccagcauauaaacagaaccaaugacaaaaaccacaugauuaucucaauagaugcagaaaaggccuuugacaaaauucaacaacacuucaugcuaaaaacucucaauaaauuagguauugaugggacauaucucaaaauaauaagagcugucuaugacaaacccacagccaauaacauacugaaugggcaaaaacuggaagcguucccuuugaaaacuggcacaagacagggauacccucucucaccacuccuauucaacacaguguuggaaguucuggccagggcaaucaggcaggagaaggaaauaaaggguauucaauuaggaaaagaggaagucaaauugucacuguucgcagaugacaugauuguguaucuagaaaaccccaucaucucagcccaaaaucuccuuaagcugauaggcaacuucagcaaagucucaggacuuauucuuuaguaaugggaaacuauugaauuaucuuccuuguauuguagaaauagaaacuuggauaauaugggagacagaauuagaaacauaagggagauuacuuaaaaugcuccugugagaaccccaauggacaugauaaggacaucauugaugucagguucugccuucaacaaauauuucagaugugucauauuccacaguaccugauccugugugaucauguaacaccaaaguguuucaugaauaugagagguaguggccaagguuagugacuuuagacucaaaugcucugggcaauuuuuaaagcucuucuauucacuagcugaaaggggcccuggugaguuacucaugucuauuccuguguuuuuuuuuaaucuaugaaaugcagaugauaauguccuucaucuuguggaguuguuccaagcauuaaauggcuuaaaaccguuguguacauuauguuuguuucaacagugacugaaacagagaaagaacucaauccaugauagccaguaggcaaucuggcuccagaguccaugcucauaacgccuauacccuaacaaauaggucagcaauugaagauaaacauucuuuuaggcaauaagaugcccuugauuaguuuuucaagguaugaauuuuugaauuaggguaaagagauaauggaugaaugaggcacuuuaaaagaaggguggugauuguuaaaucuucgcaugugucaggaaaagauaaaaggcaaaauuugauuuuucucaaaguuuugaacucgugucaccagaagaaugacuuuaccauuuguauaaaugagauagaaagguuucucaauaaugcaggaccuaacuuacgagguuauuggagccauagcaagauaauuaaugcaaaggcuuuagcacagugacagguauaguguaagcauucaauaguuauuaucuauuaucacaguugucaucauaaucuuagcaguagauaagaggcauaucuggauggccccggagucucauucucgccagccuuuauagcaguacagcaaggagcuagcucagcagaucugagggagcacaaaagagaaguugccugauaacuaccaaugagcuccagaggcucuccuuuccuaacaggacaacuuuucuggccccugcccauaaaauuauguacagcauuacagaugcaggucucucgauccuaggaucuuggccaugggguuagcugacaagcugugcucaaccaaagcuaagaucuuaggggacuaugugaacuuuacuaguuuucugcuuguaguuuuccccaauccacuauauguuagauuugcauuccaagaagcaauaggaauuugaugacaaagaauacagggguggcugagauuuggcacaggugugcacaaggauugauagcagcaguugagauugggagguaguuaaaauucaugcccaaaaggguaagcaauauucauaggcaagaggaaguuaugaccuaaaauaaucaagucaaccaugucaggguuaaaaauaaaauagcagaggauuggaaugagggaaggagagaauccugggaaauuggaggugagcaguacuccaauauccaggcagggaacaggcagcagguuguacgucuagggguagcaagaucucggccucuggacagagguucagcaauagagauucaaucucggaaagacacucagaaagccuggaagugcuagaagaaagacuagaagugauuguagagagaacagacaucuaggcaggucaucaguaucuuucagaaaacaucagagucuaccaagcgcuacaguaagaaucuaggcacaacuguaauuauaaaauugaaucguagagaaugaaugaaaggaaaaaagcacugacuggagagaagaaagaggacucagaaauagcacagaauuucaguucccagaaguagggucugagcucagguuagaaaagccucaagggaaauauaucagaauaaaauaagucagaaaauguagucaugauugcagauggggccauauccauaauuauuuccugauaccauguuuaccaaagguaauuacuuucuaugcauguugaaugacucucccaaaauuuucuugugaaaaaccuugaugaagaaaggaaagagacuaagaaauauauguggcuaaacaugauacugaguuuccaaaggagucauucuuucagcugaucccaagucacuuucagaggcucacagaaucugcagaaucccucccccaagaaggcugauuuccacaucuaguuacaaccaagcaacagauaaccuaaugagccuacauucuucccaaauuacuuaaaaauuaaaaggugagggagguagaugcugggcaaugauacuaucucacagucugaauuuccuggucaaguuaauuaucccugguaauucucaacaugagguuaauggggggagugggaagugguguggggaagguuccaaaccaaugacugcuuuguguuuuuucugauuaugaagguacaucaucccugauuguuucaugccaacacuauuuauuuuguuaacuauuugaaacaaaauuagacacgcaauugcaaaaacaucuaaaguugacuuagauauaucucuacuauguaaauccauauugcuuaaauuuaccaauuacucauuuauccacuacaaaaguuucaaccuuacaugaagugucagcccuuacacuuaaaugaaagguaaaggaccacauuguauauguacuucaggacaucauucuguacauguuaaguagauacaauauuaucuguuaacugagaaauauacuggcuuuucagcaaaguuaauuugcuucuauguccucccuguucuugucuuagaaacaucuucaacuacaugcauauauuauuuuuggaguuccugggcuauguucuuugcuauucuuucauaauucauuuuuauucucuuaguaucaacuagugauaucugauuuuuuuuucucuucgauuuauuuguacaguaaacugaagcuuuugaaacacagucugguucucauuggcaccuuuugccuccauuuuauccaacaaaguuacuaaaacuuuauugccuuuuuggaauuuuaaaaaauuauuauacacacauacacacaacauguuuuauucaucuucccugaaaaaggcauagaacauuuuaaaaggcucaaaaauauuguagaaacuagaauggaaaugguguccuggagugugauuauaaauuaaaaugucccuuuugcuuucuaaagaauaagucaauaucuaacaucauaaaacucucccccgguccuuuuuuuccuuucauucugcacuauaaugcuucuauugaugaaaaaugugcaccagcauucacugcaguauaauuaaagguagauuuccacucaguucgcaugauagugguacagccacacuaggaauugauauauaauaaaaagucaguugggugaagcuacccaggagcaacauaccauugacucaaaugccuuuuacuugguaccauguggcucucacagcaagucuauuugugaauuucagggaauaaaaucagcaaaauauguuuuagauauguccaaggguaucuuauuucuaugugucuauuuagaucuaguacucagaucuuuaucuaucucacuuuugggauccaccaaacaauagaaucuauuccuuuccagcucaguucuaggcuccuaauuaaagugaguacagugcucuaugaaucagaauuucuuaggcuccauuuucgcccuaagaauacagagccauguuuuaucuuuuguaucuuaagaugauggauuugccuuuaccggaaauuuuuagauaucuacaagcccaucaaaagguacaaaaaucuaaaaauuacuuuuuagccacuuauuuuguaaaaguaugguguauguagauuauuugggaauaaagugaugauuuauuuauuuauucaaucuauuccuuuauugagaaaaaggaauauguuguuaccugauagcuagcaauaguuuuaagggacaauacuuuuuaucuaucuaccuaucuaucuaucuaucuaucuaucuaucuaucuaucuaucuacguaucuaucuauuuuccaaucauuuaucuacuuaucuauccaauuauuuacccagguugaaaaauaguuuuaaaauuacauagauggugcggaauuuguucaaaaugaguuaugaauauuuucaaauaauuaaacauuauagacacaaccuccaaauuucugcaccugauuauaaaaugcuccauuuguauguaaaugcaauugaaauucuguugaagcuuauuauuuaaggugaaacuuuuaagaaauuggcuguacauguuucuaaguaaggaaauuagaauuuuuaaauugauaugcuauuuaauuuccauuuguaacauuguuaagcaucauacuuuucagaaauaucauuuuauccucaauuguuuuguagcauauuguuuuugacuucugagaacaauugauguuuauuggagaaaauauagauauuagagaaaauauauuaaaaaguuaauauaauggacugauaacccaccaauuagagaugaucaacauuaguauuauauuauuucauucugauuuggaaugaaauaaaauuccuauauuuauaauaaugacauuagauucauagucuacuuaaguuuuuauuaaaaauuuuauucuuagcauuuuuuaccauguuauuaaauuuuauauaagaaaugugauuuauaaugacauaauaguauuccacauaaaaauacacucuuuaaaaucacauguccauuuucaguaguuuguuuucaauuacuuugguuauuguauauauguugugauaaauaacucugggugcuucuuuauuuucuuagaaucagaaaaacuuaaauuuaauggaucaaagggaaguaacaucuuuuaaggcuucuaauaaauaugguuuaaacuugaauuagagaacauaucuuguuaaauaagucuccaauuauuuugcuguaaaacauaauaaaacaaaucucuuaaaguauuuguaguaaugcugaaacauuuaguuuuugaguuacaagaauuuaagacauuuugaaauaauaucaguauagaacugaaaaaaaauuuucaguaaacaacuaaaacaucaaaaauuguauuucaaaugagaccuuuuuucucauaugaugaaaaggaugucucauggggcaaguuaucacugaacuuuggaaaacgguauaaauuaauuuuuuaaagaaauauuaauaugcuggcuacauuuccaaguguucauaaaaucaagaacagagauauuuuaauugcuuagaauagacacugccuggaguguucccaaacacauuugcccagauugaacugagaacuauuucccagcaugcucccagccacacacugaaccaagaaaacucccacuccucccuugagacacccaauggaacacaaugauuuacaaaggaaauuuuacuaagaagcaaaguaaauaaaacaaguccacagaagauuuccuuuggagaugaaaauacaaaugagaaaaucuuuucugauuacauauuucugagacaguguggacacugaacagccauucgaaaauugaagcaauaccuacauuaacaaaacaaggauguuccaauacuugaguauaagaaaacagcugauuuaggacaggacauauucugaaugacuuuuuggaaaggcuuuguuuauacauggagagaaguuaauuuuuuuccaauaacugagagagaauauuaagauaaaucacuuucuccccacuauaauaaaugcugaaucacauuguauuaccuuguuaauauuggcagacgacaacugaguauuguucuaaauauguuuguauuuaguggcauaaaauugaggcauuuugaaauaaaaacuuacuucaaaagguagguuuuuuuuuuugcuauaauucaaauaguaauguacauuaaugcuuuuuuacuaccauuauaauauuauaauacuguucccauaagacaaauuuaguuuuccaauauagagugauggaguuaauacuuccaggcaacuaaaacuuuuaaaaauuccaacacuucaaauaagaaaaagaaugcaggucaggucgguguuuuccaaacuguauuuaggacaugaaauuauuauaguggguuauggcuuuuuuuuuuuuuaagaauaaagcaaaagaaaagaaaauaucacacuuaucauagugcaucuaaaauagcaaggcaaguuuuauuucaucaaacuuugugucaguagguuuuggguaugacauaaaauauuuucuuacuguacuuugaucaaaauuauuugaaaaacaugguucuagguccaccuuccccagaguuuugaauuuuaaaguuaaaaugaaaauuaugcccagaaugaacagcuauuauucauuagacccuuuuugcaccuguuuaauauuaucauuuaugccuaguuaaaaguaaugccuaaauauguauucauaaaucaguaacuucuguccuaaaaaaugauguacugggauaaaauugagucacuuugaaauaaaaacuuauuucaaaaaguaaguaggguuuuuuguuguuguuguuuguuuguuuguuuuuggcuauccaucagaaaacguugauguugcaacuuguucaauauuuucaugguaagauaauccacucuguaaauucaaggcuacugaguuugacugaauuucauaagucaagucuacuguugauuacuaaugagacucuugaagacaguaaucacaacuuggaaagaaagauacaaagauagggugaacaauauauuaaacauuauuuuacuuguaagauguauuuaauauuuuaaauuaauucccaaagaacaguguugaccaagauggaaaaaaagguuuuugaucuaauuggguuacauucauccuggaccauggaauuuauuaaauaaaaacuaaguuaccaguauauauuaacaguaucugagagucucuauauuaccuucucagugcacuacuuuguguguguacaccaaaauuuuaucacugguuauuuuucuuuucuagauuuucugcauuuucuaaauucuuucaaucaaaauauuugacaaaaggagaaguggacugacauucuucaaugcucaugcugauaagaguagaauagcugugauacagauauauuucccuuuguuaaagcaaacauuagaauccugacuuaacuguuuucucaguguugccacuuuacuaacuuauuuacacauuuaauugaauuugauaaaauacauuaaaagacagaggaaauuauguccuaugguuuccauauguacuuuuagauugaaugaaugaauauaaaauauaacuuuuuuaaaugguugaauuuuuuuuucaacuaauguuucucaaauaugagcacuuaguuuccacuauguauguauguguguauguaugucuguauauauauauauuuauauaaaaugcuugaagcaguaagguauuuucacuggauuauagaaggguaauacuacggaaaucuuuagauuuuauaucuuuucaauuaauuugcacagauucuuggcuaaauugacaaaaacucuucaguccauuuuuauuagguuuaagcaaaucuauuaaggugaauuaacugucauguauuggauuucuuuguucauucuaucuuuaauuuucaaaauaaacacagcuuaaauuaggugagaguaucuuggaguacuaaauuacaccaaaucaaauuaauacauguuuauugaccacuaggguuaauaucuuauccuuucaaauauauuggcuccuguuacauggaaacccaccagcaaaucggauuugcucagagacugcaaggagacaggccuucauacuaauauuuuuauguuuagucauuaggcaauaaucauuaaucauaacaauauaaugugggaguuuuucaacuguggcaaacauuugcuuuuguuuuuguuuuaucuguuuuucuggucucuccagauauuuucgauuugcuguaaaccucccuagguauacuuauaaacgaauguagugauaaaauaugguugauuaaucauuuugacuagacauucaaggaaaaagcaaaacuaauaaagcagaaauggagaaagugaauaacuagguauuucccaauaccuuugauuucaauaauuuaggcacaucucugacauaacauuucuuguggcuuccuugaauccuuuucaguaauagaccauacauucaggccacacacaaacauaaagccuauuuuacaagaaaauauauauguucuauagcaggggauauucuguuaguugaaaggggucagaguauugaauucaacaaauauuggagagcaccucuuacagguacuauucuauaugccagagacagaagaaaaaggagcauggucccugcugucaaggagcauggagccuagaggggaaaagagagggacaaaaaucauaguguguuagaaaccgugucagguauaugcauagggugccaugagaguauauggcauauucagaaaucagaguccauggucacccaauugagcucucugucaugacuccuuucaguaucugcuacaucuguacuaaguguucaguaaauguuaguuuucuuuguaucucccauuucuaaguaguucuucacaauauauauguaugacuauugcaaagacuaucucaagaaaaauagaugaaaacaguuacuauuuaucaguccaauauugagacuaauuuuucuuugcuuauaacaucacaauuuacaaugucaccuuucuuuguacuguauuuaucaaagaacuuccaagguugcgaagucuauucaaauaacaagaauauuaccuaagccucuauuugucauaucacuacaaagccaaauuuaaaauuauccuauuuuugccuaagccagucuuccgucaguugauacacaaaucuugucauuccaccuuuauauucacuuucguuuucuuuuccaaccauuugcauaauuuuagcaagaucauuuugaaguucugauuccagcaguggaauauuccuuaaaguuaaaauuaguauaaucuuguuacuaauaguaaaagguacacgaauguugauaaagagaaaagauaccagauacaauuguguuuuuaaaauaaacauuccuuguuuuuaaacauaaauuauucacuuaaaagaagagcaauuuaucuauuaaaaauaaacuagcauugguaaggaauagauuuugcuuuuccaaucucaaccaauuuucuccuucacccaugccuugcucucucaacaacuuuccaaguuuucuuuauucaaucagcacacacuacaaccaaguaagcgucuugaagaucugaauuaaaaccuaauccugagcguguaacaccagcaaaaccaaacaaagcacaacauuaacucuggaaauugcaauaaguuucaggaacaaaugucaaauagguuucacugaccugaggaaauaucgauuuggcucaucuuggucugugugauguugaugugaacacccacuuugcuuucagugaggucaaucuccacauugcccaaauuauccgcaaagugacugaagaccaggagaccauugggguuccauguccuaaacuggaaacugacugagaacagguccugguuaagccguccgggcaccuccagguaacuuguagcguugaaaaagacaggcaccguauaggguuccacacaagaaaagcucaaauuucccuguaaaauagaaagacaggcucugaggaaaacacagaauaaaaugaacauccaugucagaccacugaugaaaguauaguucuacaaguuuugaagcacagccugagccuaagcuaaacucacacacagcagcagagcauggauucagugacuggaugcaccacuacggaucuacuuggaguguaagaccuacuacugagcagcaguuggcugucuaacuauaacaagcagcuuccaccaugggauugacagccagacagccugaugugauaggcugaccaugaguuguaaaguguguauguguguugugggugugacuguggaucacuagacuuucugaagacagcaaagcuacugcuggccgaacauaagucagggagagagaugcucuguccuauucuggguggucaaugccaacauuaauuaacauauuacucuggucucaguggggacuauggucauauguuugcaauuuaugaaacugauauuuuagggaaauauauuuggauuuuuaucuauauaccuuguauaugcauauauagauagauagauauuaaguuuucagcauuaauguaauugugguuguuggagauuauuuuaguauccaacucaaaaucccauuuaaauucccaugaauugugcuuauaucacaaugcauuaauuccuguauaacuagcacuauaaaugggcuaaauggagauaaaauuugcaauaauucaggcuuuccccuccccuucuauacuccuccuccuugguauaagcaaaagaaaaaaaagaaaaaaauauuuaucauucagauacacuaaauuguauauuucagugccuaacuacauucucuuuacaggucuaaaaaucuguauuugcuucuaacuucuuuuauccuaucauaauauuuuaaggaauguaauuggaugauauuuucauugguucuaucucuaugucugucucucuuuuucucuauauauuuuuaacaacaccauauauauguauaugguauauguauaugguauacauguguaugguauauguauauguauaugguauacauguguaugguauauguauauguauaugguacauauauauguauaugguacauguauauguauaugguauauauauguauaugguauauauauguguguguauauauacacauauauacauauauauacacacauauauauacacauauauauauguguauauauauauauaccugaugcugauuucuuccauuuuagcacaauaaccauuaaaucuaaggcaggcagucucucugaauuaauauucaaauuaaauuugcucuguaccaucacagaugauuauuuuuaaaugcucgcuuuuacugauaaaaagaacugccuaugcauaauaauugagauuuuauaacugaccacauaccucuuuugaggggauugucucccuagcaaaauuaaagauccuuccagaguaacggugcugacuuuggagucaaugcauaaugagggaaugaguaugugggggaagaggagguagaaugagugcucagucaauuucacugaaauaccagcacccaacaucuuugaaaguacauuucuuauauaaacacuugucuuugcaggguugcuugcaaaauguccuauuugucucuaucccaucuaagauuuucuguauguauguauauuuugauucaaaaguuuauucuauguuuucucacugcaauuauuuguuaaaauaaaauguaauuauagagcauaaucaaacucacauauugugaauccauaaucuuuuuuuauucuuuuauuuuuggggggacagagucucagucuguugcccaggcuggaaugcaguaguucaaucauggcucacugcagccucaaacuugugggcucaagugauccuccuaccucagccucucaagcagcuaggacuacaugcaugcaccauuaugcccagcuaauuuuuuaauucaauuugauuuauuuuuuuaauuuuaauuuucuuaacuuguuguagagacauggucucacuauguugcccaggcuggucucaaacuccuggacucaagugauccuccugccuuggccucccacaguguugggauuacagcagcaacccacuauaccaggcuauacaucuaucuuuuuaucuccuacucauaaaauaaaaguuauuuuucucauaaaauaacuuauuuuuuccauguuaaaucgcaauguuuucaucuacaaaauguuuguauccuucuugcaguauuguucucagaucauccuaaauauaaaauacgacuugccuagcacaauaccuguugccuauaaauggagcuauuauuauuuuuccauagucaauauacuuuaugagaaaauuuaaccaaaguucaaguuuuaauuucuaguauaaauuuaugauuacuuuaagaaaauuauuuauuaaauaaucauuugcaugaaguuauuguuuuaaaccuuccauauucaaccugaacuguuuauucauucagggauuuccauuugucaaaucauuuuaugaaacccugggcucaaauuugaggcaacgagaccaucagagcucuuuuggagcacagugcaaacacucaugacauuauuguacuuauagugcauaauaucuucuuauuguaugggucucuggaauucuaagcucucccaaauagccucucugggcuaaagcagcuccuggucuugcagagccauagggaacucucauacuaaaauugcaaacuaagugucuuuuagggauguggaguagugucguuuggaagcaugugugcuggggcuuucuuugacuuuugcucuccuuccaaaaucuaaugaaaccuggcaccaacucacacaaaaggcagaaaaaaaucacugugaacuucuguggcacagcuuuggcuaugcaguggaaaucaagcuuuauuuaacuguguaauauuuagucugguuagagauuugcuaaaaaguguauuuauuuacauauucaaacaaaucaucuuuggaagcacaggaguaaauauaauaaagucccugauuuaaaaacuuuaaaaauauuaaauuaaaccauaagcaaguaacuuagagcacaugugaugagauauuugaaaacacgaugcugccgguuuaagggcugcuaacugcugggaugaagcacgugccacgagucauccagaaauauugagucuaacauucugugcuccgugggaauaaaaccaaccaccuacuucaagcuagucccauuagcuauucucaaagaauagcaaguaucuauacuaauucugauaacucuaauguuuguuuuacaucauuuugcccaaacacaaauaugaugaaaaaugucaugauuuuguuguuguucaauaauccaaaaaacaaaaauguuacuugauauuuuauagaccaauauuuugcgggugaaaauccuuaccacauuugagggcucuaauuucuuccuucuggcaagaucaguaauguugacgccauuguaguugaugcuuuccaugcagccuuugaaauucuuucuacugcuggagcugggcuugccagagaaagggaugccuccaaagguuaucuuugagaaaaagaaauuaaauguaaacguccacauuguauuaugaugaacuagacaaaacuaugaauacagugaaggucaaguaucuauaccucaaccaaaauauacaaauauuauagcauucugccuccaaaaucuauggcauauuaaauuauguuguuguugaagugucuaauggagucauucauucugauaauuagauuauaacuugaacaaaaaaaagcaaugauccuuugcaauuuuacugccccaaaggcauuuuauaaauuuucuugagaauauuuuaaaagauuuuuauucagcaaacuucuuguaucaaauaauauuagaaauauauuuuuauguuuaucauucaaagacauacuaucaauaaaugccuccaguaagcaugagauaaucagcacuaauuuaauaagcugauaaaacugcagcccaaagcaagggauaucguauuuacccuaugcagacuuguagucuaaugaccauuauugucaaaaauucauuagauuuauuuuggauguagaaaauaguucaaaaaauaucauuacaauauugauuagggaccacuuaggauuugggaacucaaaguugagcuguguaggcuuaaagauauuauaggucuuuuaaaucuuaagaaauaagacaaugcuacuuacuguguuucucuggcugcuaucgcuuauagaaagaaaauauccauuucuuauacauuuuugaucaauauacacuauagcauuaaauuuauaugauacaaaauugcauuuaguauuugcauggucaaggaugauauuuacuaugaauagugaauuaguaguaaaugaagccaaccgcuaauuauaauaucaagauauacaauacuuguaauauauaucuuuuaaauuaucauacaauauuaccauuaucuauuuuuuuuacuaucagcuucauuaaaaugucagaaaaugcucugugguccaaccacuuuauuuucaaugagaauauauaacuauaaagaaucaaugacagccuaauauccuaucauuaguuacauuagggauugggguuagaacucacuaaaugguuaggaaucuguuaacuugagccuguggugcuuuuccagagcauguuugauggggugaaaugaaagcaacagugaagacauuuuuaaaaaucacgacuucauauuugaagcauaagucaaauauucuguguucuggaagguccaugaacaaauuauguucuaugauuuaguguuauggcaucuuaaaugcuuaaguacuuuuagggggggaaacacaaauugugguuuaugaggugaugguaaaaaaaaaaacaaaggccucauuuacaauaaaaucaauuauuauuaauaaugguuagcugaauauguauuauuugccacacaguucauauauaagaagguaaaaggaaaauugaggaaaaauauaucccaaagaaucagaaaacuacaaagaagaaauaguaaucuaaaguagaauuauugggaaaauguuuucaaguugcacugaaaugaacauauuagguacuaccuaagugugccuaguaccaaaggcaaucauuuuugauacuaaaauggaguacuacgucuccuguuuacaaucuuuuugaacaauuuuuccccaacugacaguaauaauaccgucaauguuuaauauuauuaaauacauauuccucugugugcauauuucuuuaauucggaccuuucacuuucugcaggggauucaaauuauccuuacaguuucccuguuuucagcaacucuaggcacaaguccaccucaucaaggugcucuggaaaagcaaugcaggcucaaguuaacagauccgaacaauuuagugaauucugaccccaauuccuaagguaacuaauuauaggauauuagguugucauuuauucuuucuaguuauaaauucucauuggugggccaggcaugguggcucacaccuguaaucccagcacuuugggaggccaaggcggguggaucaccugagaucaggaguucgagaccagccugaucaacauggagaaaccccaucucuacuaaaaauacaaaauuagcugggcgugguggugcaugccuguaaucccagcuauuugggaggcugaaacaggagaauaacuugaacccaggaggcggagauugcggugagcugagaucuugccauugcacuccagccugggcauacagagaaagaguccgucucaaauauuaauaauaauaaaauaaaauucucauugguaaaauaaacugguuggaccacagaauauuuucugacacuuuaacgaagcugauaguaacaaauauuguugcaguuguccgauuaauauucaauuauuccuguggcucauaugauacauuuauuaaugaccuugccauccaauaaccuugccucuaaagaaauaacugcaguaacgauuuuguuagcuuucaaguguacacaaaaugucgcagggacuauuggauaccucuacauauccuuucuuccuacccucauuagggaaaaaaaauaaugcuuuucagcugggcacauugcuccccagucaauauaauaaauuaucaacuucuuugaagccaguuuuggucucaugauauuuaaguggaagggcuguaugcgauucuaagaacugucauuaagagggggaggacacagucuuguuuacucucucuuccuucuugcuagcugaagugcaaagugaaauguuagcagccgucuuugagugauuugcaacagggauagaggaagagcaagauuaaaaaggacugugaucuugaagaucguggagcagccauuugccuccagucuucuuuuacauaaaggagaauaaacgugcauccauuaaauguagccuauguaaucuuaacucacacacauuuuuuucuauuacuuccuguugccuccucauaaacccuauggaaagaaugcgauuagauucauuucaucaaaggggaauaugaauuguccacugucacacaaccauuaaagggcagaaacagguucaaacucgggcuucuccuccugugacugauuuucuuccuaggcagucugugguucugcaauggucaagagagucauuccucuacuucccuagcagagcuguauugcaaaagacaacagcauaauauccacaguggguguccucugaagaacagagagaaucuaagccaaacaccauuuugcugcucuccccuuugguuuuuauugacuacgcugaggaaaaaugaagugaagugcacguauauaucaccacacagucucaagccacccuguagcuagcagccucauugcagguggugauuggcccacuuugcaguguaggcagcuacaagaggaggggaugagacaaacucuuaggacuaggucacaaaaaauguccauauaugccgggagcggugacuuaugucuguaaucccagcauuuugggaggcugaggcgggcagaucacgaggccaagagaucgagaccauccuggucgacauggugaaaccccaucuauacuaaaaauacaaaaauuagggcugggugggguggcuuacaccuguaaucccagcacuuugggaggccgagguggguggaucaugaggucaggagaucgagaccauccuggcuaacacagugaaaccccaucucuacuaaaaauacaaaaaaauagccgggcauaguggcaggugccuguagucccagcuacucaggaggcugagccaggagaaucacuugaacccgggaggcggagguugcagugagccaaaaucgcgccacugcacuccagccuagugauagagcaagacuucaucucaaaaaaaaaaaaaaaaaaaaaaaggaaaaaaaggaaauguccacauagaguuacaucaaaggagugaacuuguauuccaucacuucuuucaugauguucaucuccagaaauugugguaaguauauuuaauuuacgcuagcagugcugugcugaaucccacucauacugguucacaagaaccgacugcuaagcagagcuauuauuaaaacuuccacuacauaagcuauaaauuaaguaaauuacaugaaacacaaaauucauaccuauucagaauuuaucucuacacuuuacuuucguauauguucuugaggucauuuauauuuauugcaacuauaugauggaaauaccgucauauagugcuauuaggcaccucuuugcaacucccugcucaguuccauauaugguagcaugaaaucaaccauggugggaaauucgcaccaugaaaauuaacaaaugcuauauaucagggcauuccugaccauuccucccuggagagagcugguuguuaagcauuuaccagcauaccuccaccuuugggccucaaugccuuuguccuuaguguacucuggaagaauugauugaggcaguauaaucuuggggaagcaggacauugcaucuucagguuuugugaagauaacaagacgagcuuucucuuccuuuaggccaaagccuuuaaauaguucaggaaugaauguuguauaauuuguauuauuuuagguuugaagcuaauuuucaugcagucugugagguuugaguauaguuaguguguggauauaucaaggagauaaguacaacaaaacuagagacugacucuaauacaguccgugagguguuuguuuguuuuuuguuuuguuuuugagauggaauuucacucuuuuugcccaagcuggagugcaauggcaugauuuuggcucacugaaaccucugccuccugaguucaagugauucuccugccucagccucccaaguagcugggauuacagaugccugccaccaugccuggcuaauuuuuguauuuuuaguggagacggggguuucaccacauuggccaggcuggucuuaaacuccugagcacaggugaaccacccgccuuggccucccaaagugcuaggauuacaggcgugagccaccaugccuggcccagucccugagguuuuuucuaaacaaauaagcaaagggagucccuuuccauuaagagaaaaguguagcaauauaaagguaagcacagccacuuuuauuacauuucaugccaauaauugcagucucuaagaggaccauaaucuggcaguagccagaaaugguaagucuacccugauucuuugucaguuaauuuaaauuucuuccuacuguuucugucuaauaaauaaguuccagguauuuuagucuauaccugcaguucucaaacacgacauuguauauagaugggcuucaaaguguccaugaaacugcugauccgauauagcaaguguugugugugcgugaauagucauagacuucgucacacacucaacaggguuuaugaccccaaauuuuuaauuugguuuuuugaaaauuagaauuauauuucuucauucuuaauguuccagaauuuucaccucuucuaugguacuucaaaguuuauuaacagaggaugaauaauucaucuuuaagaucucucauacauugggagauaagucacaugagccaagacacauacuaauuuagagaagauagaaauuucugggauguucacauacauuuucuuuuaacaaucaguuugcuuuuaagaguuuuuuuuagggggagggauaaaauacuuuccaauaaucuuaaauucauuuaauguuaauaaagucuccaucaguguuuauauagcauauucuacucuaaauuuuuuauuuaagaauauauaucguauauucauauugcaaaaaacuagaaacuauuuaaacauaaagauaauagaaaacacagcuauuaauccuguuuuuuccauuuauuuuaugaugagcauauuccauauucuuauaaaauuauacauaaauauacauaacacacacauauauauaugaauacaucuccaauuucagaacugggugccaaggaacaugaagguggugcagaaaacuaauaggggugccauagcauguuugaaauuuuuaaagaaaacacaacaauauuugacaccuuuuggacauugugugaaacucuagcuuaagguaguuuacuguuccaguauuagauaaugugucauuccuuuuaaugaugugcugucuuugugaauuuuggauuuggucauuacucucauuacucugauuaagacagaguaucauguagaguaaaaguggaacagaaaauuagaaugccauuggcaaaucugauccccauuucugccagucguacagugcaauagcacucaucccauuaguaauaauugcuguuguuuaagaaugaaauaaaaaucuacuuucacuuuuauuuuguguuuauuucucuaaauggcuaccaaagucuuaggacguaaauuuuuagguuguuuggaccuaacggcucaggacugcuguggaaaaaguucgaagacacuaagggcuccaugaacuaagaaaguucggaaacuucuggcuaaguaauagcauugugucccuuuuaucuuaccguucugcugcuuuuguauguauaguguuauccuuuucuccuaggauguauaauacugugacaaacaucuuuuuuucguuguuguuuuuuuugaggcaguuuugcucuguugcccaggcuggagugcaggggcacaaucucagcucacugccaccuccaccuccuggguucaagcgauucuccugccucagccuccugaguagcugggauuacaggcacgugccaccacaaccagcuaauuuuuguauuuuuagcagagacggaguuucaccauguuuguccggcuggucuugaacuccugacccugugauccgcccgcgucagccucccaaagugcugagauuacaggcaugcgccaccacgcccggcugacaaacaucuuaaagagcucaccuacguauaugauuaacaguuuuaauggauauuuuaagguugaauugcucuccaaauaauuuaaaaauaugauauaccuacuuuuaaccuaugagaauauauuuuuauuuauauaaacgugaucauugauuauuuuuaaucucuaauuauugagaagguaauauaugucuuuuuguucaugaacaaucuuuuuaaaauagucuguauuuuacuuuauugcuuuugugauauugauucugagaaaacagagcuugucaaaagacccaucuacagucaugaguuucuaaaugacuuaauauaaaccagaaacuaagauuucuuauucaauacuuuauaauaaauauuagacaacccucugcauauaauguacugcacauucucaagaagaauugauaacaugauuaacuaccaaugaaaggauuacaaauuaaauuuauucugaauuuauuaaauggccuggauagcaugguuccucucuucaaauuauuacauugguacuaagauuuuuauaauaguucaaguacucaugauuauaaauuuagaaauaaaaugaaacgaauuaaucagguuuuuaaaauugucagugucuuguuuagagaagaaaauaaaaaagguguaaguaguaauauaauuaacaauaauacaauacaguaggagagugacacaauugcuugacauuuuauuacaauuucuacgucaucacauguaccucauaguccaaguccagguagucaaacucuccauugguacggaagugcugcaugcuccuguccagagugagguuaaugcuccgccccuggcgcucaaugaccacagagugccagugguggucauccagcaaacuuccugucaucacugauguguggccauauauggggccaagcugguugcuuccugcguacacagaagugaaaaagaaacaaugcaaugaugcuauggccaacucugugaagcagaagaucuuucauuuacagcaccuagaggcugacauuccaucaaagcucuauccauucgaguuaaccugggauaccaguaaguaacgacacuuaaaaauacuuuauguucuggggacuguuguggguuggggguaggggggagggauagcauugggagauauaccuaaugcuagaugacgaguuagugggugcagcgcaccagcaugucacauguauacauauguaacuaaccagcacauugugcacauguacccuaaaacuuaaaguauaauaauaauaaaugaaaaaaaagaaaaauaaauaaauaaauaaaauaaaauguaauaguaaaaaaauacuuuauguucaaaguacguacaaguuauuaaacauggaaaaaagugcuuuuuuaaaaagggggaaaaugaguguuuuaugacugugcaaugaauucugcuaaauuuugguagguuuguuauaaagucagugucacgugggcuuuuacagaagccuucuggguucugaugcuggcuccacuuuuagcuuggguuccaggacaaguugagaaugcuuggucuccauuuucucauauauacaauagggaagauaauaguaccugcuuuguaagguugcaugaggauucaaugaguuaguacaggcaaagaauuuaauacacuuucuggcauauagugaacauaacuguuaccuguuaaucuuuuaugacuguuauaauuauuauuaagaccacauagcaagaccauuuuuaauuuucauugacuccaaaagacauuguuguaaagagaacaauaugcaauuguuaauggcauagaaaauuuacuuguuaucuuuuaauuaaaaugauaacauucagaauuauauauguagcuuuuaguucugaaauaagaucuccauagcaacaaaacuauaaauaaaaguaaaagauuguuagaaucuaacauauuuauuaaggucaucccuggauaaaguuuacauaguuuguuucaucuauguugucuauucaagaauugcuuuuuauggucaggcaaaauuaaucacuauaaaaauauaauaggguuucagaauaaauagcauaauggaaauaagagauaaacaauugacugucacacuaaauucuuccuuccuuccuuccuuccuuuccuucuuucuuucuuuccucucccuuucuuuccccucccacacucccuccuuccuuccuuccuuccuuucucccuuuguaugcuaaugcccccauaccuuacauuuucuauuaucuuccuagaacauauuuucuucuuuuauggugaugaaaucaaauguugaugugugaugguaaaucaguguguaugcguaaaaugagacaaggaaaaggagagggacaagaggaggaagaggaagagagaggaagaaaauucagaacuaagugaaaaggucacacugaguuuuauuuaaauauuuacacuaguagacugagcagcagguagacacgucugauauuuagguaacugcauuaaagaauggcaguagauauuugaguggauauuucucccuggcuguuguaaauuccagucagucaguaaaacuccaucaguaaacugcuuuccaauguaaagcuaauaaacuuuuuuugguaaggucacaaagucaguuacuucuuugaaaacaguaaugucacacugcuauaagccacaguugauuuuaaaagguuacucuacauguuucauuugggauaaaaaaugaaaaguuugaaaaaauaaacaucuuuagauauaauucaacugcagugugugugugugcacacgugugcaugugugcauauuuuauggaaguacacauaaaauguuuuuauguguacaaaaaacaaaaaugucuuuuguuucugguuacucucccccugcucuuccuucuuuuccucuauugggucuuguuuuaaaaauaauuucaggcuauuuuccccugguagcacaaugaauacacguucguuauuagaagcagagaauauuaugaagaaacaagugaaauguaaugcaaaaauauuuccaccucuaaaaauaauuuggucuauuuucuuucauauguuuuccacaaacagucaugcaccacauaaugacauuucuuucaacgaugggcuucauauauaaugguguuaacaucaaauuuaauacuguauuuucacuguauccauucuauuuuuugauaugcaaauacuuaccaguuuuuuacacaguugccuaaaguauucaguacaguaacaugcuauacagauuucuacacuaggagcaauaagcucuaccauauagccuagguguguaauaggcuauacaauuuacguuugucuuugcagacucuuguauuuacaaaguguugaaacucacacagaauuucucagaacgcauccccauuuuaaagugacacaugacugcauauauuuaauuagaucgauagauugauacauuuuguauccuacaaguuuuacuuaauauuauauauuuccccauacaauuaaaaguuagcacauuuuaaaugcuaucaacauauuucuauguguuuaauuuuuucccaauuuuugacauuguaauuaauguugcaaauuacauauuuggacuuaaauccuaguggucauuucuuuuuuugccuuaugauuuuuggaccaaaauacuguauuguaagagauuucaaguguccgaagacauacugucuagcuauuuuccugaaaguauuuucugacuugcagaacaauacaaaggauccauuuugucaaauaccaacacugaaaguaucacuuuaaaauguauuuacuuacuugauaaaaauuaagcauuggguguuuauauaauauuuuuuucuuuuaugaguuaucuuguauaucauuugccuauauuuucuccuaaugucuugguauuauuaugcagugguauaauuucuuauucaugauuuauauuaaaccaguauauuugacauuuguauuucccagguuuugcaugcauuuuaauguuacuuuuauuuuaauguaaaaaauaauauuuuauguaacuaagugauggcgaauuuugugugacuuuucuucuuuguuauagaagcuauugugucuaucagaucagaucuuuaaugugaaaaguuuuauaaucaaggguacaucuuuaagguaauguaucauuaccuacaaaaauagccuaagugaaguugcaauuuuuaguauaauacugaauuucaaaguaauaaaaguuaauauaugagauacaagucauauucaggaauguuuggaccacucaaauugguaauugccaaauaaaucaaauagccuagaauuuuuagccaaucaagagaaacaggugagacaggggccaagauggcugaugagaagcagcugaagucugcagugcucaaggagaggaauggaagggaucaguaaauacagccuuuucaaaugaaauauucagguucucacauggagacggauuagggaaacaacuucacacaaggagaaugaaggaaagcaggauggggcuacagccuacccaggagcgacguggagccaagggaacccccaaccccugccaagggaagcagugagugacuaugugaccccaagaaaccaugcuucucccauggauuucugcaacucacagauuaggagaucuugugagcccaugacaccagagccuugggucugacacacagagcuguguggagucuuggcagaacaacugcucaaucaugcacagagacaggguggagcuuuacaaacuccacccugggauuuccaacaaaggugucugcaacucaggcaaggcgggaggucugcacauacuccuaggaagggggcagaauccagggagccgaauggcauuguucugugggccccauuuccauggcacccuacaagaaaagacccacuggcuuggaauuucagccagccacugucaucaggacaaagccuucuugagaccagauggagccucgaggagagguacagacaccaucucugcuauuuggucgacugggccuuugcagccugugggcuuuggagaguccaaagaguccagacaaggaggaagguuuccccagcagcguaacacaguggcuuugccagaucauggccagacugcuucuuuaagcagagcccugauccauucuuccuacugggugggaccucccagcuggggcccuccaaccacaccugccugcaugacagagcuauuuucuaucccugggauggagugaccaagggaggggagggucaccaccuggguuguuuggacaauucagucauuccacagccugugggcuuuggagaguccaagcugaugggggcagaggcaguuccucaccacaacauagcuguuuugucaaggugugaccagacuguuucuuuaacugccccauccccccauccauucuucuucccagggcagguugucccagcuggggccucuggccaccccugccuguguucuccacgggacaaagugccugaaggguggggcaggucaccaacuuggacauucaggcuucucagcuaguccagccugugggccuuggagagcccaaaccgauuaggggcugaagaaaucuccaacacagcacaguggcucuaucaaaaagcagccagacugcuuuuuuaagucaaucccugaccucauuccuccugacugaaugagaccucccaacaguagucuccaaccacuuccuccaggcacacuugggccagcaauaggucaguuaucccuagcauggaacuuccagaggaagcagcaggcugccaacuuugcuguccugcaggcuucauugcugauauuauacuuccagguacaggaaaaacagaggcaacuagugucucgaguggacucccagcaaaccacaauagcccuauggaugaguggccagacuucuacagggcuauuaaaagaaaaacaaacacaaaacaacaacaacaacaaaccccacaaaacuccaucuccaaaucagcaacuucaaacauugaagguagauaagacaccaaagaugagaagcaaucaaugcaaaaaauucugaaaaaucaaaaagccgagugccccuuuuccuccaaaugauugcaacaccucuccagcaagcgcucagaacugggcuaaggcugagauggcugaaaugacagaaguaggcugcagaagguggguaauaacaaacuucacugaaguaaaggagcauguuguaccccaugcagagaagcuaagaaucaugguaauacaauaugggaucugauagccagaacacccagguuagagaggaauauaauugacauguuagagcugaaaaacacacuacuacaaugcaaucacaaguauuaauagcaggcagaccaagcagaggaagaaaucucagagcuugaagccuaacuuucugaaauaagacaggcagacaagaauagagaaaaaagaaugaaaaggaauuaacaaaaccucugagaaauauggaauuauguaaagaaacuaaaccuucaacugauugguguaccugggagagaccgggagaauggaaucaaguuggaaaacauacuucaggauaugauccaggagaacuuccccaaccuaggaagaaggccaacauucaaauucaggaaaugcagagaaccucaguaagauacuccacaagaugaucauccccaagacacauaaucaucagauucucugagguugaaauuaaagaaaaaauguuaaaggcagccagagagaaaggcugaaaggccaggucacccacuaagggaagcccaucugacuaaaagcagcccucucagcagaaacucuacaagcuagaagagauugggggccaauaaucaauauucuuaaagaaaagaauuuccaacccagaacuucacauccagucaaacuaagcuucauaagugaaggagaaauaagauccuuuucagacaagcaaaugcugagagaauuuauuaccaccaguccugccuugcaagagcuccugaagaaagcacuaaauaugaaaaggaaaaaccauuaccagccacuacagaaacacaucgaaauacacagaccagugacacuaugaagcaaucacauaaacaagccugcaaacuaaccagcuagcagcaugaugacaggaucaaauccacacauaacaauacuaaccuuaaauguaaauggguuaaaugccccaguuaaaagacacagacuggcaagcuggauaaagagccaagacccaaugguaugcugucuucaagagacccaucucacaugcaaacacacacauaagcucaaaauaaaggauggagaaaaauguaccaagcaaauggaaaacagaaaaaagcagggguugcaauuguaguuucugacaaaacagacuuuaacccaccaaagaucaaaaaacacaaagaagggcauuaccuaaugguaaaaggcuaaauucaacaagaagaguuaacuaucauaaauauauaugcacccaguacaggagcacccagauucauaaagcaaguucuuagagaucuucaaagagacuuagauuccuacacaauaauagugggagacuuuaauaccccacugacaauauuagacagaucaucgaggcagaaaauuaacaaagacauccaggacuugaacucagcuuuggaucaaguagaccugauagauauauacagaauucuccaucccaagacaacagaauaugcauacuucucaucacuacacagcacuuacucuaaaauugaugacauaauugaaaguaaaacacucaacagcaaaugaaaaaggacugaaaucauaacagucucucagaccacagcacaaucaaauuagaacuuaugauuaagaaauucucucaaaacgacacaacuacauggaaagugaacaaccugcuccuuagugacucuuggguaaauaaugaaauuaaggcagaaaucaagaauuucuuugaaacuaaugagaacaaagauacaaaguaccagaaucucugggaugcaguuaaagcaguguuaagagggaaauuuguggcccuaaaugcccacaucaaacagcuagaaguaccucaaguuagcaaccuagcaucacaacuaaaagaauuagagaaccaagagcaaacaaaccccaaagcuaguagaagacaagaaauaaccaagaucagagcuaaacugaaguggaauagagaggcacacacaaaaaaauccuucaaaaaaucaauaaauccuggagcugguugauaugaucuggcucuguguucccacccaaaucguaucuugaauuguaauccaaauuauaauccccauguguugggggagggacgucaugggggugguuccccuugcuguucucaucauagugauugaguucucaugacaucugguguuuuuauaaagggcuuuccccgacuucacucugcacuucucucuccugccgccaugugaagaaggauguguuugcuucccuuucggcccugauuguaaguuuccugaggccucuccagccaugugaaacuguaagucaaguaaaccucuuuuuuuuuuuuaauaaaucacucagucuugggcaguucuuuauaccagugugagaauuuaauacacugguuuuuugaaauaauuaauaaaauaguccauuagcuagaauaauaaagaagaaaagagagacgauucaaauaaacacaaccagaaaucguaaggggggcaucaccacugaccucacagaaauacauuuguauuucccuauagaaauauguuuguauuucucuauuauuuuuauaguauucucuguaccaucagagaaugcuaugaacaccucuaugcacauaaacuagaaaaucuagaagaaauggaaaauuucuggacacaugcacccucccaagacugaaccagaaagaaauugauucccuaagccagaccaauaaugacuucugaaauugaggcaguaauaaauagccuaccaaccagaaaaagcccaggacgagacagacucacagcugcauucuaccagagguccaaagaagagcugauaacaugccuauucaaacuauuccaaaaaccugaaaaggaaggacuccucucuagcacacucuaugaggccagcaucauccugguaccaaaaccugguggauauacaacaacaacaacaacaacaacaacaacaaaacuucgggcaaauauuuuugaugaacaucuaugcaaaaaugcuuaacaaaguuauggcaaacugaauccagcagcacaucaaaauggguauucacuguaaucauguaggccucaucccugagauguaggguugguucaacauacacauaucaauaaaugugauuaaucacacaaagagaucuaaagacaaaaaccacaugauuaucucaguagaugcagaaaaguucuugaauaaaauucaacaucccuuuauauuaaaaacucucaguuaacuagguuuugaaggaacauaccucaaaauaguaagagccaucuaugacaaacccacagccaauaucauacugaauggggaaaagcuggaagcauuccacagaaaacugucacaagacaaggaugccuucucucaccgugacuauucaacacaguauuggcuauccuggccagggcaaucagacaagagaaagaaacaaaggguauucaaauaggaagaaaggaagucaaauuaucuuugcagaugucaugauccuguaacuaggaaaccucaucaucucagcccaaaagauucuuaagccgauaagcaacuucagcaaagucucaggauacaaaaucaauguauaaaaaucacaagcauuccuauaagccaacaauaagcaaucagagagucaaauuaugaaugaacucucauucacaauugccaaaaauaauauaaaauaccuaagauauagcuaacaagggaagugaaggaccuuauuaagaagaacuacaaaccucugcucaaagaaaucagagaugacacaaauaaauggaaaaacauuccaugcucauggauagggagaauaggaauaaucaacaucaugaaaauggccauauugcccaaagcaauacauagauucaauacuauucccauuaaacuaccauugaccauucuucagagaauuuaaaaaaacuauuuaaaaauucacauggaaccaaaaaagaguccaauggccaacacaauccuaagaaaaaagaacaaagcuggaggcaucacacuacccaacuucaaacucuacugcaaggcuacuguaaccaaaacagcaugguacugauaugaacagacacauagaccaaugggacacaguauagaacucagaaauaagaccauacaccuauaaccaccugaucuucaacaaaccugacaaaaacaagcaaugggaaaaggauuccucauugaauaaauggugcuggaagaacuggcuagucauaugcagaaaauugaaacuggaccccuuccuuacacuguacaaaaaaaucaauucaaaaugaauuaaagacuuuaauuuaaaacccaaaacucuaaaaaccuuagaagacuauauaggcaauuccauucaggacaugggcacaggcaaagauuucaugauggagaugccaaaagcaauugcaacaaaagcaaaaauugacagaugggauauaauuaaacugaagugcuucugcacaguaaaagaaacugucaucagagugaacagacaaccuacagaaugagaaacaaauuuugcaaucuauccaucugacaaaggucuaauaucuagcuucugcaaggaacuuaaauuuacaagacaaaaacaaccucauaaaaaugugggcaaaggacaugaacagacaauucucaaaagaagauauacauguggccaacaaacaugaaaaaaaaucucuacaucacugaucauuagagaaaugcaaaucaaaacugcaaugagauaccaucucacaccagucaaaaugacuauuauuaaaaagucaaaaaacaacagaugcuggugaugcugcagagaaaaaggaaagcuuuuaugcuguuggugggaggggaaauuaguucaaucauuguggaagacagcgugaagauuccucaaagaccuagaggcagaaauaccauuugacccagcaaucccauuacuggauauaaacccaaaggaauauaauuuauucuauuauaaagauacaugcauacauauguucauugcagcacuauucacaauagcaaagacaugaaaucaaccuaaaugcccaucaaugauagacuggguaaagaaaaugugguacauauacaccauggaauacuacgcagccauaaaaaggaaugagauccuguccuuugcgggcacauggauggagcuggaggcuauuguccucagcaaacuaaugcaggaacagaaagccaaauaccacauguucucacuuauaagugagaacugaaugaugagaacauauggacacauagagaggaacaacacacauggggucugucggagguuuagguggugaggaaggaaagcaucaagaauaauagcuaauggaugccagccuuaauacuuaggugaugggaugaucugugcagacaaccgucacggcacacguuuaccuauguaacaaaguuguacauccugcccaugcauucaugaacuuaaauuuaaaaaaaaaaaagaaaaagguaccauuacuuugccuaaacuguaauuuugaaugccaguaccaaucuugcagaucuucacuuuagcuuuaaguaaauccuagcuacaucaucaacauacaaacauacauuggucuuguccauuuaaaaacaacaacagggccaggcacgguggcuuguaaucccagcacuuuggaaggccaaggcagguggaucauuugaggucaggaguuugaaaacaaccuggccaacauggugaaaccccaucucuacuaaaaauacaaaaauuaaccgggcauggugguaggugccuguaaucccagcuacucgggaggcugaggcaggagcaucacuuaagccugggaggcagagguggcagugagcagagaucaugccacugcacuccagccugggugacagggugagacucugacucaaaaauaaguaaauaaauaaauaaauaaauaaauaaauaaauaaauacaaauaacaacaaccccacauaaaacaguaauuugaguucagaucuuucagcagccaacauuucauuucucuauguucuuucuuucuaguuaacaguuaacuaacuguucuuccucucuaguuagucaaaauauuuacuuaacgccuuucauucucuuuuuuaccuacaaaauuugucuuuucuauuccacagaguagaaauuaacaguaaccuccauguuguuaagcccaauauuugccucucugucuucaucuuacaugacauuuagaugaauucaacaguugacaaccucuuuuguuuccuugauuucugugauacuacacuuucuucauuuucuccuacucaauauucacaauuacuuagucuccauuuuagucuuccucucucagucucauauaucaacuuccauaaucgaaaguucuacuuagauguuucauaagcagcucaaauuaaccauguccaaacugaucucuagaauuccuccuaaagucuucucuauuucugaaaauggcacuaauguccauuuggugcucaagcccaaauccuagggcucauucuuuauuucuacucuuuucuucuuaggcuauauccaacccaucauaagucaugcugaauguaccacuaaaauuauuuccuuaauugacauauuucucugcaucuccccugauaaccaccucauacaagcaguacuaucucucacccaaacuaugcagaaguucugcugcgacucucauaucuacacaaguaauucuucuuacagaagucucaaugcgcuugauaaaaaauaagaugauaaagccauacaguuuaaugacuuccaacagcuuccuauucuuaaaaauaauaucuaaacaauuuguaaugcccugcaggaucccacaggauuugggcaauuuccaccucuuggacuucaucuuuugucuuaauaacucacagcauuuaugcacggcggcauccuuccugcuucuugagcgugcuuuuggucuuccauguucucuuccuauguaaucuucuuucucucauguuuucauggcuaauuccuuuucaucacucugaucucaucuuaaauauuuucuccccagagcagucuuucuucaccacacauucuaauauuagcccuguugccuuugaacaggacguauuaaccuagucccuuuaucauauuaaucuguucaacugguucauaauauauauuauuugaagacauucauuuuugcuuaguuguuuuaaaauaagaauaauaaaugcuauauggucugauuccuccguuaggucaugaacuuaaugagcuuaaggaucuugucuauuuguuccuugcuguaggccaaagacuaguauaguaacuuguauaguagagguguuuaauaaauauuuuuugaaugacuagguguuucauuauauaccuacuguuauagauuaaguaugaauugaaauauaacaugagcucuuuuuauaauuuacauuuuaaagaauugagcaacaugaacauauuccuaaugggaacauccauaacggaaagaauagaacugacagucagaacacaccuaaguuuaaacugaggaccagcuuggcuuuuuucaguuccaagguaauguaaucuccuugcuguccuucuccgugcaggauuacuccuucacuuucagacgucuuaaaguucaaggcaaugacaucuuucaguguuuucaucuucuuguuucugaaucuauaugguaauacaacauggccaucaaaguugauaacaucagccccuaaaacaaaaaaaaaaauaacauauuaguucagccauguauguuaccauccacuuccaacaggugucugcaaagaauaaaugagaauuaaguaaguguuuuucuugagaaauugacaguccucuguuuuucuucuauuccuucuuuugauuuacuguguuuguuuuaaaggagguuuuauggagaguauugauaaaaaugcucauaaaagcucuaucaguugaacauuuuacuuuaauuacaaaauuaguaauauaaauucaauggguuauaugcuucaaaucuuaacuuagaaaucuagaguuuagaccaaaaucguaaaauuuuuaaaucucaaacagauuaugagacuuaaauguuugauuccuuaaugauaauucuucaugauuuuaaguauauauuuuauucaaaaaguuguuuucuuugauguaagaaugaaggcacuuggaauguaaucuuuuaugcuauucucuuuuuuuuaaaugguuuuuauauuucaccacaauuuuaguaaaccuuguuguaguauucagaguuuacaaccaaucgaauuuucagaaacuucuuaccauuuauucuuaggaagcagugugucucaaauuucuuauuaccuccuugcauuuggaauggagaauugggcaccauuguuuguuuuuucacuacauuggacacagauaucuucacuuauccauauaugaguuuaaagaacaaauauccagcguaugacuacagcagcucuaauuuuaguuucaggggaauagauuaaaauaaggaaaguauguaaacuuuuuaaaaaaugggaaauaugaucagaaauaugugacugugaggauucauuugauaacuacuauuuauuucacaccagaaauaaaaaugagaugauauuauuuauuaggcacuauuggucaaugcauucucgauucauagaaugauucaaaaugcaauguaaccauucaaaucaaauauugaguucaaauagaagcuucguuaccaugaucaaaucuucacuguuaaaaaucuuuucaauagacuauuucuguaagcuuuucauuuuuaaaucauagaaagccuagucaaacggaacagcucuaauaacuuuagaauuacaagucuggacaaagcuagccucuagguuuuggguaaggucuggcuaaagaacuccagagggagacauuggagaaaaauaauagccaguuuaaagccugucagagaaauauuuucucauuucauguccuaguucucuggcacuuguuuacuccaaucaccacgaggaacacuuugguuugccuuguaaguggagcauaccaccaaauaaauuccuuugggggccacaguagagaugcagggcugccagaaccacauccacuccuuuuuuguguugaguuuacuuaauucuauaaagugaauuguugugcauacaguuacuucgaauaaaaugaaaucuaagcaugccuuucaaaucauugauggcuuucacauacuuugaaaauaucuaugcuaguaucucaaauauuuaugcuuuuaaauaaguuuguacaauguuauauuauaaaacauucagaaaaaauaugaccuuaaacuuuaaauuuuaauucuuauaaucagcucuuuauugcccauaaaaagacuuucuuaaucaacagaauucuguucucugagacugugaaucacagagguuuauuuuaauaugagggaaaaaaucaaucguuuaauuuuggcuucugcuaacacugcaaagccaauuaaacuucagcuuaauccuauauacugucacagcugaauuucaauggcaauaucuuuuucaugugcaaugagaaauaaaggagaacguauaauccagcaguugaugauacuuuuuaucuugaaaagugaauaaaagaaaaacagaugacaguaaauucugaacucuagacaguaguuuugcagucaauuuccuaucagugacaguuaaauaauagacacaucuuguuuuauacaccuuuagcauauuuuaauugacauaaaauauuucuaauucaucuuucaggaaguaaacguucccugagcuuuuacucagggaacaagaaucaccuccucuauacuuucuucuaaaucaaaacacauuuaguucuagguacagaguaaugauuuacgcaaauguuaaugcauuccugucuuacuuuuagagcaaugagaaaaugugacagaaaagaugaagauggcuuauuuuuuucagacaauccuaagauauuaauaaaaacaggaaggacagcuauucauguagaccaagucucacuuuacaaaugguaaguugucagggucagcugggaaacaaaauucucuguaaccuagauucccuacaaagaaaaagaaaaaguuucaacauauuuucccaccuaucuauccaucuaucuaaaacaaaauuuaaaaguuguuauucuaugaauggguuaaaugcuuccaaaauaucagcacauccucuuguggauguaagcucagagcuggcuugaaaauuauaaaauuucuagaaguaaucuaugauauuuacacuuuaacacauaccauguacucuuuaaaaagucugggauauucuacaacaauguaaagaacauccaucacaguuuggcucuguuuccuacaaaaauagauuaaaauuucauuugauaucuaauaaugcgcugugcuuauuuggggacaagccacuuuuuucuucuauuauccugauugcuuaucacucccuagaauuaaguuuucgaugcggugauuaaauauguaugguugaacuguuuaagcaaucugaacaauaauggcuagucaaaaaaugaaugcaaaaucauaguguuuccacaauuuuguuccuaacaaaagcucagcaagcugguaauaugcccaauucaucaaaucaucaugguagaaaacgcuuuuucaaaaacauuuuauuguuccuuagucuucacuuucuaacuuugaauaagauaauuugaagaaguguuuaccauauaaacauuuuaauauuaaaauuuuaaguuuauuugauauuuuaauuuuaaaagauaucuuugcuauauauuuuauuacaaacuaugucuauugaucaaaagaaauuaagcaauacagaaauauagaaaguagagagugaaucccaaccacgaaaaaucaccaguguuaauggguacuuaacuggugcauauccuacauuuuacauauuuaccuaaauaucuauccaacuauauaagguauggaauaauucauauauauauauauauauauauauauauauauauauauauauaugagggaggaagggagaagaauaaagacagugggagagagagagggagaauuucauuucaguuagucaugguccaaaauguacacuaauaauuugaguuuggggugauauaauauuuauaguacagggaaauugcaugguuuaauuaaaauuuuuuauuaaucuuaauaaaagacacuuauaaaagaauauauaauuugaaacuguagucuacuuauuugaaaaaauuaaaaaguauguaaauauagcauaucaacaaauaaauauucaagaguuacuuuuaauaccguuuccccaucaaauguuuucaguuacuuuuauaggggauccgaaagaaacaaaaagguuuaaagaaaaaaaauuuaaaaggcauuauuucauuuuuuacugaaauaaccaaugauaauauacuauuugugauuauuuuaaauugcauauaaagaaucuuuacguauguacauagauacacauauggauaauacuguauauaguuuguguuugauuuuuguuacuguacauuuuuuaaaccuuauuucauaauuuuguuuucuaaaacaggauuuugauuagcuaaaaauguaccauuaguuaaauguccaacuucuucaauaaaaauugugguggaaguuuuguuuuuauuuucacaaacuuuuuauuuuggaaaaauuuuagauuuagagaaaagcugaaaagguaguuggaaagauagaauucucauauguuucacccagcuuccucuaauauuaacauuuuauauaaccuggcacauuugucaaaaugaaaauacuaacuuaaguggcauucacucaaauacagauuauacuuggacuucaccaggguuucacuaauacuuuuuuguugcuguucuaggauucaauccaggaucucagauugcauuuaguuaugaugccucccuagucacuucuaaucugcaacaguuuccaauucuuuccuugucuuucauaaccuugacccucuagaagagcaccagccaggugcuuuguagaaucuuucucaguuuggauuugucugacguuuucuuaggacuagacugcauuauugauauuuggggagaauaucacagaguuguggaaucauauaucucaaauauauacaauuuuuauuuuucaauuauauaauaauucaauaaagguaaaaaauuauauagauuuuuagagaaaaaaggaaacaaaauuaaagacuucuuuuauaaaaaauaaacuaauuaaaaacuaguaaauuuggaacuuuaaauuuuguaaaagcauauauauuucucaaauacauauaaagcauaugaaucuaaaaaaauaguaaaaauguauauuaaccaguuaguacagaaucgaauacuauauaguuuaugcaaauaaauaccaagucacuucaagaguuugaaauacauuucauuucugaaacugaaguuuaaaaauacuagaagauagaauuugcuuauuuugcaaguuucacacacaugcaaaucuguguauuauuuucauugucagaugucaauauuuuagauacauugaucauucuuuauaaaaagugugacugccaacuuuaccuccucucuauucacgcagcuuuauucauuuuuauggaauuuaucucuaccugauacauugauguuuguauauuuacagcauaucuccucugagacuuaguuuuguuccauucuaaagcccagcacuuaaaacagugccugaaaaacagugaauauuuauuaaauauuuguagaaugugugaauguugucacucauauuucuauuaauuggauuaagguauaauaaacacuauuauuucauacuucauuaaaaaauuagagucacuagauuggaagaaauuucaagaaucucgcugacccaucuuggugcuacaacuacaaauauacuugagguuucaauagucagaugaaaagacugguaacauuagguuacuuuuggggagcugugguggugggcaagaauguauuccauuauuuuaaauugacucaguccuagaacagacacaacucugguggacucaaucucauuccaucuacacauugcuuuuaucugaauacuuucuuccuccuaacccacugccuuucuuuuuuucaauguaucuaugauauaaaccuaaacagauaaaauaauuucaaaaugucauuauagcuaauuuagaguaauaguagcaaaugagccuucuccagauccuuuaaaaaugaucuagagauagaaucugaaaaucacuucuacuuuggggaaaauggaacaaaacaaaaaaccucaaggcucuucuuuccugaaggccagcaucucacaguuugugcaauauuucugcuuaaaauauguugcuuuccccuucagugcuugauauucccuaggacagugacaacaauaucaaaggacucugauuucauuucugcauaccauuuagauuccaauccaguaacuuggaaggcugauccacauggauauuccacaggcacaucucacucuaccugcucaacauauaauucuuucucugggccccacuacuuuuauuauauccauuauccagucacucaagccagagaucuggaacuuucuugagcuucuuuuuuuuuuuuuuucuuuuugccuaccuacauuuagcgacuuccaagaccugugaaauauagagcuuugugcaguggcaguaucauauagccaaugaguucauuugaggugcaaugauuguuaauugaaauuugauauuucaauuugauauuucacuuugauauuuuuaaaacucauaguuuacuuuuauauguacuaucaugagccuaccauuaccucacauguugccuauuguauuaacauuguuaaaugaccaauucucauccuuuggucuuauuucucuuaaauccaacugauaugaacaggagacaagagggugguuccccggcaaaggcuccgcccucaagcccgcaaaccguggugcuaaaugagaacaguuauccuguuuuccugcccaauuguugcuucuuucaaaaccacccuggccugccgugcuccccauccuauacucauaaauccaaaccccaggcuccaugaacagacgagcaguagaacagaagagcggcacagcagagaaggagagaagagaggaagcgucuguacaucaagagggguuuggcuggggacagucagauaggagaauggccguggggugguugaacuccaggggaagaucaucuucccacuccaucuccuuuccagcuccccauccaucccgcugagagccaccuccaucacucaguaaaaucccugcauucaccauccuucaaguccaugugaccugauucuuucugaaugccagacaaggaccugcguaucaagaggacaggguauaaaaggcugucacccugacucuccacugaacugguuaacacuuaaccauccacagauggcaaagcuaaaagagcacugcaacaccccuagacacugccguggagccagggcccaaaagcgcucgcuccagcucaccugcaugcuccuccucccaaaaggggcuugagcgagaaauggagccacacccuuguugcaagucccgugaagggguccagggaacucucccgucuuaaaaccaucacacagaagcuggaaagaccuuuuugaaauaaacucuuuccaaaaaagaucaaaagccagguucuucaguguggccuauaccacccucaaugauauagcuccugccuucccguccaggcucauuuuuagugccaucuuucuuuuuaugugcuccugaugguaaacggauugaauuccucgcaaacuucacauagcaccuuuccucgggcuaugcucacuuucuucagugagcagccauuuuucuuguucuaguuuacuuuuaggcaucuucuaagccucagauaagccucaccacuagaaagccugccugugugaaacagccuuggucuauuguccccuaguuccuugcauacuuuuaucauuuuacuucucacauuauauugaaguuaucuucuuuugggcgugauuuuuccuguggacuugaagcucuucuaggauacaggcuuuggauuguuccguuuuggauuccuggcagcauaaacacuuucuaaacugauugaaacaucauuuagguuugaaacaaggcaaaaggagaauuccacuguguuauuauuuccccucuaaacuaugccugugaccgugcaguuuacuuucuaagaguacagauuuauacaugauuuaaggcuacacaacucuuacaacuaugagugucugauaugaauaaaugguuuaaacauaacaugcuuuuauuauacuuacacuggaguuauuuguuuauaagucaaaggccaaaacauugaacuccuguaugaguuuaaauaaagaauauauaauuuccuuugaauuaaaugcauuaaugaggaacuugcauauuccaagauuaaagucacuaaguuuuaaacaccuuuuagagcagucauuguaugcuaaucugaaaugguuauugauuuucagaggcaagaucaauugacuccuacauauuuuaauuuuugacuuacuccauaaaaaauguauauaugauaaaccauaaauggcuaaucaucugguuggcccaaugaaucacaaaaaacagacacaggaaaauauuaguaacuuuuuaaaguuauagcauuagauaucacauuauucaacgugaagagacaaaaaagcccacugagguacccuaugccucccaaaauggacauucacacacacauacaccccccauacacauacacacaaacacaugcacacaccuauauucuguccucgcucucauccacucauuacccacaagauaucagaaaaucagagugaucuauuucuaagcaggguuauaacucucauauauccaauaaugcagaaauaauaacaauuucugaaaauuagcauauaaucuauuuguaggaaauccauguggaagcuguuuuuauuuauuuuuguaaaucaaaaagucaaauaaauuagacucgccuucucgccuucgcuguuuacugaaaauagcucuacaacuuuugaccacacaaaaucuaguuuuuuugcuggcgaaaagacuaucuagaauuauaaauccuaaguaaaugcuacacagaugaggaaagaaaccagacaucaagaaacuccucagaaugucuuuugauuuaaauuauucccaacauuuauuucggaauuuuuaaaaucucuauucaguucaccuucuaauuccauuuaaaauaucauugucaguguucuguccaaauuuugauacuauauaaagauagcaguuuaguuacaaauagugauaagcaacuuguuuuuaggcacucuuuucauaguaauuuauauaauauugaggaaaaaaucaauuaucccuaugaguaaacggaggcugguagcuguggagggugggagcagggguaauggcagccaccugugucauuucuuggagcugccauggcuucaacuuccccucuauccugaccauguauuuuaaucucugugcuccaaugcuuugacaucuggggccuugcugacccuagagggacuggucuucccagaguuagccaauuucuagagaugguaagcacacuuuccaaauauaaagcaaucaauccagaguccacaccccaacugcuuccuuuauccagcuuucucucuucuggaccaugauccgucuucccuauucaucccagaaucagguacaagacaacuaggaucagccucugugccccagaacucacuggaauaauuauuccaguuagccagaccuaagccugcuuacccugcugcaccuaucccuucccauggaaacuacaauaaaggaccuugcccacaguucccucauccccucuaccuccugacagauccuggugcuucccugagcucccuaccucuggucuacacccugugggauggccugccacaguaauaaaaguaauaaaguaaauaaaugucauguauuuuaauaaaguaauaauuguauuuauauaaaauaaaauaacuucaaugcucagagaagacaagcaguuuauacaaaugugugaugcuggcugguuauaaauaucguaucaauaauauaaaguauuaauaaaguaauaaaauauuaguaucuuuucacgguagguguuuucugauauguuggccuuacugugucucaaauuuucuacuaauaaacuauauuagaaaacacucaguacagaaaauuauuuuaccauaucuuagaaaagaagugaaaaaucaguuuugaucaaacaaaagccuaggaauuguuggcaaaaguuaguccauagaccugcaaaaagcuccuuuaaagcaaauuuuagaaaccauuauuaaaugucuaagaucaacuucuggacucugaaguaucuucuacauccauaacauugugucaagacugggguuguggaaguaauggggugaguuaaaaaacaaacaaaaaacaauacaggaacuuuccagugaaaagagaauuaagacugaguaagauaaauucagacagauaggggaauagcacauucgacuguucuaaaaacgcucaguuguuugugacuuuacuacauaaggcuuacaauucaugugcagggugagaauuggaagauuaaagacuuaaugcucccugaggaagcugagggcccauguguguaaugaugguauucuaaguggaaaaugcauguccagguuugcauuggaaagauaacuccugugcuagugagggagaggagaaagggcguggaaagggcccagaaacagagagaacaaagacccagccucaaacgagcugauguucuuacaguguuggcaacaguuacgcaaagccagaauucagaagauaccuaugucauuaaaggaugcaaagcauucagaugaugcauuaucacuacacagaauuucaaagcaguuagggauuuuauacuaacugaagaauuucagaucaaaauuuacaguuguggcugacuccagguguaugauaaauccaauauuacaaagccucagaauuuaaaaugaaauugacaguacccugaaaacaaaaacaaaaugucaaaaauuccucuuugaaacacgcuacauauucgaauucauuuucccaccaucuuaauuuuuacacagaaucuuaguuuguuacuucuuuagcuauccaaaauuucuaugcgcuauccuuuucaaauucaucugauaugcuuugucucuguuucuccacccaaaucucaucuugaauuguacucccauaauucccacguguugugggagggaucuggugggagauaacugaaucauagggaccguuucccucauacuguucuagugggagugaauaagucucacaacgucugaugguuugauaaagggaaacccguuucucuuggcucucauucuuucucuugcugccgccauguucaagguccccuccaccuuccgccaugauggugaggccucccuagccaugaggaauuguaaguccauuaaaccucuuucuuuuguaaagugcccaguguuggguacaucuuuaucagcagcaugaaaaccaacuaauacaucauccauccauccauacaacuauucauccacacauauguacaugaacaaacaccauuacuuuaaacuuguaaaaucauuaauguucugaacgcuauacauccaucaacaaccccuacaaauuugucaggacgaguagcaauauguaauaggugauuaggaaaaaaugucauuuuuauuuauuuuacuuucugugcuuuccugaaagcuaaauuaguugguacaaaugauuuucucuuauuugugagagauugggacauaugugugcaguaucuuuugagguuaugcauauggugcaauauauuacaacaauucuguaauuuugguuugauuucacauaccuuugggugaaaauuuuaccucaaccauaaaauaggcuuaguaaagcucaaaagguacacauguugugagauaauguucucuuuccucuuugcuagagcaguuagguccugucugguaaaacacuaaaaacaguacucuguggucugcucgugaacacaccucagugauuugggcauuggagggaaucugauucacugugaacuugggugcuguccauuacuucaugacaccugcacacucacuggggccaugaagaagagguugaauuaauuuauuuucauaaaugagcaguacuuacacaacuuguggcgagaaccaguccugacagagauaaaaugauuuguagcuucuaaaauuagaagucacaacuucaaugcucagagaagacaagcaguuuauacaaaugugugaugcuggcugguuauaaauaucaugucguucuauugaucuuuuacuuucuuacuuuugauagcaauaugaccaagagagacauauuucccugauuagaaaaucaaccaaaaagagauucuaaugaagagauuaaaagcucagccaugauggcagaggauucaugcaguguuugggauauguuguggauaaaaggggcugucccuauucacauggagguaacuuaugauaugcaggaaugcugguguuauucaaacaauacauuuucaaggaagcccagaaauucaaauuuuuaauuaaauuacuccaauuuaaauguucaccaguugauuuggaguuguauuaugcagaggcugcuagcuacuggcccacauuuaugucuucuuggccacauaguucuuuaagcugucaaauacaagacuucauggaucauaguaaaucugaaacaauuagucugcuaauaauuacacccuaauuuuccugugaauaaccaguauguaucugccuguguuuuuauuuuucaaaagguaaauucuguaggaaacaacaugauuaaugcuaaaucaauagagagagcaugguuaagaaaaaacaaauguuaauguaaauaaaagaaaaaggugcauuuacuacuuuuacgagggguccaaaaggcucaucugucaggacccauaugaagggagaagcugccugucguuuuguuguugcugcugcuaaagggaagggugggcuucauaggaacaagaaccuccacauuugagauaaaagauaauuauuuaauuaauaauagcucaucaaguguuguuaauaacaacuaagcaaaccaggauccaguuuuaggaagauguacugaaauaaaauggaaauuguuuuucugccucguuucuguagcuugguaagguauaugauuauaaaaugaagguagaaacaaaaaucaauauuguagugaugucagauucaaaagaaaaaaagaaagaagcaagaaaaacaaugaaagacaaugaaacaacauacaucugaaacuuauucacugagauuugaaauagaacuuacuaaaaagaaaauauauauauauacauauauaaauuuuacaaauauuuuauuaacugcuauguucugaauguuuguguccucccaaaauuccuauguuaaaaccuuauucuuaauguuacaguguuaggaguuggggccuuuagaugugauuagguuaugauggugaaguccucaugaaugaaauuaguucucucauaaaagcugccccagaggcugggugcgguggcucacgccugaaaucccagcacuuugggaggccgaggugggaggaucauuucagguaaagaguucgagaccagccugaccaacauggugaaaccccaucuguacugaaaauacaaaaaaaaaaaaaaaaaaaaauuagccaggcgugguggugcaugccuauagucccagcuacucgggaggcucaggcaggagaaucgcuugaacccgguagacgaagguugcagugagccgagacugcgccauugcacuccagccugggugacagagcaagacucugucucuaaaaacaaaaacaaaaaaaauaaaguugccccagaaagaugcguugcccuugcacacagcaagaaggcaucaucuaagaaccagaaaguggacccucaucagauaccaaaucucuugguaccuagauuuuggacuucucagacauuagaacuugcaaaauuagauuucuguuauuuauaagcuaucuaguuuauauuauucuguuauagcaggccaaacagacuaagacagaaaauugcuacucaaguagaguccugcugcagcaaauacuaaaaacguaggaacauuuuuggagcauggccaugggcagaggcuggaaggcuuacaaaguucaugcuuuaaaaaaauaauaauaauaaucccagcacuuucggaggccgagacaggcggaucacgaggucaggagauagagaucauacuggcuaacacagugaaaccccgucucuacuaaaaauacaaaaaaaaaaaauagccaggcgugguggcggacgccuguagucccagcuacgcgggaggcugaggcaggagaauggcgugaacccaggaggcggagcuugcagugagccgagaucgcggcaccgcacuccagccugggugacagcaagacuccuucuccaaaagaaaaaaaaaaaaaaaaggaauaauaauaauaaaaggcuacauuauucugaauggaccuuuaaggguaauucuggugaggacuuaagaagaaaagaggagagcuguagaaagaaccucaaucuucuuaagguauaccuaaguggccgugaacagaauguugauagaaauuugggugauaaaggccauuccgaugaggucucagacagaaaugaggaugcccugggaaguugcagaacucaggaagagaucuguugcucugcaagaucuccacagagucccuucuagggcaauguauagaggugccaugggguugcggcugccccaaguuuugccgccaucaaaaccgguagaagccaccagugugugauucuagcaugaaagagccgugagcuggugacccaggcacagagccaccauggagguggggcuacugcagagaaccaucuagguggcaggauauucggggcuugggacuuuaaauugggaccuguuaccuuuuucuucuuuccuauuuuuuuuccuuuuaaagugauaaugucuauucuaugugugucccacauuguauuuucgaaguacacaacuuguuugauuucacaaguucacagcaggagagcaguuugcccuggaugaaucacaccuugagucucacccacaucugauuuagauguuauuuagaugagacuuuggaguuagaauuuaaaauugauguugaaaugaauuaagacuguuggggcuauugagauggaauaaacgcauuuugugugugagaauugugugaauuuugggguuuuggggcagaacgcuacgguaugaguguuuguguccucucaaaaacuguagugaccagaggcucacugaaaccuaaaccuauacuuccccuaggagaaauaauucaguauucgcuaaaucaguguuccuggcaacuuuauagcacauaauuacuaucaauaaugaagacugcuuguguuuacguugcauuuauuuaccuuuacacaagaaaguagagaaccauuucaaacuaccacauauaugucagcagaauauaauaaauauuuaauuuaaucuugaggcaaaugauuaacaaacagcaaaucucuucaaaaauaaguauaaugcugcauuguaucaucugacauacguacaccuuuucuuuuucuuuuuuuuuuuuuuuuuuugagauggagucucgcucuuucgcccaggcuggagugcaguggugcgaucucagcucacugcaagcuccgccucccgaguucacgccauucuccugccucagccuccugaguagcugggacuacaggcauccgccaccacgcccggcuaauauauauauauauauauauguauuuguauuuuuaguagagacaggguuucaccguguuagccaggauggucucgaucuccugacgucgugauccgccugccucggccucccaaagugcugggauuacaggcgugagccaccgcgcccggccauaccccuuuuccuuccacagcauggacgugccauuuaguacaugcaacuuacaaguagaacauacaaaggccaaucacucauuccugacaugcuugcugcaacuaaacacugugguuuauauaccuaauuauuaaaauucacuaaccacuauaucaacaauaaguuuaguuuuuguaguacagagguauguagaaucugagauuccuaaagaaucacagaauccaaaucacauuuuucaauuuacauucccucuauggugaagcucagaauuuuuuaaagcuauuugaugauugccuacuuuuccugacuuuguagaaaauauucugcuuaaaaauugcaacauaaaaacaaauauuuuauugagucuacuagaauaggaacauuaaucucucuucucucuaaacccuaaauuacuuuaaagcuauaaauaagcuugaaguugacuucuuauacuauaagaauuuuagauauuauuuuguacaauuuauagcuugaauuucucuuucuaacauaaauucaggguuucucuugaaaagaucuggcauuuucuuuugaauaaaggccugagauauuggaaauauuagaaaccuauugcaaaguugcagaauucuguagcuucaagaaggaaauuauuuugaauucagaaaauauaaggacagauauaucacaaauccaguuaauuuuagaaaaacauuuuugagggggucauugggaaaggaacugaacuuggaaacaggauacauuugauacagugccuacacaucuguguuucaacuuccugcauuuuuacagcuuaggucaaucuuaacaauuuaugcauuucccaaggcaugacagauauagugcuguuacaagugcuauuuauaguagggugguuaaguccuuaaaaugacaaugguuggccaggagugguggcucacgccucuagucccagcacuuugggagguggaggugggcagaucacgaggucaggagaucgacaccauccugacugacauggugaaaccccgucucuauuaaaaauacaaaaaauggccuggcgcgguggcucacgccuguaaucccagcacuuugggaggcccagacagguggaucacgaggucaggagaucgagaucauccuggcuaacauggugaaauuccgucucuacuaaaaauacaaaaaaaauagccgggcaugauggaggggaccuguagucccagcuacccgggacgcugaggcaggagaauggcuucaaccugggaggcggagcuugcagugagccgagaucgcaccacugcacuccagccugggcaacagagcaagaaaaaaaaaaaaaaauuagcugggugugguggugcgcaccuguagucccagcuacuagggaagcugaggcaagagaaucuuuugaaccccguaggcggagguugcagugagccgagaucgugccacugcacuccagccuggugauagagcgagacucuugucucaaaaaaagaaaaaagaaaaaaguauaugguugaguuucuuuaauauaaacuuagaaucauagcacaugccuucauuccaaggguuggcacgacaaagagcaugcugaggcagagcauuuuucagaaaauuaaagugaugccagcuuucucaugaccgaagaaauacguaguugagucaauagcaucaugaccaucccaucaggauacagaagagcauuggcucugagcccagagaucaggaucuaggcuugguuuauuugcccaugaggaaaccgauucacuuucugggucuguuuaaggaaagaaggaaggggacgaggaaucuaagagacuccaugaucauccgauggggcguucaugaugcuauugauucaacuacauacuucuugggucaugagaaagcugacaucacuuuaauuuucucccuucaacuacagaaauuaagcaucucuuauucugauugacuugcccaagcuuaauuuuucauuuauuuuuaauuuugaauuuuaaguuagauccuaaauggaagaauucaggauuuuagagaacauuucuugauuauuuuagcacauuaugaauuggacuauuucaaaugcaauuuuaaaacauaaaauccacagacauugaaacgcuuucacgggugacuggacaaucacuuaaaauuuauguaagaaaaguaucaaaauuagccaauugcagcaaaaauauuacauccuaaaaaccacauauaauugucaauauuguuaauuuuuacaaagaauaauuauaucaauuguuuuaauaaacaauuggaagguguuagaaguaaaaucuaacacaacaauuuauaauuauuacuuauauucuuaguugcuugauaaugcuaaaagagauacacauuucugaagauuaaauuauuuuaauucuagaacauuaaaaaaguaucugaauaaauuaagaaaaauauucauggcugcaguuaccugggaccaguaagaauaaauguaugaccuugagcaaguguaaaauaaaagauuuaaucccauucagguaaaacaugucauauuucccucucuuuuugcuaauauuuagccuagcacaacaguacagcccuuguuguaaauaccagagaauuguaacacacacacacacacacacacacacacacgcuuauauguucuauaucagucuucuuuacuaaaucaagaucugguucacaguagcuggaguggcaacauauuaaguauuugucuaauugauuugaaauaaugacuauucuaauccacccacuuagcaacauugacucaugccuggaaggagaacagggccauauuuuuaccauaacaugcaugaauggauuuaggacaaauugggcgucuugcuuggugacuaugggacccucccuuacuguucuguauuugugcugacuucccugagguagcugguuuauuuucuccccagugaggaagagagcaaacuguagagacauaaagugaaagcugaaaaaauacauaauucagucuacucugcuuccacugcuuucuguacugaagaacauuucagagaaacaaguauuuuggaggcuucuggcacugcccccucacuaggcccugagacaccuuuggugcagagugaggacgggugcuuauaugaacaccuucaaguccaucaucuguaauucuguccacaucagcauaauauaagccagaauuucuuuauagcuuaugaauuugccacccagaaaacaacuaauauuuauugaauauaggaauucagugucauaacaccugguuggcuguauguauucaauguaaacuuugguuucuauaacuuucaaacuaccaaacuuaguuaacuccuacccaaggccuagauuuauaacaaagacuuauuuccaauuuuuguauuucaugacuaaaguugaugagacucuggaguucaaaaugaagaaaaugucucaauuacuaaaccacaaugcugugguuaagaauaaauuagcuaaaucaaguaaaaauaaaggaaaaaguguaaaauuuuagacauaugugagaaaaacaagacaagaauguuuuuccaaguggcucugugugagucgcaguggaugcuauuuauaaagguuuuauacauagcaugagaagccuugcaaagagaccauuuauagacauugacaaacagagaagugcaaugcuagggauuauggagacaaugaagugggagggccaggacuccgaucacuugaaacuucucaaguggaacugcuacaagauguugaaaaggugggaugcauacacggaacauacagauaauucucucugcaggggcaacagcugggguaauguagcucccaugugacagugguagaaaacaaauuccuugucagccauucaucuaacccaucuugggcggacagccaggauccuaacaaauugcugggagaagcagucuugcuuuucuuucucuuucucuuucucuuucucucuuucucucucuaucucucugucucucuuucucucuuucucuuucuuucuucuuucauuuauuuauuuggagacagcaucuugcucugucacccaggcuggauugaagugguaugaucacagcccacugcagccuugaacuccggggcucaagcaaucuuccugccucagccuccugaguagcuaggauuacagggaggcaccaccauguccagcuaauuuuuguauuuuuguguagagauggggucucucuauguugcaggcugaucuugaacucguaggcucaagccauuuuccugccuuggccuuccaaaguguuggaauuacaggugggaacugcacccagcuucagccuugauuuugaaaacaaguagaagaccugacacggcccuucagggcucaaucaccagcccuuuaguuacauacugcuucauaauaugacauaauauuuuagaaucugauuuaguuuaugacugacuacuauguauuuugucacuugaauugucuuguaaauaauauaguuuuaagauuuagaaacuggcuuuaaaccuuaaaauuuaaacugauuguaaccucaaaauuuaagguuagaaaaggagcuuugcaacuuuaaaacaucuauuuuuuguucuuuucuaauuucuaguuuuccaauuuccaaacuccuggauuugacagcuaccacagaaaagcuccaauauuuauguuagaaauauuuucuuuuucuauuaaagggucauuauuccauagugauccuuuucuuuauuuuuagugauccaagugagauuuauuucuccaaaauuugaaagaguuagaugauuugauaaaucauucccucuugaaauuuagaaagguuuugaaaugugaauuaggaaaaugaaaguuagaguccugagguuagcgagauugauuaguggaagcugcaagcaagaauuuccacguuaaggccuaaacuguguuuuaaacaguucuguugcacuacaggcaaaagaugaccaugucugcuugauggcuguuuuuuuuguuuuuuuguuuuugagguggagucuggcuguguugccuaggcuggagugcaguggcacaaucucggccuacugcaaccucuaccucccggguucaaggggaucuccugccucagccucccaaguagcugggacuacaggugugcgccaccaugcccagcuaauuuuuguauuuuuuaguagagaugggguuucaccauguuguccaggcugguuucaaacucugaccucauaugauccaccuaccuuggccucccaaagugcugggauuacaggcaugagccaccaugcccggccuugauuauuuuucuuauaaauaaaguagaagcaaccauuguuaggagcucccccacuuuggguggaaaugauuuugccaagaaugaaaauaaaaugcuguuucuguaguauccauuuuacagcaaauucuauuaaaaagugaaauagaaaaugucauuagacaagagccaauauuuauagggccaaauagccaugcaagugagguacaaacaaugacuuuuaaauauguugcauagagaaauucaccacuuucgcuacacacaaauguuuuuaaugcacuuacacacaucuuugcuagggaugaccacugguuaaaaaaaacagaacaaagaaaauucaugugucucuucgguguccucuuuuuucagugauuuuccacuccccacucugccacucaauauccuuuuguuaagagacacauugcaaagaaucugauaacauaauccacaaugagauacuguaucuaaugauacuuaacguuucuaagacaauaaugggaacaauacuuaacucaaagggaaauaaaugcugcagagggaacuugaggccccagagaacgguuaauaaaaagacagcuugaauggaaagagagguccuccagucacugaagguccaccauguagauaauaaccagacacacuggugaagugugcaaauuucagauacaguuacacuuaccagugucuauuuuccuacaaaccacaacauucucucuaagcacaauagaggcaagcauaaaacuuuucuaaguaucagggaguaacagguguaaaacuuaacuugaauucguugaagcucuguacuagacuuuucugaaguuucaucuuguuuugcuuugacaauaauuauaccauacuaaagauuuaaaauugcuguuucccagacauuauuugauauaguuagagaaagugcuacauguuacaugaggaagggggucuaagauuauguaucuucuguauggccagacuagguggucaugcuuauaauuccagcgauuugggaggcugggguggagaaucgcuggagcccaggaguuugagccagccugggcaacauagagagacccugucuccacagaaauaauuuaaaaaauauuagcuacauaugguggugcaugccuguuuucagcuacuuaggaggcugaggugggauuacugacugagccaggaaacugaggcugccaugagccaugaucaugccauugcacuccauucugggugauagagagaaaucugucucaaaaaaguaauuuaaaaaaauuaaaaauaaaaauaaauuuuaugaaaagaaaaagaaagagaaacauauuuucuguggauguaucaaaaagagcauagauaaaaauuuuaaauguugcuauuuuuauacuuuugcuucucuguaucuauuuucuucuuuguuucauauuuuuguuuauuuucuguaaacucauuuauucuucaaaccucuccucuuucaaaacucauugagcccagagauaucccuuucuuuccuauuuaaauaugauuuuguauuuucacuacguucacauuaaaaugcuccuuuaaaaauauucauauuaaaauuuccuuagaguuuaugccauugauuaguauucagguugaaaacacuaaugaaguucucuuggaagcugcgguaggaaacugcuuuuggugacaugccccacuggguuuuucuaccauuucaaguugugcuucaaugaggcuccaagguuuaaagaaaaauuuauuuggaaaaacacgacgcuacucuuugacuuacagagcuuucgugugcgugucuuagcuacauaauuucuacaggaacacacaggacauuuggguugcagaugcaaaugauauguuuauugcuaucaaucauuuguaucaccagaucacuggaccagaggacaacuuguaaaaggauuucagaauggcauaaugggaagaaacacgcuaauaaaacgaugagacaugaagagaauuuaaaaauauacaaugaucagcugugaagaauuggccagguaacacacaguaaaauguuuacacuuacagaauaagucuguauguuuuuagcucuuaaaaccagagguguaugguucuaggagagauaucaccuauggcagcgaucuccaaccuuucuggcaccagggccaguguuuugggagacaauuuuuccacggacagguugggcuuggggguggguuuugggaugaaguuguuccacuucagaucaucaggcacuagauucucaugaguguucauccuagaucccuugcaugugcaguucacaguaggguuagugcuccuaugagaaucuaaugcgggcacucaucugacaggaggcagagcucaggugggaacauucgcuugcccacugggcaccuucugaugcuguggccggguuccuaacaagccauggaccaguauagguccguggccuggaggcugggaaccccugaccuacaguacaguuuucccagcccaggcaaaagggauacauacaaagauaacaauacuaggagauggagaacaaagucauuaaagaugcuauaauuuucaucacacuuuucuuaagaaaauuauuuguuuuucucaaaccaaaagacaucagcuuugauugguuuauuaauaaacaacaaaaaaugcuuuucuaacuuggagaaaaaaugcuuuucucaacuuugagaaaaaaauaagccugauuuuauaaguacucaaaccucucagaguuaguggguagcaaaggauuucauuauaaauauuucaucaauguaaacuugagauauuaaaugauaugacuaaaguuugacuagcucacaaccucaugcuacauauauauacacacacaaacacuauaugugugugccuauacauagcauauauauaaauuauauauaauaaaauacauaaaauuauauguauuacaucaucauguuacauauuauauaucauauaucacauauuauauacauuauauauaauuaucauacagcauuauauauuauauaugcauuauguauacauauagcaugcuuauauaugcuauauauuauauaguauaugguauaacguauacauguauauacauauauacauauagcaugcuuauauagcauuauauaugcuauauguacauauguauauacauguauauauuauuauauuauuauauauuauauauaguauuauauguauauacaauauagagcauuuauaagcaugcuaugugcauauauguguauauacauauauagcauuaugcauauauguauuauauauacauauauagcauuaugcauauauguauuauauauacauauauagcauuaugcauauauuauauauacauauauagcauuaugcauauauuauauauacauauauagcauuaugcauauauggauuauauauacauauauagcauuaugcauauauguauuauauauacauauauagcauuaugcauauauguauuauauauacauauauagcauuaugcauauauguauuauauauacauauauagcauuaugcauauauguauuauauauacauauauagcauuaugcauauauguauuauauauacauauauagcauuaugcauauauguauuauauauacauauauagcauuaugcauauauguauuauauauacauauauagcauuaugcauauauguauuauauauacauauauagcauuauguauauauguauuauauauacauauauguguauacacauauauaaugcuauauauaaugcuauauaauauauacauacauguguauauguauauaugcauauaauauauacauacauguguauauguauauaauauguacauacauguguauauguauauaauauguacauacauguguauauguauauaauauguacauacauguguauauguauauauaauauauacauauauguguauacacauauauaauccuauauauagcauauauguauauacacaugcuauauaaauauauaauacauuauauaucuauguaucauauauaauauguauuauauauguauauauagcauuauagauauauacacacauacagauauauuuuuuauauauagcauuauagacguguguguguauauauauauacauauauauguguauauauauauauacauauauauauauguauauauauauauaaaaugauguuuacuuuuaaccugaaaacgaguuagucuuuugaggaugagaaaucauuuguacaauuuuaaauuuaauguacacauuacaauauacauuuaguagaggugagcgacauuauugccuacuucuccaaaucacuagaagcaaaauacaguguuccccauauuccaaacguuaguuugucauuaauacuuuugaaggcucucgaaacuacguuaugaacuguagcagacaguguuugccgaccuaacauccauuuccucuuuguugcuuuuggugguguuacuguugaccucagacaagccuugauuuuacucauuggguguccaguguccauccaguccucauauaauucaagggaagcgacucucuuuucucugcaagggagccaguccugaacuauccaagucaaccgaggcaaucccauuuccuugccgcuacuuggaugaaacauggggaugugacucagcuacagcgagagaggaugagaggcgugcugagaacaccuuugggaaggccgccgauuccugagaagaacauggcggcagagcagauggccucacccugccucuggaaauugcagugugugucugugagaacugaaaggguguggccaucuugaccccaagaugggagccaggcucaggacacgcagugaugccggaauggcucccaaauggcucccaaagcaucaggucagugggucaacuaauuccugagaucuguuccacccugacacuuccaucauauaggaaacugaauuuccuugcuuuuugaaucaguuugagucagaucagaauuuuuaguaagaacuaaagauuaaaccuuccuuaaauguauauuuuaaauuuccucuuaaaaauuaugacaauugugaucuuucaaagcacagaagaggaggaauucucuccuccauuugucuaggggcgaggaaguaaaucgcacggcagagacugcuagcuguucaaugaaagcgcaaggugagcuuuacuuuagugauacaaauugcagcuuuuagcuggguacguggcuacagaacucagacuaguuuucuauucuccuuugcaucuaaguguugguggucacacgaccaaguucugguuaaugaguuaugagcagaugcugcaagcccauuuuggcucuguucucaguaacaaguaagcccuuauaaacaaaaaagugaaucucagccucaguucaaagaggcagcgauaaaaggccuaagcaaauguaaagaaaaggggagcauguugguccuaaacuauucuuugguaaucacaguuuucaguuucuuuuuccuuucuucgugguaccaauuaauuuguaaaugcuaauguuuaaauagcagcauccaaucccugauuuucccuucuggucaaagcccagccaguggcugaauucaacacccuuuaccuuucuuuuuuuuccuagcacucaaugaaaccauuguauuuccugcuugaacagaccaaugaauaagugaucaaggaccauucuaaacugcagucuuccaguucuauaaacauuauuauucggauccaaaaaacuauuagcuagagccuauugauccucuagcucccuccuuuucagagcaccagcauacaaaucgucucauuugauuuccuucuagaagcacaagcugggcguggaagacuguacagauguagcaggaagguaugaauggccaacggcacaagaugaaacugaaagugacauuccuguuuuaauacuugcucuuugaccaagccuuuaagauuaaugaaucucggccgggugcgguggcucacgccuguaaucccagcacuuucagaggcugaggugggcagaucacaaggucaggagaucaauaucauccuggccaauauggugaaaccccaucucuauuaaaaauacacacacacacacacacacacacacacacacacacacacacacaaauuagccgggugugguggugcgccuguagucccagcuacucaggagucugagggaggagaaucgcuugaacccgggaggcggagaagguggugagcugagauugcgccacugcacuccagccuggcgacagagugagacucugucucagaaaaaaaaaaaaaaaagaaucucuuaguuuuuaagugaugagugguugggauugccaguuuugguuuuggcguagacucaagagacaaaaauacaagcuggcagguccuauagugaaauuuggagugaauccuguagcagcugaugaggaacuaugagacaguggccuguguugcuggauagaggcaucccacuguccacucguugguguauguucucauaaauucacaaucauucuuucaaauguggcucaacaauccgauacuaaggagcacuaccugaaaucacaaagacaguuucuuugugaauauugcaccuucuucauagcuguugguucuuagcacuguuguguguucaaucuuucauuagauuauauacuccuuaagacaggaucaggaguuauauuuuguugaauauacacuauguugaugucauaugaaauaaaauuuaaguguauauuuguguaccauaugaggagaaauaaacaauauuaugugugaauuuuacauuuauucuaauuuucauucauaucaguucaaucuuucucacuuuucaggauacauagccagagucaauauuggugaggaggucaggaagagguaggaaaacgacuggugguugaauugacuggaaucaaagggggagacugauucuaauugacaugaggcagaaaaauaaaaaauagcucaggauugaaaugacacaaaguuuuauauauauauuuauauauauuuauuuuauauauagauauauauguuauauauaugucauauacauguuauauauguuauauaugaauguauguuauauauauaaaauucuaugcuaccauacaauuacagaaaacauaggauuuuaguuaaaaaauaaauguuaucuucauggauaucauuggccuuuugauugcauuuguugacuacaugaaacuauggacaaacaagugaauuuuuaaaauucuuucaucauauauuaguuaauuauuaauuauuaagucucuucacuuaaucaacauuuauuaaguucaugcuauacaccuggcugguauaugccugggucuggauacgaaguugaguaagauguauaauccagguuuaaagugcaaaaaaggaauccauguaauuuagaaaagaaaugacauguuuacguuggauaauuauucccauguuuucacagugggagauuaucuugaaacacuacucccuuauacuuaauugccuccaggcauggugacagggugaucuuuagaauaugcacaaauccaaaggaucaaguuuauagcaaacaaaaagagaacagggagcaaucugguuaugacaucagucaccuccuaauuggggggauauuugcuggcuagcugaguugcuuucaagcuagaggguucuaaccaauuaguauauaagagagcauauggcuaugcaaaaaaaaaaaaaaaaaaggacuaggcuuugaauucugguucuacuacuuacuaacuuugugcccuuuuacaagaaagagcacuuuucugagucucaguaugaagugauauuuaaaauaucucaucaggugcugaugacacaugacaguaagucucgcggcuuacagacacugugaaaggacaaacacguggggauucucaacaaacagcagcuaugggauuguuauuguguuugcuguugucauuguuuuuaauuauuaauagcacacagauuauauacuccauuuuuaaucuauuaaaugauuccuaucagguagcacaaaguggcaggguguguauuauaaagaaggagucaggcagggaguguauuauaauuaauuuauuauuauuagcauuauuauuauuauuaucauuauuauuauuauuauacuuuaaguuuuaggguacaugugcacaacaugcaguuuuguuacauauguauacauaugccauguuggugugccgcaaccauuaacuugucauuuagcauuagguauaucuccuaaugcuauccaggguguguauuauaaagaaggagucaggcugugggucuuuugaauacuguuuuucacgggagcaacaucccaaacugcaugucccacuaacggugggaugaagacagcucugucaggccguggugugguggcagguagcacaggucccagaauuagaagcucuggguuccuggcugagcucuacugccuccuagcuguguuacucaaccucccugugaccucaguuuuccuacuaaauggggauaauaauaacaucuaccucguagcacaguuagugaggauuaaaucagucaaaaugcguaaaaucuuuauaacaauaguuagaaaacaccaugcaccaaaauaugcuaguuauguuauauuacagaguaugucacagacuaaauuaagguuugacaucaaauuaaauaagacggccaggccaguggcucacaccuguaaucccagcacucugggaggccaaggugagcagaucaccugaggucagaaguucgagaccaaccuggccaacauggugaaacccugucucuacugaaaauaaaaaaaauuagcugggcaugguggcgcacaccuguaaucccagcuacucgggagacugacguaggagaauugcuugaaucugggaggcagaaguugcagugaacugagaucucaccacugcacuccagccugggggacacagugagacucuaucucaaaaaaaaaaaaauuaaaugagacaauuaaagaagaaaaauucaauauuagaaauuagacuagauagagaguuuuuuuuaauggaggaauaauuagauagauaccaaauaacguugucuguguuagaccaucguggccaggggaccuauaguuccuaucuggauugcagccaaaauggaaccugcaggcaucaagcaaggucuguuaagagauaaagaauaccaaggugauagagcuuuaaaaaaaucugugcuuucaacagcuucagaauucccugucuaaucaguaacagcuuaucaagcaugagaugggagaaaaacagucaucggggcuccagauggaaauguuuaaugcauaugcaguuuauaggaugaauauaaauugcaaacaugguacaugguaguuuuugguuaaucugcugaacaaaaaaaguauugacuuuguucuacuuuaauuaaugaguaacugaauauuugauacagcaacguacuuaacucuuucacagaaagucaacggccagugauuucgcagauaaaguuggcauugucaggguuauuuucauuauacauguaauucuuucaagguauauuuugcagcagagauaaagucuuauauguauugcgauccucucuuugugcugaugaaaaauaucuaucaaucuacuuaauugugcagcauacauuggagaaaaauguaaguaucauuuaaaauguuuggcacucuuugaaaggaaggaagguauaucagaugucauagacaagagaacuaauaauauacccuguuaguugguaguaagaagccugaaaauguaaaaaguaauaauguggagugaauaaagugauauguucugucuacagcuauuucuuuaucuguaaucuguguaucuugaagccuauuuuaauugcauacguauuacauuuauauaguacuugcuauauguuccagaaccuuuacaaaguuaccugaugcaauccucauaaucacccuauuaugaggguacuaucauuauucucauuuuauagguaagaaaacugaggcacagaaaggcuaaguaacuugcccaaggaagcuagaaaaugucaaagcuugaaauuucaagcuaggcuggcuuuuguacucaaccacuccacugggcuguguagcuagaugguacccaaaaugaaccugcauacauuauuuauguauuugguguguauccauugacaagagugguaaaagacuggagaaacagucagaaaauauuuuacuauuagauaagguuucaggaaguacggggaucuugcgucuaccuaagaauaugaaacggcucaucaccaguguugcuuugagucuuuuccuuuugugaaguugaaucauacaugcaucuuuuguuuccacuaaauaaagugugcaauugaaaaaaaagcauuucugcuaaucauaauugcauucacuuucuccagauaccaaagagaaaagaauuagggccaccuguaauuuuagaacuaaagauacaaauguagguuacuuuuauaaggaaaaaaagaaaaguuaauuuuuuuaaauaauaaauuuguuuuaguaaaaaaaagauuaaaaucugaguuguagacacaauagggcuaaauuggaaaacaauggaaaaaagaauuuaaggaugagaaaauacuuuuuuaaauuuucucagauuaaaauuaguuuuauauuaagaagcuaaacgauauauuuucuaaguaauucaauuaaaacaucuaauaccauaguaucugugggaggaaacgaagcaguuguguuuuaaagaaacucaggaaacuaauacaauguuccuuauuugccagcugagggguuauugcuauacauuuguagcaacguccauuaaaagagaaguagcuauuuuaaaaugcaaauagcuaguuugaccuucacaaugcucuuuuucuucuuguuuucuaaauuauaaaucuugcauucuuuuugauaguaaagccagaacgucuauuaaaguagaaaauauaaacagcuuaaacauugcauauuauucaucacccauaguauuaaugaaauuuacacugacagaaguaacaaggaacaacauccugaagucuuugguugacuuuuuaaauuguguucaugauuaaaacucauauacuuuucaucacuaauaaaaaugcagcagauuaaaaauugcuuugaaagucauaacugauuucacuuagaaauuuauucacuuaaaaauacuacccaucugacaaagggcuaauauccagaaucuacaaagaacuuaaacaaauuugcaagaaaaaaucaaacaaccccaucaaaaagugggcaaaggauaugaacagacacuucucaaaagaagacauuuaugcagccaacagacacaugaaaaaaugcucaucaucacuggccaucggggaaaugcaaaucaaaaccacaaugagauaccaucucacaccaguuagaaugguguucauuaacaagucaggaaacaaccggugcuggagaggauguggagaaauaggaacacuuuuacacuguuggugggacuguaaacuaguucaaccuuuguggaagacaguguggcgauuccucaaggaucuagaacuagaaauacuauuugacccagcugucccauuacuggguauauacccaaaggauuauaaaucaugcugcuauaaagacacuugcacacguauguuuacugcagcacuauucacaauagcaaagacuuggaaccaacccaaauguccaucaaugauagacuggauuaagaaaauguggcauauauacaccauggaauacuacgcagccauaaaaaaggaugaguucagguucuuuguagggaaauggaugaagcuggaaaccaucauucugagcaaacuaucgcagguacagaaaaccaaacaccacauguucucacucauagaugggaauugaacaaugagaauauuuggacacaggguggggaacaucacacacuggggccuaucgugggguagggggaagggggagggauagcauuaggagauauaccuaauguaaaugaccaguuaauggguguagcacaccaacauggcacauguauacauauguaacaaaccugcacguuguacacauguacccuagaacuuaaaguauaauuuaaaaaaaagaaaaaagaagaaauuuauucauuuaaaaauaucauauuaaaaauguuaugguauuucauacauucauauacuauuauuauuguuagucuggaaugcuugauggacauaaucuuaugaauuuucaaaauauuacuccccaaauagcaagaagaaccagaauccuuauaauaaagcuuucgugcuggguagagcuagaaggaaauguguuguaauaccaucuucaguucauguuaccacaagccauggggauuucuuaaguucuagauaaaugaguauauaaaaguaaaggaaauuaaaggaauguggcagucaagagaacccaggcuguagguuaaaucgacacauaagaauaggauacuaauacuucucauccaguaauuucaacuagaugugcaaucaauauuguuuacccacacaaaguacaaacaauuuacauaaaugaagcauuuauuuauaaaaugagauucaugagugaauuuuuauucccauguaucaaucuuuucacuauagcaaacuuaaaaguuucauaacugugaaggguccuuuugaaacuugccuauauucaacaaucagagaauaacauuacuguguacucuuaacgguguuugacaacuuccuaaaauggaccagacacuuauaucuuaaucucaauuuaauccucauccacaaucuggacccucacugagcuugguuauaaauguauugucuaauuaaaaaaaaugcuucagaaggagcaaaacaccauuagauaugccaagcacagcuauuaacauaguugaagcucugaaaucucaccccagaagguuuugagaauucuugauggcaaucucacuuucaauagaaacauacugaaaaugaaauaagacaaaacacaaaccuccugauauaggguauaauauuauuucaaagagccauaauauuauuuaaaugauugauuuucauuuuuaauaugauguauauuuuggccuauucuauuucacuggcacauuucuauuuauucauaucauucuacuuauaaauagaacuucuaaaagguuccauauaaguguaacaaaggaaagauaagaaagcaaguuuuuuacaucuaauggggcuuuugcauuaugaacaugaagaaaugcuaauccaugaugcggcuacugucagcauauuuucuuaaaugcuaacuggucaaccauagaaaugguggcaggaaaagaacuuagcagagaugaggauggggaggaaaagauggauugguagcagugccauaugcagaugugaggaaaugagcaaauauuuaucauagcuaaaugaggcacaucaucuguaauggggaaggggaauauaguuacuugccuaucugaacccauagcauaggccaaccaagcacaccauccaagaauaucaagcagaugauaaauggaagagcagauggagaucuccagaaacaacaaaagaagggaagcagaaugauuaucagggaaacacguugguuuugaggggcugccacugaaaauguuggaucuuaccuaugguucuucagccagggugaauagaaugaaauaaauucuacggagugcaauagcuagugaacugucauauaccaagaaauaauaauagguuaauugaauucaccaucuugauuccaaaagcaggcuguuuaaaagagcgaacaaaugaaaugccucaucuuuauccuauuaucugaugcuguguuucauuuggaaaugccacacugcauuuucugacucaaucuccuaaccccacccuucauccccauacuccauucacaucacccagguuuaaauuuccgucccuuccauaaacaacucaugcuauggucaccaacaacuucaauuuuacuaauuuccuggacaauauuuuaguccucaucuugcaugaucucuuagcagugcucaucccuggugcccauuucugucuuccuggcaugcuuucuugucacaucucccuucuagauuuccccugaccuaccugccacucauucucugucugcuuugaagcuuauguuccauuauucagccauuauuuuuagaucuaaggaccagucuuagaugcucuucuuuucucacccucuauucucacccuuaggugaucucauccaaacacgguuucaauuaccucuccuaugcauagcuaagucacaauuugucguuuguccuauccaagcugagaucuugacuccuuuauuuaguuauccacgcaacaccuuguagaugccguaaaggcacuucggauucaacauuuaccaugugugcucauuauuuagcugccacuuacaagcgagaacauacaguauuugugguuuuuuuuuuuuuuuuacauuccugcauuaguuuacuaaggaugaugcucuccaguuucauccgugucccugcaaaggacaugaucucauucuuuuuauggcuacauaguauuuuguggaauauauguaccacauuuucuuauccauaaaacaaaccugcauauguaguccugaacuuaaaauaaaaguuaaaaaaaaaaaaaaaagaaaaggcuuugggaggccgaggcggguggaucaugaggucaggagaucgagaccauccuggcuaacacggugaaaccccaucucuacuaaaaaugcaaaaaauuagccgggcgugguggcgggugccuguagucccagcuacuugggaggcugaggcaggagaauggugugaacccaggagguggagcuugcagugagccgagaucacaccacugcacuccagccugggcaacagagcaagacuccaucucaaaaaaaaaaaaaaaaaaaaaagaauaaaggaagaaaaggaaauaaagacccagaguguuaaguucaccuccucaaaaauaaaaaaaacaacagaugugugauccuuucuuuaaaucugagucucucccaucaguccauaccugcaugguauugcccaauaccagguaaaaccagacugacacaugggaggcauuuccagcacuuuuuuccaccacagcccacauguaacccacaaccaaguucuguagauuuuaccuucuaauagcucuucaauccucccagauauuuccacucugcuaccaccauccuagucuaggcugccaggucucacccuggcacugcagucauauccugugacagguguuaccaagucuucucuuucugccuucagaccuguccucuacaccacagccagagcaaggcuuacccagagcagacaugaucaugauaugcuuccuccauguccaucacuccaacacauacaaacuguuggcuuaagauaguuugguggcaucucuuuggguuucuaauggaaucaaaaccagaaaucaggaacauugccuaaaaagccaucuauugcaggauuugucaacucuccagccuuauuucauaccaaaucacccuucaaucucggugcugcagccacaccagccuugucuuucugccccaagaguucuguuuaugcucuuuuguuuaccugaaauaugacccuuccuccuaccuucaccuacuuuccaaagcucaaccagccaucaccucccuggagaaguucucccucagaucacuacugaagucacauuuccguuggcuucuauuaccuugagagcacuaccauccuccaggaugaguacaggugcaauaugaccuccacugugcagaucuguaaugucagucuccccacaaaggcagagacugguuuuuauuuucaucaugauacccugggcauauccagccccuaguacaugguugguucuuagucauuguuacugaaucaaugauuguuauuaugaccaaacaaaaguuuuugauacagauggccagaacucucaagaaugacuugaaacaagauauuugugauccucugucuaguacuacauagaccagcauuuuuggucauucauuaacuugcuaguugauucauucugugccacucccucagccuuaacuacccguaucuucuuuuccacaugucucacucuuacucauuuuacagaucucagcuuaaaugucacuuucucauauguggccagggaauaucuguuaagugaaugaugacccuaucaaguauucacugauugcuauaauuaggugccagagagcauacuagggccugggguuacaaaaauugauaugaagcuuuuucugccaucaggaacucauuucauauuuggggacugcaguuauguagagagauaauuaaagccuaauauaaaugguacaagagagggaugcaucuccugcuugcugaaagaugcacggggcaguccugcugcuguucccacagaguaugguuggaggaauguauacaucuuuuuuuuuuuuuugcaggauaaucugcuuuauaccuguuagcugaauaacuuuaaaaguaucacuucauuauuuguuaaaaagaagaaaaagucacuauuuuaaaacauugcuugaaaauuucuguuauggagaaaauuuaacuaaacacuuugaugggccauuugccgaugaaauuauaggcccuagagcaccagucagaaggcuggguugaauugcuuuacacagcaaaauaaaaggaaugugucuauggugaaacagcuggaagaagucaagcaagagucccacagaguugaagacacagagggauacauaaugagguccugggagaaaaagagaggccaaaccauauacccagguccugggccuggagugaagcaaauacacacacacacacacacacugccagugguaaauuuccuuuaauuaugcuucuuuugaaaacagaggucucugcuauuuaguuuuaaaucauguucugauacauuuccaucguaaaugagaagccuucucaaauaauuccuuaaaccuuccagccaacaauaugaguauauucaagagaaauuugugaaagcuaguuaaaguugccugacauggaauccguacucuaagaaggacauaaaaacauggggccuuaaucagcaguugcaucccugucuucuuucccuggcaaggcuauaugacucuuucaguuuaaugacaaaugcaaagcucuucaaauucccuggaaccacagguaggcuauauagaaaucaaagacuaaaauccuagcauuggguaaucucuggaucagaucagcauucuaacaguccuucugagcucucuaggacccaacuucugaucagacugucaguuaggaucucagaauuccccgaauauccguucuuaggugugguuaauacgaugacacuucucagagcauuugaaccuugaaaaugagcuaaccauaugugguuuuggcuacagaagaauugauagcucauuuuuccccgacaggcaaugugcuuuuucugccucugcauuuaugucuauuuauauuuuuauuugaguguuucggaugaaucuagucccccucaaaagauuccacgugaaaagagacuaugcuauauaccuaauuucccucugagauuguagauaggcacaauauauuuucuuuaaagugaaaacaaagcacauaaaauugcaauauguaaaaagcauaguacugagccagucuauuuuguuucugguugaaaagagauuuucaggucauuuguuugucagguacacauuaauaaaacaaauguugaaacugcagacauaucacaggucuuauuuauagccaaagcugucaaguuuccuguagaaauccagcugugaccgauagauuauuccucuaugcuguguugucuaauacugcagccacuaucccaauaugauuaauugaacuuaaauuuaaauuaguuaauaacaaaaauucuguuucucagccacuauagccacauuuugaaugcuccauagcuacauauggcuaguggcuacuguauugaacaaagcagaaguggaauauuuccucuaucacagaaaauucuauuggacaacucuaccuacuagaaaacagagaaugauaguaaguaagcaacuuugagauuagcagcuaaugaguuuggggaacuggaucuccgauugucagaaagggccagcuuuuauaucuuuacucaaucucuauguuacguaaagcuuuaauuccauuauuuaugugaccucuucccuccccuaccaacugcuuucuuacugucccaucccagaaagucauacuguuuguucuccgugaauagaauuuauuagaaaauaaaaaguaaauaguuggagaauauguggaagacagaauucugagauggccccuauauguccuugccucugggacaggugaccuguauaauccccuucuucugagggugaacagaaucugugaauaugauggguuuucuuuucugauuaugguuauguuauacagcauaguaaguggauuuaguauauguaauuaagguccuauaucagccagggauucacugaagaaacagaaccaggaugauagaguuugcauauuuaugcucucccccuacccugccauucuaacauugaaauguaauuccuaauguuggagguggggccuagugagagguguuugggucauggggguggaucccucauaaauggcucugugcccuuccccgggugaugagugaauucuugcucuauauuuuccccaugagaucugauuguuaaaaauggccuggcacuuccucucucuuucacucccucucucgccaugugaaaacagauuucccuugccuucugccacgaguaaaaguuucugaggucucaccagaagacgccagcacuuccuguacagccugcagaaccaugagccaaauaaacucuuuuguuuuauaaaugaccuagcugcagguauuccuuuacagcaaugcagaaaggacuaacacacgggaggauacacaaauauuaagauguauuucacgaaauuggcuuaugcaauguaggggaugauuuggcaguucugaaguccauaggacaggcugucaggaaaggcagacuggaaacucuugggaagaagcccaggaccagcuagacuauuggagauagccuccuuuacuuaaaguaaauuuauuauggaguuuguggccaagcgcaguggcucaugccuguaguuccagcacuuugggaggcugagguuggcggaucacgaguccaggagcucgagaccagccuggucaacauggugaaaccccaucucuacuaaaaauacaaaaguuagcuuggcgugguggcauaugccuguaaucccagcugcuugggagguggaggcaggagaaucagcuugaaccugggaggcggagguugcagugagcugagauugagucacugcacuucagccugggcgacagagcaagacuaugucuuggaaaaaacaaacaaacaaauaaauaaauaaagucaauuuauuauggaguuuaaucuugucuauaaaauacuuccauacaacaccuaaguuaauguuugauuggccaacccaagaagguagccuugccaaauggacacauacaacugaugcucacaggucuccaauuaguugauuuuaggucagaagagugaccauccuuagugggccugaguuaggcagaugaccccuuuaaaagaggauacagagauuugagauuuguagcaacaaaggcugucucuccugccaucccugaagaaguaaaccauccugaguucuauagcugcgauaaaaagacuucugccaacaguauucgagcuugcacaagaagccugaaucucagcccagaccacagccuaggcugacacgccgaugggcuaggccaugcccagacaccugguccacaaaaacaguaaaauaauaaaugucuguucuaaggcauaaguuuguggaaauugugccauauaagaaacuaacacaaaauggaaugggaagagaacaaccgaaugcgaaucgagaggauuagguaaguguggcacugagcugaggagacuucauaagauacucaacagaaugcuuguugaaauuauuuucuuucuaucaaugaagaauuucuuuguuucaucuuuaaggauaaagaaguugaagcucaaaaauuaaguaguuugcccaaagugaaauaguaccugucagauucaagauuuguauucuagggacaguucagauuaucucuucuuauggaugccugaauuaaugucggacagguggguuuuugauuagucacugcuacauuguaaauauuauagcauacucauaaaaaagaauuaugaaaaaauaccauucuuuggaauagcaauacacaguuuuuugaguuuaguagaucuaaucccucauugcccaaauguugguguccccucccaaaauucauguugaaaucugacccccaauaaaacagcauuuggagguggggccuuugugaguuaauuaggucaugaggguggaggccuuaugaaugggauuaguccuuuuuuuuuuuuuuuuuuuuuuuugagacggagucucacucugucaccaggcuggagugcauuggcgugaccuuggcucacugcaacuuccgccucaugaguuccagugauucuccugcuucagccuccugaguagcugagauuacaggugugugccaccaugcccggcuaauuuuuguauuuuuaguagagaugggguuucaccauguuggccaggauggccucggucucuugaccucgugauccacccaccucagccucccaaagugcugggauuacaggcgucagccaaugcgcccagccuagucccaccuuaagaagugaccagacagcuagcucguucucuucgcuauauggugauacaacaaggaacuagcagucugcaaccuuguacagggccuucacccaaacucgaugaugcuagcacccugaucuuagauuuccaguccccaaaacuauaagaaauaaauuuauauuguuuacaaucacccaaucuaugguaauuuguuacagcaaucuuaccugacuaaaagacagucuaacauguggucuucaaaauaaagaggaaauaaauacccaccaugguuggcauuagggaaagcaaaccuguuuaauuacugaugccaacauuuuuuaucuugacuauucucccccauuaugaguuugugcacccuuucucaguaagaaaaacucguuagagucugugugaacacuuacuagucuauaauugggaaugaacacagcaagaauuuuaggaaacuuaaaaucuccuguaaggcuuaaauagaauuuauaaaauccaauaugucagaauuuguuaccagauauaucuacaaggcaaaaacaauuuccagugugauaugcuguuuaguuuuauaaaaaggaaagcccaucuagaaggcaacuucagccaaccaugagcguggagaagccaccgucugcugugucaccuguccuguucucaucccggauuuggcaaguagaggugagauuugaaguagucugucguaugaugucuuggcuguaaugguaacagaacugacgaaauaaccuuagaacugacgacgaucugcugaaaguuacagucuaccagcaucuucaauucaguuuaaagaacuguuagggucauugagaaaacuuuuguucuuucuaauuaaauaauaggucagugugaccuuuguugccuucuaguuucuguacaucaagcuccuguugcagauaucaagcuuuugcuuuuagaccucugaauuaacuuguaagguuuuuuguuucuuuguuuuuuguuuuguuuuguuuuguuuuauaaaaccaccuuuuccaccuuuuuuauacuucagaguuuggaaaggagacagguacaaaagauaugagucaacuucaugagaaaaucaccgucuuuauuuucuuaauuuuccuaauuaaaacuccuaauuuuaauauugacuaaaauguaaguaaaaucagaaauauauuucuaaugauuuuuacuuauaauaauuucuacuucuaacaaucaacuuaaaaaugccuauuagcuuugugcaacuuacauuuugagaugcugagaagaguaggaauucaguauaauaaccaguuugugucuuuaagaaauugauaauggacuugaagaauauacuaaaaaagcauaauuaauuccucauaaaauuuuaagauacaagggaaacugaacauauaagugacaggauauaagaggaaaacuuuauccacacaacagacauguagguucaaaucugugucugccacuaaccagcuaguuggcaaccaacaaacuacagccacuccuaauguuguuuaccugguguuuaaauaugagaguuggaaaagaucaucuuaaauuguacuuaagaauuacacugccccaauuucugaauaguuaguuagaacaaauaggcucauacuuacaucaaaaguucaucuguagucaacuuaauuucauucuuauccaauauauuucuugacuuagaauacaaaauagccucuagugaagauucaaaugguugccauuugcuuaauaauuacuaugugcaagacauuuuccauuaaacuuuucaauuaauaauuaacaauauuaaauaacggcuauuaucacauucaccuuacauauaggaaacugagcuccaaaaaggucaaugacuugcuuaaggcuucauagcuaauaagggaagagcuggaauuuggacagggcuuuauauuacaguagauuucuuguccauuugugcauuuaaaacaaucucaucuaaacuauuuucuaucagaagcagaaauuagaagaaaaacauguauagaacagauuuacuuaauuucagaggcauuuaaauacucagcauuuuauuuuucauuuggacagguuaaacacuuucaucagcuuauuucauaaggaauuugagcucuugaaacugcaaaauugaugugggcuucacagucuuaguucuaaaaaucugugucuuucuggacugaaacaaggucagccaacugggaagauuuuaacauuuuuagaaaauggauuuguuuuauauaguuuuguuggagauggagagaaugauuuuccauucccuacaguaauuucuucuuuauuauucuuuauuuaaggauauauugacauugaauaaguccccucugcuauuaauugaauauuuugcaacuacuuacagaaaaauacacuauaagaacugugacuggagaugggaaagaaaugggaggaaagaaaggcggugugugugcauucaagguaauacaaacaacacucaccuuuugugaagaaugcuaugugaggcacagggaaaaugucaaaucucuauagaugguguggucagucaaagaauucuuccacaucauuuagcaggugagaugcuacccuuucaucaaguaucucacaagccucuuguuauacaauggagagguuuuuaugguaggauaugcacuuaacagcaauauacagagcaugugccuguuacuuuuuuccauuucauaaugugugaaacaaauuuaugaacuauuugucauaagaauucugauauaucaauuaaguugacauuggaguuuuaauaaucuuuuguuaaugcucacucaauacacuauuucuaggaacucuccaaaauuaaaaauuaaaaugacacauuaaauagcaugcuaaugguaagucagccuuuuaauacuacuuuaacaugccauuucaaaaggcuuaugaagugcuauacuuaaaaaccacuagaggacauuuguuaaagauugcaaacagugcuauuaacuaacauauuuuauauugauuucgaugaguugucccuauuucuuuccaucucucacuucucugucuuaucuuucucgaaagcugcuguaauucuuagcuaacuuacauauccuuacucuccuauaaugucaaaaugaucauacaauugugagaaauugaaacugugacuagauaagauuuuuuauacugcuuuuauauuuuuuauauuacacugcuuuuuuaaugugauauugaaaauauagauuuuagguacugucuaugguuuuaauuuuauauauaaauuaaaacugugacuagacaaggauuuuuaugacauaagugugcugagucuucuuugcaaauauaacuguuuuuaagucauuuugcuggacuuuauauuaauuacuagacauuuuugccucucauuccuguuucuccuaugaauuaauuuauuauuuaaaaauagcuuaaguguagacauucuuuacuuucuugggcccaauaugcuccuucauaguuccacugggcauacaacaauuauuuuuauuuuccagaaaaaaacugagauugcuguuaucuccuccucccuuaaaaaugcaucuauaaaauguccaaguguggaaaggaacccaagugugucccauaccugcgguuguaaaauuauccucuaguguaaauugcugagcaauuggccauuuuuuuuuaccaacaaagucauuucauauauaggauagauaaaagagggauucauucuuucacaacuauuuuaagaauaucuauuacaugcaaggcaaaaugcucacacucaaaguccacccauugaugacuucuaauagaaaugaaaacguacauguuaccuuaaauguaauauaguggaagagcauggggcuaagcacuaaaaccaaauccaauacgguucugcuacuaguuccuuauggggaagucucaggaggagccguuuccucuuucagggaguucucaguucuucaucugcaaacuuaauaguuggacuagaaaauacaugugaagccagccaccucuaaacauuuucuggcuccgugacuccagucuucuauucugcuuucaagucaaucagugcagagagaaaaucucuuuucugaguaguaucaauuauauuuugauuugaaggcaacuccuucuggaaaaugcuuauuucucugugugagcaucaagaccucauuuuuaugcuuauuuaauguuuaaggcauguuuucuugugagguuaagaacagacgcuagauaauaaaauucauuucagaguugagaauauaggaaguacaaacaguuacuacaugacucuaugcacuaccaaagggaagaacuaagaacaacagcagcaauaauaauaagggcuaauauguauaaauccuuaccuucagccagccauggugcuaagcacuuggcauuuauuaucuaauuuaaucuucaugacaaaucuaugaaguaagcauucuuauuccuauuaugaguggcaaaaaugggauuuggaaagcuuaagcaaucaucucaaauauacccauuuaguaaacguggcauuuauuuugucuuuaaacccaaaaggccaucucuuuugauuauaucauaucauuuauaauaaaagauaaugcuacacuucauaauaugguuaccacaaauaaucccugugcaugcauacucugcucuaaacuaaaaagugacauugggaaugacauugugaauaauucuuugaauuaauacaauuuuaagcauucuauaugauauuuaagcagggauaaauugugacauauaaaucacaauaauauacugauauuacacugcuuuuuuaaugugauauugaaaauauagauuguagguacugucuaugguuuuaauuuuauauauaucauaaagaacugguuuuuuuuuuuuuuuuuuuuuuuuuuuuuuuuuuuuuuuuuuugagacggagucucgcucugucgcccaggcuggagugcaguggugcgaucucggcucacugcaagcucugccucccggguucacuccauucuccugccucagccuccugaguagcugggacuacaggcgcccgccaccacgccuggcuaaauuuuuguauuuuuaguagagaugggguuucaccgugugagccaggauggucucaaucuccugaccucgugauccgcccaccucccaaagugcugggauuacaggcgugagccaccgugcccggccaaagaacuguuuuugaauuauguuauuaguauccgaauacuaaguauacuaguuuauucagcuaguguuuuuuuguuuuguuuuguuuuguuuucaaauaaaguaauugguugcuauuuugggauaauuauuuauagguggaccaucaacacauucccaauugauucaaguucccaagacugcaggaaaagcagcagagaaucacugaaucguggaggaggaaauacaaacaggggccacuguaaguaucacaacuagucucugggaacacaugaguguauacacacaugcaucacuguauguacauacaagugugugcacacaaugacacgauaagacccugaaauaaaaugaaaccaggauugacuuagaguaagccuuucgaaagaacagcaagauggaagcuuaaaauuaaaacugauaaauaaagggaugagaacuuuuaugugcaucugaauuuauacauugagauacaaaucuuguacauauuuuaaaaugauauuuaaagcaaauuauauauguuuuguauuuuucacaauuuugacuaaucauuuuuuuaauuuuauuuuacaaugguaaaaacacaugagaucuacucucuuaacaaauuuguaaguguucaaugcauuauuucugacuguaaguacaaugguguguagcacauuccuagaauuuauucaucuugcucaacuucaugcccauuaauaguaauucuacauuuccucuuccuccccggccccuggcacccaccgcucaacucuuugauucuaucaaugugacuauuuuagaugccuuauauaaguugaaucauacagcauuugucuuucagcgauuauaguaauauuugaauauuaguaauaaaguuauugaauauuaaugcagaaaaacauaaaaaagguuauccauaauacuacaucucagaaauaugauuaguauuuugauguaauuuuugcgcaguuuuuuucuuuuucuuuuucuauuuuuuuuuugagacagagucucgcucugucccccaggcuggagugcaguggcgcggucucggcucacugcaagcuccgccucccagguucacgccauucuccugccucagccuccagaguagcugggacuacaggcgcccgccaccacgccuggcuaauuuuuuuguauuuuuuaguagagacgggguuucaccguguuagccagauggucucuaucuccugaccucgugauccgcccgccucggccucccagagugcugagauuacaggcgugagccaccgcgcccggccccagauauuuuuuuuguacuuuuaguagagacaggguuucaccguguuugccaggauggucucgaucuccugaccuugugcuccaccuguguuugccucccaaaguguugggauuacaugcgugagccaucgugcccagccugcacauuuugaaaucaaacugcuaagugaaagagauauugaucuguauuaacaauuuuauauucugcuuuucuucaccuaauacauauuuuuguuguuguugccauuaaaauugcuuuaaauaauuugcaauggcuguucaacacaguuuauuugaccacuucccuuuuugucaugacuuucaaauaacuacucuuaggaaaaauuguacuauagauguacuguguuccccucaaggacagauacauuuuuuuuuuuaaauuguuacuuugggaccuuugagaauauggcaccacuaaacaagcaaauacauaaucgcucuuauuuuuacacuuagugauugaaugaauaaacaaaaaauuauuuuguccuucauuuucauauuguuaaaaugaagauaguuccuaaugaagauaguuguagcaguaucgugagguuuuaaauaaggaacuuagcacaauaucugaccuauaaucaaugauuaaucaauucuggauacaaacuauaauuauaguaguaaugauaguaauuauuauuauaaccauucuuucuaugaaucuguuaugcucugauuuuaugcugucuuuaagagguaacaugcuuugguagaaaggccaaaaauuaaagugacauugcuuguuaugagaguaaguuaauucacuucuucaacuucgguuuugucauuugcaaaaugggggaauaauuaccuguuuugcaucuuuguuguaaggacacaauauauaugagccagacacccuaaauaaaugcugcuuauugcucaguuccuagcuccaauauuuccuacuagguauaguucugaaucaagcuagugagaauuaaucuaacaaaugguuguuuaguuaaccaaaccacccacuauuuccucaauuaaaaagcaagcauggggauaguacuauacuuaauuuuguaaggugaacccauuguacaauuggaaauaagaucacagucaagaguaucuuuuuauuugcaaaaaaaaaaaaaaaaaaucagaauuaucauauaacccccuccccaguuuugugcucaagacucuuacuaaguaacuggauuaucugugccagacugagguugccuagaguuauccaaauagcucuuugagguggucaguccaauuuaaaugcaauaaaacauccuccaaaccaauuuaauggcaucaaccacuaaagcaaucguuugaacuuucaauagaacauauuuucacacuguguauuaugccccucuaggcacaacuccaaauaagcaugauuaagaugacacagugacuucauccucaaaaucagaagagcauucacauguaucauucaaauucuuaugacaacccuaagagguagggaggaauaggguguguggcauuuuaugugaauuggaaagguuuguuugggauugcuaagcacaucaccaaggagugguauuguguggugucacauggucaaugaagguguuauuaaaagugcaaaaaaacacacaaucaggccugcaucguuuacuuccuuaguaggaaaagagcccuuugagggacgggaaugguggcucaugccuguaaucccagcacuuugggaggccaaggcagguggaucacgaggucaggagcucaaaaccagccuguccaacauggugaaaccccgucucuacuaaaaauacaaaaauuagcugggcgugguggcacacaucuguagucccagcuacuugggaggcugaggcaagagaaucacuugaacccgggaggcagagguugcagugagccgagaucacgccacugcacuccagccuggaugacagagcgagacuccaucucaaaaagcaaaaacaaaaacaaaacaaacgaacaaaaaagaacccuuugagguggaagcuaagaaguggggcaaaguuauuuuauugauuuguuugcucuguuuuagagaaaaucagccuuuaugcuauuuaugaagguuaauguuucuuaaaugugaauagagugcgugaaaacaauauaaauuuuauucuguuagcaaaguguauucuauaauagaauagaauauaguguaauauacucuauagaacauacuauaucuauaauagaauauuagagaauacacuuugcuaacagacuacaaauuuauauuguuuugaaugucuacuuuuuuagcaaaagugaaaugcaaagaaacagcuauauaaauaauccccggccaaacuauguggcagaucuaaucaaucuccucuugaucccaaacuuaaauucacaauaaggaaaauguccaauuaaccaaaggagauuacagauucaaauugauccugguugaaaagaugauauccuuaauggcaaaauaaaaaguaaugccuaauuaauaaaaauaaaaccacuuagauugaaaauguuuagaaguaauguuguguaauucuccacaaaucacagacaaacgauaugagaauucaagaggucauuuucuuuugcaauauuuaugcugaugaggugacauaauaguauuuuuaucugcaguacauauauaggagaucuauauauguaggcauacuuuaacaccauaaauauuguccuuaucaauaugaagucuauggaaaucucagcaugcaguacgugcuuucugcaaauaacagacacugcuauauaaaucaaaugaauguugagucaauucuuacaaugugucaauuuuccuuucguaguuccuaggaacacaaugaacugauuucuaggugacacuuuagcaccaucuauaucagcaguucuuacccaggggcaguuuugccacuaggagacuuuuggguuaauuuugguugucacaacugagggaaauaugaugcacuucuaguauugaauggguagaagccagggauguugcaaaagauuccaguguacgagacagcccuuuccuccaaagccaagaauuauagagccagaaauaucaacaaugucgaggauggcaaacuuuaaucccuacugacaaaacuuuaucuuuacugaaaguugaaaaucuaauuuguuuuaaaacauuuaugugcucuuuuauuuuagaaagaagauauaagaagaagaaaaacuagauuaaagagaaagagcagcauaauuuuuaaaaaaaauagaagaaaugaggugauauagagucauuauggaaggucaggugauggaugaagcaggcuuuaggcucagcuguuugugggcaaguccaggcuggguccacacuguugguugacaaaggaggaaacacauugcauucuccuguuguuucaugauaucgacuucaaaugauuuauuuuacagcaagaucuuaaauaaauuuguagcauauuuuaacuuagacgcuguugaaaaggaucaucuuggccuggugcaguggcucacaccuguaaucccaacacuuugggaggccaagguagaaggauugcuuaagcccaggagucuaaaaccaacguggggaaaacaaacaaacaaacaaaccaaaaaaaaaauaaccccaucucuacaaaaauauaaauaaaaaaaauaagcuagggaugguggugugcaccuguagucccaguugcuucagaggcuggggcaggaggauugcuuaagcccaggaggucgaggcuacagugagucaugaucauaccacugcacugcagacucggugacagagugagaaugucuccaaaacaaacaaacaaaugaacaaacaaacaaacaaagcucauccagagauugaauugaaaccauuugccccacuguauuacucagauagccuucugggacccucacuggguagguuuuguugcaaaaauuacuaaccuugcuuuuguucguuaacuuuagcauuaguaaguauacauuauuuuguuucaacaaaaaacacacccacaccuguaauagauggacacagcaugcugaaauuuggaguagagauuaaugaccgaggcuguuaauccaaccauguucagaguccaacucaaaucaaagugagcucagucccuguccuuuggaacauagcaaaacccuguaaaaggauuugggggaaauaauuauauuuucuauggaagugcaaugccaugggaaagaggguuuuuuuuucccuuaauaaaacauuugcacuucaaaguuuaggaagcuacuuguccauuuucuaguuuauauuuaugauacacaaauacagccaacacagcaaguuuaaaagagcacauacagcuaaauagacaugauaaaugguugguuaagaaggaagaaauaauuuuuauaacagggaagaaaaacagggaaguuuuucuuuucuguucugauaacagggaagaaaaaauuuuauaugggauuuuacauguuguucauguuguugauuuggcuaaaguuaguaauuaaugcaaccuauacggugauauuaaauucggauuguuaaaucaaauuuacacaaagcaaacaucuuauguagagccaaagauuauuaauaauuguagaaaacaaaacauuaagagcuugugguauaaggccgaaaaguaaggcccaguuuaugugugcuuugacaucugggaaaagccuggagggucuccagugaccucacugcaagcuccccucccaacuuuguuccugcggauauguccuccaauaaaaagacgcugcuucccucggggaucaggcauauuccacuucuccuugaguauugggcuuccguucccuccuacccuacacccacagaauuauucgaacaagccaaucacauccuccggugggaaccagggggaagaccacucucuugauacaacaaauccugccucccgcagugucugauugcucacucuguucccaaggacaacccccauguccccugcgagacuugagaugccuuucucucaaagccuguguggaaaugccacuaauaaacugcuguuggucucaguugcuuuacgucaggugucagguguuccgucauacccauaaccccaggacaggaauccucccuuacccaugggauaaagaggagguaauuaaaacagagggacaagcaaagcaaggugggaucugauacacacugcauaguuccucaggcuuuuucuucuuucaucagacaugugcucucuggccuagaguaauagggacaguccuuaauaagcuaugcaguuuauugccucacgcagaagcauuucgguuaugaagcaucuccauuucauuccuccauggucaucuagcugauaagugauuuuccauagagccgugaucauaaaucuaaaguugcuaaguguuuaccauaagcaaccuaacacagggauaucuugcuaaaaacauuccauaaauaaggacuuuuuuccuagcaaauauuauuauuugggggugccugaggguagaguauucagauguuuacaaaaugauugguacggguugaaugcuuucuuuaauucuugagauuauucccccauuaauugguaauaaaagagaacacugacaguuucuuuaacuccuccuguccagccaaacgagcaugaaaggugaaaaaccuaauaugacaguauuuugagcaugugagaaaaauauacaugcuucauuuagaagcauagaaaauauaaaaaucucaaauugaaaaucuggauuacuucuuuucaagucuaacuauaaaagaucugauacuauucugauaggaguaagaauauuuaaucucugaaaaucacugauuucuaauucaaguaauuuaaauugcuugaaauuuuuaaagugugcauacuaaauaauuauuuuauuauguuguuacuuuuaauucaugaggacaauuacugccaucuuaaauauuugcucuucucucccuagcuaauuuaaauaggugauaaugaaaacuaacaacauaagaauaaaagcuaauaaaggaaucacuuauauauauuugcagcauuuuaaauuuuauugcuuuccuuacauuaaacggauuauaagugaaauguugauggacuguauaacuguaauuuaggcucuaguacucucugcaaucaucuaucauaaauaaaaauuaacauauauauaaaaaguaguuaacguaucucaggagguaagauuaccugagaaaauacacuaacugauauugauaaacuuucugcaccaaaaugcaauuaaagcuugaguuauguuuauuugcaagcuguucuccaaugaguacauuaugaagauuagucauuuaaauuuuucugcuggacauguagaaugcacaguacuagugagauacuuuucuuacuggauaucuccuauauauucuuacggugauaauugauaggccaaagcauuucuauggucauuagaauucacaaaauuguauuuucuguaggccaucacuaagauuauaaaaagcccuuacgggugaagaagaaacaaagaagaaugaaccagaggagagagguauuaaaugucagagaggaagcuaugcucuagauuguuaugcaggauuucuaggucugcgauuaauucgcuuaugcaagucgcauaacucuguggguuuugguuuccucguuaguaaaauagaggauugggcuggauggucucuugggaacuuuucagcuuugaaguucuuauagaguacacauauggcuccucuuuguaguaaucaaaauaucuuauuuauaaaccacagugaaacauaguucuuuuucauuacuuuauucuucucuuuaaccaggcaccaaaauguguauauauacuuuuguuuuaauauguuuacauuucuugggaaauuauuuuaugaaaaauuuuggacuaauauguauaauaaaaguuauacccucccuuauucuagaaaguauacuguuauucauauuucagagugacagacauaggucuaauugcauauuacucucugccagaaauuuuaauuugcuuuuaaaucgacacucuugauuuuauaugucaguuuaacuuugaaaguucuugagaguaaauuuaaauuuagauuuuacaguaauaugaugugacucuagcucuauaucagugacauauuaaauaguucuccaaaauauaagcuagcugccaauuguaacugucuuguuccuaaauauaaagguaggcucaccauguucucucacugaacaaagucaauuguaaguuucuuccaaguaaacaaauuacacuagaaaaaaaacaauuaaauacugauagcuguuuccccauagaauaaaaaauuagaacauauauuuccaugcuuuaaauuuguucauuucaaaugucacccucaaaugguaacccaggaaugagauccacugaguaucugauccacuagcuaucuaccuuagccaaccccugcaaaaaaggcuuauacccaaauuaugugaaaguaucuaucaugugcacuuucaucauuagccuuaucccuacaauaauauuuauauguacagaccaggaagucauuaucucaaacugacacugaaugacaauccacagcugucuauuacaaagcacuccaauucuaguuugaaacccaaacuauacuuaaaagcacuaaagaauacuacaugugcucaaaucuaaguuccagaucucuuaauggcaagaacaucucugguuacaacuuacaguauuuuuuuuaaaucuaauaacaugaaaacuuagaaacauagcauaucccaaauaugucauacagcacaugacaauuuuaauuaccucauuaauuaucaguuuaucuuguauaacuuggcagugauauuuauuaaaucuauuuuuauguuaaguuacuuuuauuuucacauuacucuggaucuugggugguuuuuuuuccucugauaagcaauccauauacauaacccaugaagcagccucaaaaaagugugauuuaaaauaauaaccagaaauaauaauacaaguuauacaaauauuuaaauuagaaaaaaacacugaguuauuugcugucuauagcucuguuugaacaucuauuauuauauuuaguuugguaauuauuucaauauuuuguaggccccuuagagcacuguucaauaugauacaauauaaucaugcccuguuccaccaauaaaagaaucuaugcauccucaaauaguaaucaguuuucacugagggaauaaauuacgccuguaucauuuacauuugaugucaguucauuucagcaaacauuuauuguguacagggagccugccauuuaaggggaugcuagugaugaauaaggugacacuugcugucuccuccucccaguaucuugcaguugacuuuauuuugaauuauuuuguuaaauauuccauuggaaauauuuauguaauauaaugguauaugauaucugauaaauauucauaugaaaauaaacacaugacucauuguggaaauucagaugauucucauuaaagacugcauuucaacugaaucuugaaagauaaaaaagauuggucagguaaaggaugauggagaggcuauuuugguuagagaaaguaucuccaaugacugccuguuaaacaagcaggucacucauguauuaggaaauauagcuuguauucauauuuggagcauaaaacacaauaugacuggauuuaagacuacagagguagucagugggugggcagaaauuaaauuucaaacaaacagcuuggacuuuauaggcaauguagcaucauuaacguguagucagcccagauguaauauggucagauuugcacuuaagauuuaaaauuagcaaaaugccuuuaaaauaguauaauucaauguuuuuauucuuauuaauauuaauaagauuaacaaaucugucacaaauauauugauccucuaagcaacauaauaauuuguauauuuuuguacacugaaaugagacuuauguugcuaacuaaaaacuccaaauaugaaauaaauuauguucuuaccucugugucucuuagucuuugaaaauguuaguucuugucuugaaugcuccuuuaccccuaauuucuguugcuucuuagugaaaccuuauuucauuaaucaacauaggcgaggcuugcuucucugucauagcauuuaucauagaguauuuaaacuauuaacuuauucauuuauucugccaaaaauucaucuccuugagggcagaguucaugcuuuagguuguuucuaaaugccugaaugcgauacagguucacugaauaaauugaagaaauuauaaacacaaaauauaaguaucugggaugcuucuguaugauacaaaauuaaacaucuaauuuaaguaggaacacacagguugacuuccagaacugauuuuuuauuuuuugcucacuuaaacugauguaaacauaaauucuuaaugauuuauauauauauauauauauacauauauauguauauauaauauuguguuuaauaguguuuccaaaaguccauguccagccaaaaccucaaagcguggccuuauuucaaaagugggucuuuguggauauagcuuguuaagauaaggucauccugguuuaggguagauccuaauuccaauaaccgauguccuuagaagaagacuauuugaagacacagagacacagacaaaagcgaagaaguucaugugaaugugaacccaaaggagagauugaaaugaggcagcaaugagccaaagaacaucaaggacuucuggccaccaccaggagaugggcgagggacauggaacuguuucucucuccaagcuuccagaaggaacuacccuugcuaacaccuugacuucagacugugcccucuagauccaugauagaauaccuuuccaucgucuuaaauuucaucuuaagauugcagaacuguuuuacagagaccccaggaaacuaacacaucuguacauggcagcaucucuugccugggaagaaugagagugaggggaguuagugugugacccuagaagaggguauucucacuagagaugcagacgugccaucaacacagcaugaaaaugaccaaacacugucuuuuacuuauuuguauuuaacuucuccugauauguuuucuuuuuuucucaggcagcaagacaguuuuccaucacgauuugcauugaaugacauacagguuuuauuauuuauucauccaaauuaaaagccuauauaaaaauuaguuucgauguguguaccuugguuucccaaggugccguccuuacuuuuaagaggacucugacuaaaaacuaauuaaguauuugccaucaaaaacgcucaguacuuuaaucagugcacuguguuuggcuuuuuaaaaugaauguuugaguaaugcagccauaaaugauuuuuugaaauuauuaaucugagaccucuuccuuuugcuuuaugaagucccacugguaucgcguaagaagauuagugucugcgcugugggagaaagcucacugaaucaaaaggcaugggacauauugcuaaguuuuaaaaauaacugcaugcacuuguuucaacuaaacuugagggaaaaccaaacguagaggaagcagaaugauuucaaaugaguuuagauuuauugaaauuggaauucauauuauauucaagacaagucaggaaguaggaacaauagaagcccuaaaggcuucagagcaguggccuggaacgaaauucuccaccuggaauagagucagcgucuuauuucagccuugagaaguaccucauuucucagaugacaaagugaucauggaggaacugcacaaaggaaagaugacaaacacaaggggaguugcaccagacacacagucaaacagaaacagugcucacauugugauuucucucucucucucuaguuuucuggcaaacuuugcagugaaagaagccccauucccucucuugcagguuuaagauagaucccagguacacccuuucaggaguuuccagacagauuagagaauucaucucucuuccacgggcaggaucaaaacuauguuucuccuugcugagacccuagaguacacagcacugcuauucucuaggaagccaaaauggggggcugugucuaaucuacauuccccacucaaaguuauaugauuccuuuucucauugaaaaauccaaagaaagcucuugagacaacaguucacuaagcucaagaacagaguaucaucuucuaaggacucauucuaguuugaacucuaguauagaaaauuuacauuagccaguaaauuuuuggaaguaacuuuuggaaaguguuucguaacaaauauguuuaacauauauauauuuuaaaauguaaacauguauauuuuucuuggaaaagagauaaguguaauuuucauucuucaaaaauaauaaaugaaaaagaaucuuaucuggacauuugguguacgcugugguaugaaugcguccuucaaaguucauguuuuggaaacuuaauccccaaugcaacaguguugagaggugggacuuuuaagacaugaguaggucacgagggcucuguuuccuguuaugagacaaugggaaaagaaggccuucgccagaugcaggucccuugaccuugagcuccccagccuccagaacgguaagaaauacaccuguguucuuucuagauuacccagucucagauauucuguuauaguaacacaaaacagacuaagacugugugguuaguaagaugacugguuauuacauuauugacaguaaagacaguuuucaggaugauuaaauuuuuguuuuccaaacuaagaaaaaacaauagagacugacacuuaaaacauaacuuuuauagguccuuuauguuauaaaaagacaugaaaaacauacaugauguuuugguuccucuaagcugcacugucuaauaugguagccaguagucacauuauuuaaauuugaauuuaaaugaauuaaaaauuaaauuaaauuaaaaauuugguuccacaguugucuuagcuauauuucacaugcuaguagccacauaugguuaguggcuagagcauauugacaacaucuacaucuuuguagaaaguucuaucagagaacauugcucaggccgauuuuugucuuuucuuuucuaaaauauauugacucuuguauuaguuucauguuguugcuauaacagauuaucccaaacuuaguggcuuaaaauaacagaaauuuguucuuucacaacuucggaggucagaaguuccaaagcagcaucacugagugaaaucgauguguuggcaagaucacauucccuccagagaaaaaucugccuuuugagcugcuggccuuccuuggcuuaucgccauaucacuacagccucugguuccaagguguucacauucucuccuucuuucccaucugugaaaucucucccugucuaccuuuuacaaugacacaugugauugcacuuagggcccaccuggcuaauguaaaauugccucuccccaggagaauggcgugaacccgggaggcagagcuugcagugagccgagaucacgccacugcacuccagccugagcaacagagcgagacuccaucucaaaaaaaaaaaaaaaaaaaaaaaaauugucucuccgugucaugauuguuaacuuagucacaucugcaaauacuuauaugcuuacaacuuccaagaauaaaggcuuuauguuaugauaggccauuacccaaccuacuacauccaacugaaaugcuacuuuuuaaauuuuguguugcuaaguuacuuacuccacuggcaucuauugauauaaauguuaauacaguuucccaaagcuauaugauuuucccccaaagggacuuauacaguggaaaagucucgcuuccugauuugcuucaguuauuuuuccuucuugucuuguaauugucaaagcccaggcuugauggaaaagcccaugacagcacaaacucacaacuuuauaaaucuacuuguaacaauuacagaacauguggucacaguuuaagucuacaccuguggaucuuaaguaacuucauugacaauguuugcuuuaaaauuauuauuguuaaaaaaaugucaccucaaaaauaaauacgugucuagcaauuguaaugagaaugaagaagaguugccugcaaaaacuacuuaaaacaaucaaacagaugauugcuauauagaugauagauauauaaauagauagauaaaugggaauccauagaaauaugagcaagauucuugaacacuuaaaaaaaagguauacguaugaccaauaagcauaaccucuuucaaaaaucagaaacaagcccaggugggcggaucaugaggucagcaaaucaagaccauccuggcuaauauggugaaaccccaucucuaguaaaaauacaaaaaaaaaaaaaaaaaaauuagccgggcguggugguggucaccuguagucccagcuacucgggaggcugaggcaggacaauggcaugaacccgggaggcagagcaugcagugagccaagauugcacaacugcacuccagccuggguggcaaaucgagacuacgucucaaaaaaaaaaaaaaaaaaaaagaaacauaacuuaacuaaaaugagacaugacaaacacucaccagaauggcuacacuuuuuuuuuuuuuuuuuuugacacggagucuggcucugucgcccagguuggaguacaguggugcaaucuuggcucacugcaagcuccaccucccggguucacgccauucuccugcuucagccuccugaguagcugggacuacaggcgcccgccacaaugcccaguuaauuuuguuuuguauuuuuaguagagacgggguuucaccguguuauccaggauggucucgaucuccugaccucgugauccgcccuccuuggccucccaaagugcugggauuacaggugugagccaccgcgcccggccuaaacuuuuaaacaauacuaaauaucuuaauuuguaagcaucaggaacuccaguuaauugcauuggagacuuuaaauugauauaaccaaauuagaaaaauuuguguuguuauuggccaaaggugaacacacauauaugcuaguuuguuauuacccccccaagucuauacccauuggaaacauuuuuaguaauucuguauaaauagccaacaucuagaaacaacucaaacguucaucagcaugaaauaaacaaaugauuguagaauauucacaagauagaauaauacugaggaaaagaaacuaauaucucuaauaucagcacagauaauucucagaaauaugauuuguaacuaaagaagucaaguguaaaauaaugcaucuuuuaugacuccaucugugugaaauuuuuuugaaaaacaagaacuaaucuuuggugauacaaaucaggugaauuuuuauguuuaaggaguugcaguaacugggagaaggccuacucagugguugcgggguguugacaugauguuuugauuaaacuguggacggucaggugggugcuuauuuugcugggauuaaaaacagaacggugauagugagcuuuggcacuguaccagacuaccuggguucccuuucagaccuaucacucaggcuaugugcuuuuggguaaauuuuaacuuuuacuauuuuuauuauuauuaacucuauuaaauuauuugucccacuucaucucacaaagaccaugucuuucucaucuacugugguaaugcuaccauuuaauauauuuaucacacaugaaaagugcucauuaaauaauugcuaauaaaauaaauugcacauacacguagucuccaugaaggauuauauauauauauaugcacguauauguguguguguguauguauauguguguguauauauaccuauauauaugugugugugugucuguauuuauuuacuaaaaguuaaacauggcucuuaacaaaauuugugauggucacaaaaauaucacauuuucuucuggccuucccgucaugaugcuaugcugagagcaagacuaugugugaacaugacacucuguucaugaaugucuagaccacauaggaccaaagauucuaauuuauguuagaccucuuuuugggccuuaccagaaaugcuaaauuuuccuuuuaaagagcuacauucuccugaagagcuaaaucuuuugucucucuacuaauuuuaucugcuacaauaaaaugguaaccaaauaaacaguuuuugagaauuuuuaaaugaccuccaugaccccuuuauuguaguuugcacauaacacuauugccuaugaauuaauaagacaguauucgggcacuauuauagcuaauauuuugaccaauuucuguuacuaaauguguacagaggugaaagcuucauauauucuuuuauauaaaauacuaagugucuagggcauuuuagaaagcuuguccaacgggggcauuugaaauuuucugcuuagugugaacucauuuuuguggguuuauaggaaugaguaggaaacgggcuaauaagagacuuuuugcauaacauagagaaaccaaauccccuccuuguucauacccagcaucuuuguucccccagggaauuguaacagcuggaagaaaaauuuccgggaaugaggaaaguauauuuuacuagggaauucauauuuugaagccaauguuugcaaaucacguguucguagauuaaauuuauacuaucuagcagucucauaaagaaacaacaaccacaacuggagauaaucuugaaagcaguucuguguugguaucgccuucacagaagcaaauaagcaaagauauauccucucaagaagaauucaccaucaaccuuggcccaaacaaauuuccacagauaaaauuuuaaagaaauugaggucacaguaaagaauauggauaagcauaaggauaaggauaaaaaggacagacaggcaaacaagauaagaagaaaaagagagaggaagaggaguaggagaaaacaaguaccauuugcaaaaauuagcagcaacaauagacagaagaauuauaaucccccaaauucauauguuggaauccuuagauauaugcauaauguauuuaagaaauaacaagggagcuuuaaaauauauuuaagggaaaauaaccucuuuagaugaccaaaucaauuugaaaaaauaaauuaaauuugguagagaaagcgucauugacuuuaaaacccagugauuggcuuuaguauaggaauaggcauaacugaagagagauacuuagugaacccgaaggaaguucuucgaaauguuuucaaaacccauaauaaagacccaaauacauagauaacaauauagguuuccccuuuuuaaauauuucauaaggcaaggcaauuuuauuaauaagcuuuauuauuuagucuauugaacaaaaaaaaccuuuccaaaucuucaaccuaaaguauaauuaagauauaugacaugucagucucuguacguguuuauaauauacauuuauaacaugcaaauagagacacaaccuuuuauuauauauauauguaucuaugcauagauacauauauauguaaaugagaagguaguuuauugucagagaaagcaaguaauguuaaauaauuuaaaauaaaacagcuuacuauuuaaauaaagauaaaaccugccacaaauuuaaacaauacgauacucacaguaagaacagccauaaacuucaauucugaguccaaugcgaccuucuccauuccaauccagaggcacuaugcgcacauagcgggcaauaaucggaugcuguaauucgugccggaccacaccgucagaguuaauguuuccgggaaaugccuggaaaaggaaauaguauuuuaaaaauugggaaaaauacuuuagaaacaaucauguccucugucuacuagaauaaacacaaaugucauccaaugguagggcuugugauuucuuacaccguaaauaauuugaagaaagcugcuuccuuacucuuaaugugaaaauagguccaguuuuaaguggaaaacaggucagauuuucugugggucuuuucauccauguaaacauacguuaaaagaaugaaagacuaaauggcauccacuguuguguuccauacacauugaaaugaguucuaauauuuugcauuuaauuuauacaauaaaugauuuuuauagcaucuaaccauaugucuugcucucuaaaauucuccuccacauuuucucccauaaaaccauuagaaauuuaaagauaacauuucaacauuagugagagaagaagaacaauugaacacguugugaagaggucaggguuuucuaccuuuuauuggaguagacacauuuagagaauuuguucaauggaucagaaacauguuaauucaguuuuuuucauuauagaagauucugucaaaagaauaauuauccaugaauuuuuaucugauacugaaaguucacauugucuuuuuuuuuaauuuuauuuuuuauuuuuuuccucucagcggagaacaaauggauuuuuugggaggcauacauaacgaucauucaacaaggauuuacaaacuaucuauuucauaaguuagagcaagauaauaugggauauucaaggaugugugaaaccauagacucgacucucaaaaaauuaccaucuaaugaaaaagaaaaugucaguauaaaguuauaauucaaggaagauuuaaagaaagaaacuauuauauuuuagaagauauaauucaaauaaaugaaagcuugugcuauuuuaaacaugagcaguuucagcuucauauaugcauucuaaaugucccuauaauagacaaguugaggcuuuagcauuaucuuuuagaagauauucucuuuucgauuuauuuaaauuaucuuaaaaucauacaaauaugcauucuaaaugucccuauaauagauaacuugagguuuuagccuuaucuuuuagaagauauuaacuuucagauuuaaauuaucuuaaaaucauacaaauagaaauuuuaaaaauuauuuuuuaaaucaugaaaagaugcaacacaggcauuauauuacauuguuaguauguugucuucuuugccuaaggacugaauuugcuucuaucuaaaaccaggaguuuugucuuuuaaaaaaauuaucuuuaauaaugauguuuuaaaguuagacuacucauacaaaguaaagagcgagagauguuuuuaauuaaaaaaaaauacagaguagcuucggaauugaaagcacuggcuuaaguucauccaagcaacacaaaugcaaguuuguaguagaucuguuauccaacccgcauuccccggucaaauuccugcgcuccgaaauacaaaauguguaauguaaggccuaguaauuaugagaaguauacugaaagauuuccuccgcauugaaacaauuuuauguaaccuuuagaugguaccagcaauccacauaauggauaauauuuagucuauaacauggacaauuacauguuuuaaaaauugggauguucuucugugacgauuccugcugugcucuucuugguuuucucaaaugagcugcguacuaccacugccuuuuaaaaauagccauacacuucuguaauccauaaaacaaaacuauuugagcaguaugucuugaauuuuaacacuuaauagagcauccucauugcaucuuguugacaaaauuucaucagaaaaacaauuucuaaaaagacauuuucuuuguagguacuuuucuagccagcuguuaguuuuacaaagaaucuaaaaaucuaaacaagcauuccauuaaaccauggcuauauuuucagaucucuauuggguucucuggcuucaaaugcaagaacaauuagaauccuugaccaaaaucacuugaauuaaaucuacaauuggauauggguuaauccaaaauuuaugaucuuaaauaauacucaacaaaagccaccaaacaauuucaacuugaaaauuaacuauaugcuuagcauguugcuagguuuuaugucaauauuuagaaaaacaacaaaaaucucuccugaaacacugucucuaagacaucugcagucuuaugaggccuaaaauaaaaucuaaaaagauauugcaaaaggcagcauuaaaaggaacuauggaagugcauuacguaacuaguaauuuuaccgauauuuggaguucccugaaggcuauguaaucaggcaaauucuacagaguuagagcucagcugcauagaaggacagagugguguuugaaagacaagagagaaaggggcuaggauauauugaagaauagguuggcauaaaggaggauuucagaccuaggguauaagacccagaguccagggauaguuaugcugaaauuuugcuuuguauggguagccucucuaggacuuaaaaaaaauacuuuuccuuuccccuguaugucucucacaaaaagauuugaugcgcuuauugguaaaaugaauuuuugaacuaagauuguagauucucgggaaacaugaaccaaggguguucaggaauacacaaggaauaggaauaaagacacaagucugacuggcagaaaguaguuauguugaaaaaaaucauaaaucuuuuaacagguucugucugauuagagacaaaauaauauagcauguauuguuguuguuguucuuguuguuaagaaauaacaauaaaagccauauuaaugagauccaggguaaugggaaaucauacugggagcaagaagauuagcaacaaguaauugaaggucaacaccaauguggugguaggggcaauaaauaaauaaaagacagauuugauauuucaaaagaagaauuauuaacaucuugaaagaagggaguagaagauauaaucaaccuauuccaagauauuagugugcaggcauuggugacagaaaagggaagagagggaaagauaugaugaacauuuauugcucgacugcucagcaaccucuucccuuugaguaauagcaucuggcuuuucuuuaaaaaguucacucuuaauauucuacucuuccccaggcgcaguggcucacaccuguaaucacagcacuuugggagaccaaggugggcugaucgcuugaggucaggaguucaagaccagucuggccaacaugcugauacccuaucucuacuaaaaauacaaaaaucagccagguguggucaugcacgccuguaaucccagcuacuuggaaggcugaggcaggagaaucacuugaacccaggaggcagggguuucagggaguugaaaucacgccacuguacuccagccugggugacagagccagacucugucucaaaaaaaaaaaaaaaaaaaaaaaaaaauucacucuuaauccauaugaugcuagagaggcagacacuacucccuaccaccaggggugggcaccuaacucaaugagacucaguuuuagcccuucugcuaaaaugcuucauucauacauuuacuuacguauuuauucauucaccuuucauucacucaggagauauuugagagucuucuauguagcagauauuguucaaaucaacaauguagacagaguugcaguuuucauggcauuuauauuauuaaacuacauagugagcuuuuuuucauaggcuuguuggccacuuuugaaaagugucuguucauauccuuuucccacuuuuuagcaggguuguuuuacucuuguaaauuuguuuaaguuccuuaucgaugcuggauauuagaccuuugucaggugcaaaguuugcaaauauuuuucccauucuauagauugucuguuauacucuguugacagcuucuuuugcugugcagaagcucuuagguuuaauuagaucccauuugucaauauuugcuuuguuaugauugcuuuucaugucuuuggcaugaaaucuuugcccauuccuauguccaggaugguauugccuagguugucuuccagaguuuuuauaauuuuggguuuuacauuuagguuuuggagaaaaggaaauacuuauacacuguuggugagcauggaaauuaguuuaaccauuguggaaagcaguaugaugauuccucaaagagcuaaaagaaaaacuaccauuugacccagcaaucccauuauggggaauauacucagaggaauauaaaucauucuaccacaaagacacaugcaugcaaauguucacucuggcacuauucacaauagcaaaggcauagaaucaacccagauuggaugaagaaaaugugcuacauauacaccauggaaaauuaugcagcaauaaaaaagaaugagauggagcuggagucuauuauacuuagcaaacaaaugcaggaacagaaaaccaaauaccacauguucucauuuguaagugggagcuaaaugaugagaacuaauaaacacaaagaaggaaacagcagacacuggggucuccuggagaguggaggguggaaggagggagaggagcagaaaggauaacuauuggguacugggcuuaauaccugggugaugaaauaaucuguacaacaaaccccugucacaugaguguuuaccuguguaacaaaccuucacauguacuccugaaccugaauaugugucuauauauauacacauacacacauacacauauauguauaccuacacauacaauacugacacuauguuauauguaauauguacauauuguuauauauguuuuuauauguaaauccuauaauuauacaauuacauauaucguuuaugcaaaggccagaaaggcaaauggcaugagcauacugugccuguuuguggggguagcaaggaagucaguauuguuggaagagugugaagaaggaaugaacaggggagaagauggagaggucaaggacagaaugaggagggccuguacauuaugaucacgcucuagauuucauuuaugugugcuggaagggaaaucuacuagagaguuuuaagcaagaaaguuauacaucuuauaauuuuuaacaaugaaagcacuaaaaucccccucucugaguaaagagaaauucccaagaagauaguagaagaccauugcauaauguaaaauacaaaaugauagaugaaauaauauggccacaagugcuucagagguuguucagggaggagagguuuggaacauugguguggaagaacagcaggacagcuaccacaccuugggaucuccaaugcacgcugagugaaaagaaaacaaacaaaacugcaggaauggaggugcucuucccacugagcuucuguuggccauuuugauauuacaaaggaguggaagucagagaaagacaaaguaagcacaucugcgaugacaucauuugagaaaucuaaauccagagcuugcuaagguguuuuggauuauuugaucuguuuccuuauuuguuuguuucugagcaacugaaauaacauugacuaauacaacaauauuugaagggaaagauaauuagugaagauuuagauauacugcauuugagauuucaccagcaaaauuaaaagauguuauuggacauuugagguuuagaauaauagugcuuuaccuaagguuugccuuugcuuuacuuauggaaaaaugcaugcuauauauuuucuucaggauucucaaaaucaauaguuugugcuucuguuguuauuuuuauuguuauauuuuauuuuuagagacagggucuggcucuaucacccaggcuagaguacaguggcacagucauagcuaacuguaacccuugaauuccugugaucaaacgauccucccaccuuagccuccugaguagcuaggacuauaggugugugccaauagauugugauuuuuccacuucuuucauccaagcauauugagauuuaagacauuuuccuaacugaagcuuuaaauauuucaaaagaauaccauaggcgugaaccauugauugucuugauuacaaagcuguaaauauaugugaaaugucuccauaaauaucaguauuugauaagguaggaaacauaaaaggagauguagccguugauuuaauaaaaacaacgucuaacauguauauaucuauuauuuaaacgguucuaguauagucuguauuguuugugccucaaagaaaacucuaaaauugucagggaugcuauuuuuucaaaucaggaaacagacucagagaaguuggccaacauggugaaaccccgucucugccaaaaauacaaaaaauuagccaggcaugguggcaugcaccuguaaucccagcuacucaggaggcugaggcaggagaaucacuugaaccugggagguggagguugcagugagccaagaucgcaccacugcacucuggccuggacaacaagagcgaaacuccaucucaauaaaaaaaaaaaaaaaaaaaagggaaaaaaaaaacaaaacuggaugucgaauaccuaguaaagacaaacuugggacaaaguaacaaguucuuccacucucuucauuugagaaucaaauugucaacuagaaauaaauaucuucccauuuauauacaauauauuuuauuuuugauauuuaauguuauauauuugaauaucaaauuuaaagucugauggaugcuuuuuaucauaucacuuuuuagauacacauuugauaucuggucuauuuauuagauaguacaucuaauauaguguucauauuuuacuucucuccuuauuuuuuauuucuacaaauuuuuacaaaaucaauaauauuauguuuucucacacauuuaccuaaaucaagcuucuuuugugauuaucagcacccaaaguccucugcaguuuuaauacaaguaauuuaaaaguuugaaugacacuguuuccuaaaaggaaagaagaauuugucagcuagggggcaucuuauuuaguaaauacuaaaguaaagaauaaacuaucauaggucuugaaaaggagcauuuuuucauaucacuuggcucuuuuaaaaacucauuuacaguuuuucauauaggugugaaaaggaaaaaaagauacacagcugaguuuuuauacaaucuuuaagauuuggaaaccugcaucaaaaauuaaaaacuuaaagcaaaguugaaucuuucuugcauagaacaauacucuuuauaaucaaaccuucauuuagacaaauaguauacaagugcuuugcagauacauaaaaaaugccagccaaauuuaucauugaaagaauaaaaaauccauuuacaacaacuugugaauuucauguucuggcuauuaaaucucucuuagaggcagugauuuguauauaugcuuagaauaggguuuauuauuauaauuaagauagcauauauguaucucacaaagcuugauguuaaggaaaguuaaaaucaauauaauaaaauguuaaaccuaugguucuacuuuuagaguucuugucuuauaaauuguacaaauacauaccaaaauuuagaacuuuuuuaacauauuguaagucauccacaauguuaauuuuagaauaaacaucccugaaguuuuaauaacugaaaauuuuccacuaggugcacuguuuuuucuagcuaaaacaauauuucagauggucuaagagguagugaagcaaagcauuucugcaaaguaccagacaguaaauauuuuaggcuuugcaggucacaugcuccucugucccauauuauuauucuuccuuuuuuuaaaaaauacacuugugaaauguaaaaauuauucauagcucacaaacuuuaaaagaacaggcguggacaagauuugucccaugggcuacaguuugccagcccauggacuaagagucuuugaaauuaaaucuuucuugcaaguuagacaggaugcacaagucuaagacuuuccagccaguugacaguuaagaaccaguaaacuuuggaaaaguauuuuguaaucacuuggaaaauauaauuuaucaaacuggaggagacuauauaaaguacuagaaguaugcuauguaugaugcaugaacuaacauuuuuuuuuucucaaauuuacuauuaugggguuugaaguguaacacaaauuauuuuaugaugagaauaaguauauuuauuccuaacuaaauccucacuuuuuaggagaccuaacauaaaagaucacaagcuccuauagcgaaugaaugagacucuguaucuucauguaaagguuuuacuuaagacuaaaaaaaagugccuaaaacaauuagcuauuguguaacuaaaucuaggaagagcuuuucgcuacugacaacaggucucauaggugggaacuuaugugagaaugacgugaauguucccuaaagugagagaucuuacuugcuuaaaacauaaaaugacucuguggcauugaaacacauauugacuauucuuuauguuaauauacuaaaccugugaucauuacaaucacuucccuuuaauugaaauuuuauuucuugccagauuuuagauuuuauuuuccccaugcuaacaacuuaugucaaaauguagaaauagauuuuccauuuugcggccuugaugugaguuuccaggacuagcuauauucccugcugaggcaggaagauaagaaggaccuucauaaaauacugcaccuguuacccuuccaaucuggccucuuccccuggagucucugcucauuaguuucaucuggcuggccuuccacaucuuguaggacucagcucagacagcacuuccugacaggagggaccuugccucgccaccccucaauccccucguuccauagggugccucauaguaggagaucagcaggacuuuuuuucugagcaccagucaggacucuacugauuaaagcaggaucuggucaaaacagaaugcgauaugggaggagggcagagaagugcuggauagagaagggcaggguccugguggggcuccacccuggggccugugcccacggaacuaagugcagacaggcauuucuguuuuugcgcucaaauguugcauuuucuaagaccacucuggcccuccacacccuucauccugugccuacaaaaacccugagacccuaguggacacagccacaagugucuggacaucgagaggagcagaggaguggaaaagcacaccggauucagccaagggacgcuggaggagagucuggcagcuggguggcccagcuccaggggaggaccagcuucccacuccaucccccuucugaccuccccauccaccucgcugagacccgccuccauucaguaaaaccuuacacccauucuugaagaccacaugugauccgauuuuucugauacaccaaggcaagaacccaggguacagaaagcucucuguccuugcaguaaggcagggggucuaauugaaccgauuaacacaagccaccugcagauggcaaaacuaagagagcacaagguaacacacacccacuagggcuucaggagcuguaaacacuaaacccuagacaccgccaugggguuugagcuccaugacaugcccaucugcacgcucucccuauggguuugagcaggggagcacugaagaagugagccacaccccuaucacuugcccugugaagaggaaaagggaaaacuccuguuucaaaugcagaaaauaaacaagcuaaaacgaagacggcaaagaaagcaaccucuaguuguccucauuguuuguuauccacaaauuauauuucauuagcuugcuaaaaggcacuccugccagcaccaagacaguuuacagauggcauggcaaugcccggaaauuaccuuacaugguauaaaaagagaggaauccuugguuccaggaaguccccacuccuuuucuagaaaauucaugaauuaccuggcccuuauuuagcauauaauuaaggaguagcuauaaauauagcuagccagcaaucuacaagugcuacucugcauauguccugcucugucuauggagcagccguuuuucccuacucuguuacucuaauaaacuugcuuugcuugcacuuuauucuguugguguacucuugaguucuuuccuguaugaagccaauaacucuccuggcuaagccccaauuugggaguuugccuguaucaagagcauccuguguuuuuuuuuuuuuuuuccccucuucacucaauugugauuacuucauuauguuuuugauuaacucccuaacugauucagaaguauguaagucagcugugagguuucagaccauaccucuuuggucccuguguaucugaugaccacaguguucaguggucaauaaaugugcuuaaguaaaugaauauaaaugugcauuuccaaauucccaucuaucuacauuucauaggucuuguuauuucuggauguacaaaaaccaguucuauuaccauugguaguuaaaaaccauauauuugauaauaucuuacaggaaaaaaaauagagcaugcuagacugacucaaaaagacaccaggguaauguguaaggguuuccuaguuguagggggaugucguuauaauuauguaauguggcuagaugucagagaucaugggauaaaaagaaaacaaucauggaaaaaucuugagagaacugccaggagagauguaaaaauuaaccccccaccccaaucaaauuuagcuuguucacuuggguaauucacuugaacuaugcuaaaaauacacucuuuuuuauugcaaaaucaugucaaacauugugagacaugccaacauauuccauauauauauauauauauauauauauauauauauauauauauacauauauauauaugcagcaauauccucucuagacccuacugcucuuuacccaaauaaauacaucuugucuucuuaauguugucaauguugugaaagcauuuuagaauaaucguacuagaagcauuaagaacagcauuauuuugcaagcaauaauuugacuuugaaaauuaauaaaguaaaaucuuaaaaaucugauucuugauuccuucucuuuauucuuuaggggcaucacaugaugaugguauucaauagguuuccuucuuugugaucauuuguucucagccuacucaacaaguggacugucuuuuuaauggcuuuauugccucccauaguuuauuuaucuccagucuaagucacuggcagaagaaccaucaauucuuuucuuacucucugacucccucuucuuccuucucuccaacuuccuuccuuuuucucucuccuuuuuuucucucuuucuuuccuuccuuccaucuuucuuuucuucuuuauuuccuuccuccccuccuuucuuguuuccuucuuuccagcguuuuacuauaauacaugauugauuuuugcccacaucacauuucaguauagaaagaaaaggacagaggagcacuguuccacauagucauucagggauccgggcucacuucauuugguuuuugucaucaacaucugauucucaaguccaccacagaaacagaagacaaacauauaggaaugaacuuaggauuuauggccagauuugaugaagaaaauaucacuucugcauacauuccauuggucauguaucauauugaucuuaaccuuaguguccaagagacuggaauaugugccacagaaggaaagugaaacagauuugauaaaugcauagugggguuacuugaugcucauucugaaauucugugcuuaccuauaucauaauacauuuuauaaugaauaguaaaauuauaauguuuacuauuugaucucucagugaaacugcagacuguucagggagcaauacgucauuuuuuuaaaaagaaugauaauaauuuuuaauacaguaaacugaaaaccagugaauaguuugauuaguuuugagaaaugugaucacucacgugacccucacucccuaucaagauauagaacauuuuauuaucccagaaauuagucucaucaauccccucagucaauauucuuuucaauuaaugccacuccucaccguguguauacacuuuucugauuucuauaaccauaguuaauuuugccuuuuguuuugacagagucuuuuucuguuguccgggcuggaaugcaguggcauggucucaacucacagaaaccuccaucucccagguucaagugauucuuccaccucagccuccugaguagcugggacuacaggcacaggccaccacgcccggcuaauuuuuguauuuuuaguagagaugagguuucaccacauugcccaggcuggucuggaacuccugaccucaagugaucugcccagcuuggccucccaaagugcugggauuacaggcaugggccucugcacccagccaauugugacuuuucuugaacuucauaauaaaguaaucaaacaucacuggcuucuuucacucagaacaauuuuguuaagauucccucauaucguuauuaucaguagcacauuucuauuuuucuguguacuauuucauugucuaaguuuacuauaaccuguacccauuuuuguauugauagauacugggauguuuccagguuuuuuuacuauuacaaauaaaauugcugugagcauuuguuacaaaugccuaggagaagaauuucuggauuauauaauggaugcauauuugaauuucuaagauauugacaaauaaauuuuuucagaugauaaucuaauauagcaucagaaaucuauuuuaaauuuuacucaaauauauuauuuuucuuuccaaaccuccuauaauuuuuucuuuauccuucaugucaagccauaagaaaggaugaaaauaauuagauaaaugcuauccauuuugugauauguuaaauaaauauuuagacaaacagaaauacaaaucuaacauuaucaaucuuggcaauguuaaaauacaaccuaagaagcagagguuuggagguagaaauggauacgaaaauguagaagaaauaaugugguaaauaauauacucaucuuccaagugaagagucaaauuauauuaccaaaauuugacagaagaguagaccuauuuguaaguauauuauuaaauguaauaaaauuaaccaauagagaauuaaaaauaucuauuauauauauuuuuugaggcagggucuugcgcuguagcccaggcugaagugcagugguguaaucacagcucacugcagccucaaaccccugggcucaagcaauccucccaccuuggccucuuaaagugcuaggauuacagacaugaaucaucaugccuggccuuaauauaacuucuaaaaguagucagauguguggaaaaguaagucagcuaacuaguaauugacccaagaagucauuaaccaauaggcaaauucuacauuuauaagcgaacaaauugauauaaaaguauaaagggagaguggaacaggaaauaagaagauauuggggaaaaagaacuuuaccguuaaaugaacuuauuucucuacaaauugauuaaaaauacuuaucuauguacuagcuugauaaaaauaugaaaaaccaaaaacaauuguugcauaggagggugucuaaaaauuuggcuuuaaaauuucuggcauaucacauaaaugcagacagaauuaguuucaaggcucaucuuaaauaaaaucuaaccaguugcuugcagaagcauaauacucaagguacugagcccagaaagaaacuucccaaauccucacauaaaagaaacuaugcuacauaaagaaugaaguguucaagaaaauccauauaaaaacagcaacaaauuucauaggaaauacauuacaguuuuccucaauguagccccauggaaaaaugccaaaccucagcucaguaaacacaaauuuauagcaguaaccaacacuuuugaugcagauagauauucagcucccuacugacaagcuuacucuagaaauuguuuacaguaucuagaagaacagauagauuauacugcccucagguuacccuccaaaaccauugcuuuucgcagguauuuguuaaguauuaauggcagcaaauaugaugauauacucuuuggaaaguacuugggauaaaauauuuuucugaauguggaaccaagagcuuuuuauaagcauacaaucaacaaaauuaucaaguuuuaguuaaugugagaauuauuugugauagcaagguaaauuaccaucuuucaauuuuaucuuuuucaaaaugugaaauucuuuaguuggauaaauuuaugccaugaaauauuaauaauucuaauacuaaauguaaugucugauuugagcauuaacaauuuuacucuuccucaauuucauaugcuuccauuuuuauuaucuauuggaugauuaauaccagguaauguuucuucaaaauauagaagagcuaaaauaagugacaauucuugggucuacagaagccauuuuuuccaauauauuuggauuucaucuuuccugggaagaaaaaaaaaaaacccuuuuuacauuauguuucuccauuuguacugucugguuuucuauucccuuucacugcaaaacuucucuaauagaugguguuugcucaguuuuucccuccucuuccaugcucucuuaaacuuuagcaauuuguucguugcuguuucuucuuucaaaucaaaucagaaaaaucacugaugauaaugagguaacugaugauaaugaaauaaucuuuuuuaaaauucuucuugaauaucucccuuagucaucuucuccuggaaucuuucucacucaagaauguaucuuaggcccggcgcaguggcucacgccuguaauuccagcacuuugggaggccgaggcggguggaucaugaggucaggagauggagaccauccuggcuaacauggugaaaucccgucucuacuaaaaauacaaaaaauuagcugggcgugguggcgggugccuguggucccagcuacucgcgaggcugagacgggagaauggcgugaacccgagaggcggagcuugcagugagccgagaucgcaccacugcccuccagccugggcgacagagcgagacuccgucucaaaaaaaaaaaaaaaaaaaaaagaacauaucuuauuuugcauaugucuauuugaucugugauugcuucuccuuuaucuucauuggauuuuucuucuucuucuauggauuauuaaaggucaugcuguucucgcuacuuucucacaagugacaucaucugcuuuuuugucuucaaauguaaguucaacaggaauauuuugcuuauuccuguuauuuuguuauuaucuguuuccuucacuaccuagauuuauuuucugaccuccugagagccugguagcuuuaugcauaaucagucuaaucuagaaauaucucaaauguguauuuacugacaaacggauuaauaaaguguggucuagccacagucuacuacccaacuggccuucuucuacagucuaacaggggacaaauccuacucgggcuguuuaaucccaucuucucaucuaacucuauucucccuuguuccauuagcuauaccucuacggugccccuguauuccuuaacaucucucucggccucaacucuuuuaaugaaacaagccuaaagucuugauuucagagaaaaaauaaagaaaacaaacuccaccaaaugucuuuuaacuaacucaccuuuccaacucacuucuucaguuacaauauugcauuauuuuguauugaccucccaaacuucuugaagagacaauuucauauccaaacuuucaaggauagaagcucauuuccaucucucuucuacugugcuacaauuagucuucugcacuaauaaagugaaaucuaagccuucuuuauuaguuuuaacccuaaggaaccuuuuuggugcaguugguauucuuguaaugccuucuucuccaugagacugugaucccauuuguauucuuggacaagaacggcugacuuuuucaacucaaccuccuucuacgaggucucauucccaucuaaauauuggagacugauucccauauccacaucuccagcccuaaguuggauuuugagaucuaggccugaauuuccaacuuucuauuaaacaucuuuauuugaauggcuacaagauguuaacaaaaugccuuuuuaucaucaaaacuguguuuauuuucuauuuuccacccacaccauuugcugaugcugccauccuccuaguucuccagccagaaucucugucauguccauggcucuuguucuuccucacucacauucacaaugucccaggugcuggagguccugccucuccaguaacggcuuuucacgagucuggccacuguauuuggccaaacccuccuucuccccugagagcucuuagaaugcucucccugcuuccagucucucuuccaauucacuuuauaaacuguccaaaagggaaaucuuuuuaaaugaaaaucucagucugugagaaccuaauuacuuauccuaaaacauagaugcagguugccuuuuguucauacguugccaacucaauaaguugaaauaauaauuugcaaaauuaucacccuauguuuuguuuaagggauacugaaugauucaguuaacagauucuuuucaacaaauuaacauaauugacuuaauugaagcaauauguuuguuauauuggugucauccacauacaaacauuagguggcuuuuagaauuugaguuaaguagcugguuauacagcuucugauuuacagaagaucuaugcaguuuccaucuuuucuuuuguaaugaaagauuauccacuucuugugcaaugugaugggcauuacuugagugaugcuauauucccuuguacguaugaaaauuuuauuuguuuucuaagcugaauaauauaaaacuuuaaauagauggccacaacuuuaacuucugaacacauuuuccucaauuaaggggaagaaagagugacaugaggaauagagcacacauugaagauaaguaaguccccugaugcaaagcuauugucauaaaauguuauccaaagcaaguuuuuuuuuuucuuuuuuuuguuuuuuuuuuuuucuguucuguuuuguuuuguuuuuccuccuggaguaaucaggugugacagaugcagguuugcaauaauuuuaaggacuuuuuuuuuuuuuuuuagcacugagacaaagcuaauaagcaauggguuuuguuagccaauuacauacaaacagagauucugaggaauaaagaaguagagagcuuauuuugaaucugccuuuuugaauaaguauaccaaaaagcccccucaaaucaaggaacaagucuuaauagccauuagcuuauuuugagaauaaaacagugguaaucaagucuguuuuauucaaguucucuuuggaaaauauccugugaaacuaaccaggagaaacguaggcaugauagcauccuggggaaaaauaaaaagaaaaugaaagaaaaucucuaacagaaaaaaaaaaagacauuccaagaaugaacucaguguuauuugagaugauguauucauuuccauauuuaaguauuauuauaaauaugaaggaaacauuuuugaauucuauaaguaaaauucuaaaacauuuuauauuuguuaacaaaaauuaaaucgauggaaaaagcauaugucauucauguuuuucauuuauuuagaugugguaauauuuuguuagucuaaaaagcaaacaaaauuauacuuugggauccuaucaucuuauuuauauauuuuugauauuaguauucuacugucauuucuuucuccucagauacaaucuauguuucacacaaacaccugugcauuauaaugcuuucauacguaucucaggauccuaucuucaauuuuauauacacuaugaacuuucaaacaauguaaauacauuuauauuuugaaauccauaaaaacgaugucaggcugggcacgguggcacccagcacuuugggaugcugaggcagguggaucacuugaggucaggcauuccagaccguccuggccaacauggugaaacccugucucuacuaaaaaggcaaaaauuagccaggcgugguagcacacaccugugaucccagcuacucaggaggcugaggcaugagaauugcuugagcccaggaggcggagguugcagugaguccagaucgugucacugcauuucaccuugggugaucucaacaaauuaaaaaauauauaaaaauuuaaaaaaaaaaaaaacaacagcaacacaccuguaugucaaacaagcacaugcauuuagcuaucugagauauauacguguaauguauacacacacauacagaaugagagagauaggaacuuuaaaucacauaauaaucuguaaguuugauggguuuugccuuuauuuuuuaauuugaaauaauuuuagacucacauaguaguugcaaaaauaguugaugauacaguuuggauauguaucccugcccaaaucucauauggaauuguaauucccagcguuggaggugggaccuagugggaggugauuggaugauaugggagguuucuuugcccuugcccuccccuccccacuuucuucuccccgucccccuccccuccccucccguccccucccccucccccuccuccccucccccuccuccccuccccuccccucccccuccccucccccuuccccucccccuucuucccccuccccuuccuccccuccccucuccuaucccccucccuuccccuccccuccccuccccccuuucuucucccugccccccaccccuccccucuccuauccuuuccuuucuuuucuuacagagucugacucuguuuccagggcuggagugcaguggcaugauuccggcuuacugaaacauccgcuucccggguucaagcgauucucuugucucagccucuggaguagcugagauuacaggggcgugccaccacacccggcuaauuuuuugguauuuuuaguagagaugggguuucaccauguaagucaggcuggcccugaacuccugaccucaagugauccacuugccucagccucccaaagugcuagaauuacaggcuugagccacggcgcccagccacauaugggugcuuucuaaugguuuagcaagauccuccuuggucgcgauagugaguucucacgugaugugauuguuuaaaguguggggcaccucccccuuacucucuuccuguuaguccaaucaucagaagcaccugcuuccccuucaccuuccgccaugauugacaguuucccgaagccucuccagaaacugagcagaugcuagcaccaugauuccucuucauccacugaggagggaguuuccaauugcaugcuuguuucucucccuacauguguuaacauuaguuuagaaauuuuauaucauuuugagaccaaaaaaaucaacucugagguauaaauuuugauagugcaaggacccauucaucaugcuugacauauaaucuuuuaaauuaaauuuuuauugugcaaugauuacaguuucaccugccuguggaacuaugagccaauuaagccucuuuucuuuauaauuuacccagucucaauauuucuuuacaacaauguaagaauggacuaauacaguugaguuccuauguaaccuucccccguuuccuccaauaauaacauucuacacgauacgguacaaucaugaaagccagaaaauuggcauugucacaauaaaauuaacuaaacuacagauuuuauucugauuuaacuaguuuuuauguacuuuuuuuuuguuauaaacagguuuuaccaguugcauagauucguguaaccaccauugcaauugcgauauagauguucaauuacccaaaaguaauuuuuucucuuuaaacguaauacaaauuagcagaaugugcuugagaaaauccaguuuggcugucauuuuugaauuuaguccucacuauaguguccauuuuuuaaauuucuugccacugaugggccaauuugugacuguuacuggauuagauacuggauacuacauguuaauaauaagcauauaaagaaaacaaaaaagacuauaucuaaagacugugauuaaguucugaaugagacaagguguucccagcugaguuuaaacuggaacaugaauaggagauucgggaaauaaagagaggaguauaacaguaacuuauugccagcuuggcccuauaaacuacacaugcaaauuaguaaaccaaguguagagggaaaaugugggaauaauagucuuuuaaaaaauaauuuuaaggugaaaaccaaauaaguuuggcacaugaggacucaauuacaucuccaguggugacugcaggugacucagaaggcaacuggcaguaaacuugaugcccaaggagggcagaugccuagaagucaucaggaguaacuaggaguuuuggcugaagaguggcagauccuggcagaacagauuuagugaugaauaaauucucugguucaugaugccaagaaauuagugguugcuagggguugaggaggaauacaaguggaaguaugugaggcuacaaaaugacaacaggagagguccuuguggugauggaaguauuuuguauucuuaaagcaucaaagugaauauacugguggugacucuaguguuacaagaugccauuggaggagacuggauaaaaaggauacacggcaucucucuaaagucuucuuacaaagaaaggugaaacuguaaucauugcacaauaaaaauuuaauuuaaaagauuauaugucaagcaugauaaauggguccuugcacuaucaaaauuuauaccucagaguugauuuuuuuuagucucaacauaauauaaaauuucuaaacaaauguuagcacauguagggagagaaacaagcaugcaacuggaaaaucccucuucaguggaugaagcuaucaguugccgugcccguguucaucucaggcuucuuccucuuuuaauaucccuaaauuugaacaacacgauaagguucuaaaagcuucaaucuuuuaugcaaauguuuaucaugaagcaaggaacccugaacccuguacugcaaaaggcaggccuaugacaaguuuuuaaaaaucaucucuucaaauuaauuccaagucaugauuaaugauucucgguuccauagauaacaaaccaugaccucuauuaaaaagaauagagucaaugaacaccaaauauaauucauuagacagauguaagugaccagcgcugugguguuugaugaauauaaugaaguucuuugauuaagaauauaaauaucucccaagaagagucccauguuuguuuuccaauuugaaggaaaaaaauacuuuggcaaauuccacaagaaugauauucgaauugggauaaaaguaguuuaaauauuuuguuauagauagaacaauaaacaaguuuauuguguguuuucaugauggaaacacauuaacaaaauuuucuccagagaucuuauuuuauauuuagguuaguaauaaaaaaaaaaaaaccauguguuuguguauguguauauauaguacauauacaugugugcguauauguauaguacauaaacacauauauaguacaauauauguguauauagaguacauauauauguguuauaaauauauacaauuuagguauuauguuuguagauaacccugaacacuucugcauagugaaaauccaggccaguggggaaacuuugccauaaaaaugaauauggagaagcagaaagugggcuuuacaugaucaauuuuggguaauuuucuaagggaggguuggguaggaaguucuucaaacuuguauuucuggaauagugaacucgucacagcuguggacugaucuaggacucacuguagaugacuccuggcaggcaaugacucacugaacucuuacaaugaaaucagaccaaagaaauaaaaugggaagcuuuaucucacuuuguagaaaucaguguuucuaugagauacuguuuguaauucuggucaacaaucugcaacaaagaaauagcaaaacuccggaaggucuagauagggucuacaggacagcuaaaguggccaaaagaguauagaauauuucauauauauaaaaauaagaaaaacuugaaaaauauuuucaugacaaaaaauaaaaaauaagagaaaauaggguugcauagccauaccuaaaauauauuuauaaauacauaaaugucaaguacaugaguguccuucaugauuggaguguucuaucuuuaacccucuaugggucaaaaauugauuuauguuugaugaaugcaaauaagaaauuguuaucaaauguucaagggguuaaaagcuuaggagaaaaacaagguguuacaugacugaggcaacauuuggaaauaacaaaaaccacaaggagguaaaacauaauaagauuaaguuuguugaauauuuguguaaauaucuugaaguuccaaagugaauuaaaccaguaggaggaggaagaaaauuguuguaagaacagcuugauuuggagaaaccuugagguuguuuuauaacugugagaaaagugagugaagugagacacaugacaacacuauuuugaccuuagagcaaauuauuagaaacaaaauauucaugcuaaggggaauaauagucuuaucuuuuacacugaucaggauagugguagucugagaaauauaucauacaaagaacuggcuaaaaaacaaaacaaaagcccugagcauuuuaauuggaccuaugaaauaaugaugucuauagaauauguaauaaaaaacaagggaguaugugggaugcugagagugaaucagcuucuagaauagaggcauccaaucuuuuggcuucccugggcccauugaaagaagaauugucuugggccauacauaaaauacacacacuaaugauagcugaugagcuaaaaaagaauugccaaaaaaaaucauaagguuuuaauaaaguuuacaaauugguguugggccacauucuaaaccauccugggcugcaugcagccugcguacccugggcuggacaagcucguucugggacuuuuggaugcucauugaacuugcgugauuccuuauguaaucauguacucguuucaggauuuuuaucaaaagcaugcauccaaaaccucggguacuggguugccucauuuauuuuaaucacaaaauacugaaaaaugguaacaagaaaugcaucuuaauaauaauauuucuaagaacaugaaacuacauucuuucuuuguugcccaaccuuaguguucucugacuauguguaucccacuccaugccuuucucuguuuuccuggauuuaugcugggaugaaggaaauauucaauugacuucugaaacuauguucaaacuuccaagccccugauauauuuuaaaaaguauuuuuaaaggcaauauuauuuagaaaaccuguuguugaugacacaauauuccugggucauuauaggagucaggaggugagcuguguuauuucauuggucuaaauuuccuaucaaacugggccuuacggaguguauaugaauaacaacaaaugcacuaagaaugcagcacaguguggcagucugguauuuuccuccagaugacagcauuaaguggaucaacucaaauaaaggagaacuccauauaacaaggagauauggggcccagugguuuugugagcuguacaguguuucaauaagacaacuaacaaucaaggucaagacauaauuugugcgcaucuaucauuccagacuagacccuuuaacccuguagccuuucuauuguguuaugaaauucauccuaauuaggcauucaaaauccaguuccacacuaguucaauaaagucuauagaacaacagaaagauauucaaaaauagauucuauuaaauauuuuuaaacagcuuauauaaauagaagccuucacugguauguuggugaugauugcaucaaguguaauagcucauccuaggauuugggaucaucuaugauaugugcaaaaucuauuuuucccaaucaacuacaaucaccuacaaacauuauguauuucaucuauacuacacuauagcuauacuauacuaauauacuguacuauacuauacuauaucuauucuguacuguacuauaccauaccauaccauaccauacuauaucuauacuacuccauugucuuaauccuguuuuauauucuucauuuucucacgcuaccugcuauagccaggacauuucuguccacuuauuuuuuuucuagcuaaauucuauguaucauugaugaccucuaucagcaacuaucucuuuuauaccccaauuuugauuagaacuaauuaguugugaguucuuccugcucugaaacaucauuauuacacaaaguacuuucugcuuuguacuguaaagauucacacacuuguuuuauucucauauuauguuugaaccauguugacuagggacuaaccaucuuuauucaccugcauuccuucuaccuagauuucugccuuacaugcaauaggcagaagggucauugagcauaaaauaaaguaauaaauaauaaguccuuaauaucaagauccugaugaauauuccaauacugacagcucuacccacaacaccaaacacaauuaaaauuuaaccuauaaaggaagcccuucuaggaagguuauauggauacugaugcagggccuuuuuuuguuugaauuuacuuuguguuuguuuauuuuugcuuuuuuggggaauuauuuugguaguacucccaacuugggagacaucuagagaaaaaugucguauaucauaaguuaacauucggucaacuaucaugcauuuauugaguguuaaagcgugaaacaacuuauaagacaagcccaaggagacagcaccacaccagagaaaaauaauauguagaaaugcuguuugacacucagcuaaacuggcugcacuugagagaagauaauuacuuccuuagugauauauuuuuugagauuaagaguuuuaaaugugaauuuccaauuggacaacaaacucucaguacuacuuagaaaauguagggauuacuaaaacaacaaauaaugauuuccauaaacuauauuuuuuaacucuuuggguccugauucuuaucacgcauucuuacacagagauaauuuugauauuacucacugaaaagagauuuguaguauggagaucuagaucaucuugggcagcuaaucuucacugguaauuguacaaauugucacugagguauuaguucugauucugcccuuaauuguuauucucaagauaaggucucaaacuccuuuuuagaaggagaugccuguuggucaagggaacuagcagguucauacacacuauccugucuuuggcuuaucaacauuuagaacauagcggcucuuuauuuaaucuccuuagugccugguuauccaaauacuuuacuauuuguuuaacuggcucaugcagccaguuuuucaaauuguugcaauugcauaugacuuuuaauuuagaaguuuaaggguuuccaaaaacaguuuuugaauaaaacucucuuuuaaaaaaugugaauacaauuucaguuugucuaucaaaacuaaauaacuuuaucugaauaaagcauuagagugagaagauuuucaccuauucauucuuucuuccucucuuaucccuuuccccauccaaaccagucauccaguuaagacccuaguaauuuaugcaauauggguuaaaaucugauacauuucucucacgcaaaucaaauaacagacauggacaguguuuauuuagggcacaugccaugacagagucauagaguggguauuauaggacaaggaguuagguaaauauucuucuucacuauguuucaguuuucaagaaagaaauugggcuugucuugcagcucucuaucagacugaaaaauucuguaccuaaccaguauaauugguacuuuuauuggauuuuauguggaauauacacagaguuuaguaagauaaauuauccaaaacugaaauuaugguaaaaagauuacuaagugccuuaucauacugaagaauuaucuaacaaacuuguuuacaaaacacugauuuucuagagaaaugcauauuuuucuuuuaucauugaauagaacugagguucuccgcagauaaaugucagcuuacagaagacuaauaaauuacaaaagauuuuuuuucugauagagauguuagugguuccagccaacagaaaugauggcucaguuacagauuuauugccuauaggacauuauuagccaauuuuguaucuaauugaaguaaccuuaucucaacaaucuuucauucauugaucauauucucucauaucuuuuauuuuuuaaaccagcuguaguauucugcuaguuuccucaugaauaaguuaaauaaaucuuugauauaugcucacuuuauauuuguacaagaaucauuuuuuuaacauuuugaaauuuagacuugagaguguauuguaaaaagaguuguuuaguaaaaauaaguuuacuguucuuuacucgcuaaauaaaucaguuuacuguccuuuacucacuauuuccuaucuuuggcauuaugaaaaauuguaauuuuuaaaaaagaaguuaagaauguuaaaaauuuaaagguaauuugaaacaaaaucaaauuuuacuugagauacuuuuagaaaccauuuuguagaguuuucaucuguagguaagguaggcaguuauagcauauauuauagcauacauaggaaacaucacaauacaauaauuacaauugcuaguagagaaauccuacuaaaguaaaaaaaugcaguauuuucaaauggcauguuauaacaaauuacaucccauuaauguuguauuuuaagaaauggcuguaguuauuauacuuuccaguuaaauaacguguguguaaugcugaagaauauaauaugaaauaaauggcgauguugggaaggaagacaacugggaggauggugggaaaagacgugagaaaaaaaauaaaauaugacagaagaagaagcagaaauaaaggaccugaaggagaaggagaauagcccuuuuuaaauguaucaaccuacuuuauuugcaguagaaaagagaagucaggaaauccuuuacauugauuucuuuuuuuuuuuuuacuagcuuaaauuacuaacauauuauuaagaauaaaugcaggaaaauuuuucucaagcaucccaaaucaucaaucucucuuccuucaguaguuuaugugcucagaguguccauuggccggacacauuuuucucuguggaaucacaguaggccugucuuucugugcacagugaccuagggaguagaccuuucucagugaucucuacaggauccagcuguaacuucccuguggcccauucacuuugagccccauuuuuccuugaaaaacaauuaaguaauucuagaaacuauuuugugccuuauucaccuaaguuucuuauaagaagcaauaugggucugucaaaagucaccucucagaagcaaaaugccuuaaauauaauucaaaaauuugaaaacuaauuuuuaggcacuuuggcaaaucaagaaaaucaguuuguucagaugaaaccaucugucaauaugccuucaagaguuugcaacucacucaucaaauggaaccaguucuuauuaagaggcccugagaaaaaguaguuuguauggauuucugauaagccaaacauauacuuuauaguauguuuuuaauucuugcuauuuuauagauuuucuacagaagacucuaucaugaacaagaggggagauuugaauacaggaauaucagauuccuuaaauccauguaauucuuugccguuugagauuuccugucaugcuaaauacaggagcacauccggcuugaacucagaagaagaacaaagauauuugcuuuucaccaaugacaguuagacaagcaaucagauacuagauuaaaagacugacagugcucacugguucuuccgcgcuuucaucacuugugagagcuagcuaaauucugcucaaauuagcacucaugugucagaaaguuuuugaaaagucgcacagcuuucaaucuccuagaacucagauagaaaauuaucaaauuucugguguucccaaaggggugagcacaguacucaagcaaugaaaauuagguaaguacuuuuaaaguacucaguuaaagcagagauuuugccacacgauauacuucauaauaguaucuauugcuacuugacagaagugacaguuauuuugccugucauuccuaagaaggaagaaauugagagcaaguauauuaccuucucgguucuuacuguagacacuacuuccugggagccaugugccaauguguaggauauauuagagauagaauauaaguuugauggugacgaaugugaacagaacaugauaguuuaagagauaucugaggccucucuuuuaaaauauuucugguguguuuuuacccuucuuaaauucaaaagaaaacagcuuuaaaaaaaacugaugugugaaauuuacauauugauacaacagcaguucaaugacucaaucccauuauauccucaaaaauguauaaauaaucaagaauuguuaccaccugcucauuaccacagcaucuccaagguucucuuuuaugaauaagccaugggauuauauuaucauuauucccacucacuaaaguaaaugcgucuuuagauguuauagggcaugguguuuucaaaaugguaauuaaaaaaaauagaagucacuuuuuuggaugaugccagcauguuagcuauagaauaaaaaaugauuaucugcugcauuugaagacaaaacaauacaauauaacuaaaaauaagaaaugucagacaggugcuaagaacuuuauauuaucacaguucccccaguaacccuacucuguccauuuuaccaaugagauccagaaauuggggcagugugcccagagccacuucaagagcucaugcuuccugcucuuuuaaauccaaucuaugccuugaaucagacaaacuaaacaacuaaucauucauuuaucuuuuguuuccuaaacugccuaaaaauauacucugagggaaaaaagaaaaaaaaaaaaaccacugugucaaaagcauccauaaacauucauugagcacaauuaaaguuaacauuugcugaaauaauuuaagaaauuaauuccuuagcguuuacaaauaacuuuuauaugacauuuuguaguaaggcuucuuuuuccauuuggcauuaauaaucuuaauauucuguauuaauuugucaggcaucucaauuagagcagucaacaaaagagaauaacauauuagcauguguuucuuaaugcugcagacaaagagcugaagaaucuccagggacugacuaacuaugaguauguauuacagauggccucuucuuuauuuuuuuguuuccuguuggcaagauuugaggccuuucacuccggauuaaccgccuuuccaccaaacacuggcaggggagcuuaauguugcuguuaaaucaauccacuugguuuggcauguuggcaguuuuguugggugggagguguuggugagcaaagcaggcuuucggauuugaacauuauguuaaaccaaagagaaaauauuaaauauuuggauuauuggaucuuacauaagauuuuuaaauccaugcuauguucucuacuuugaauuaaauaaauaauuauuuacuuucauuucugggaaguuagccuauuuauuuauuguuggaugauguacuaaacauuuccaugguuacugauaaaacguaagauauuacaccaguggauaaaagguagaccaucauaaaccacacucauagaacaaaccaauguauuacaaauuacuagguguuauuuuagaaaagcaaacaugcacuuaacaauauauguuuuaauuagaaaaaaaccuaugaaaaauucaaacgauacaggguuuuuuauguuauauuccugaaauuuuaauuccugcugagaaaauacauuuguuuuggaacacagaauaauuaacauuaaaaugagcauagacagcauacagauugcuuuagugaauuaauucaaugauaucuaagggcugagugccagaaaaacaucacuggaagucuccuuguggagaggcauuguuagagcucugaucucaugccacaaacaucccuuuuuccauuucauaacucacugugcuucuaauauagacaaauuagcuaaugugcauucauauuuuuaccuugcaucuuucauuaacuuguccacaacuucauauaaacacaaagcaugucggaagagagaaauaauuagauuucuguucccggcucuuagcacuguauuugggucaugguagacauugggucuaccaauauuccccuuaucccaaagaggaauaagacaggauuccucuuucaagaaccucaaauuguauugcagaaguauagauagaguuaaacgguaagaaaauacuuccuuauaugucacaagacaaugaugauuacuuucugaauaaauuaugcuaagaacauaugcuguaaauauucagaggggauagacggacacggaugaaguauuguagcaauguuccaugaaaaggcagaaagagaacuagauccugaagacaggaucaucuucaggaagaaaaggcaaugaggaggaagaaaauaauuuuagauggaagaacagcugguaucaaaguguuuacaugaagacugaguuuuuagggacaguauauuuugugagguuagcuaaaauggaugcuuaauguaagaaaaacauaaauaaaauauugauauuuuacugaagaaaccacuuagcacaaagcuaaaaguuuaguucucauuccaaagacaaauggaaguuuuaauauuuccuucacuucccuccaggucuaguacaccccucaauauuuaguacaccacaacugcaaaccaucauuccagggacaucucucagugacuagcaaaaugguugacccguucugucaaaauuaccuugaucuauuugaaucuauucaaaaauaggaccaaugacuuagaaaauuaauuuuaaucauucuacaacauacuugcuaucauauaauuaauauuuaauaaacuauuauucaagaaaacacauugaauuauuuuucuacacauauuuggauuaugcuuguuugucauuuuggggggucaaaaugguuuuaaaagaacuuugguaaauguugauccauuaauuugauuuuuaucaucuauaagaguugucaacuuggagauucaauuuuaaacacauuuuuccacaucacuacacaucuguguuuacacuggcugcaauacuagcaggucccaaaaggccucaguauuuauuuauuuaucuacauaguuuugggcaggauuggggagcucuuucacuugcucugcucuuauuauuucuaagucaguuuuauauccaaaucaaaacauucaaucuaauuacaaauuauguuuucaaaagcuuuggcaugacaacuucucaaagauauuucuaagccuaaauuaguuucauugauucuugacuagccucaaauaucacaauucucaaguuucauacugaucaacuuuuaaauuuuauauagaauuaaaacucucuaaaauuaaucugucauuuacuuucaaguugugaccacaauuagaacuacuauuuagguucaauuucaaauuaaaauuuacuccuuaauauuaguacguuuucaaaaguacuacuucaucuuccuaauuacuuucucauuuuucucuuuuucagacaauuuuaaacuuacagcaaaaauuuuaagaauacuaugaagcacauuuuauuccuucugaaucacuuaaaaguaagcugcuggcugacuuuucaucauccccaguauuuuacucuguaauuucuacaaacaagaauaugcucuuauauaaccaugacaaaccuuagaaugaggguuuuuacaucuauuacuacuaucuaaugcacaaagcuuauuuagaguuccccaauuauggcaccaccauuuuuuauaauauuggagcagaaaaggggugacuccuucccaccccaucauaaaggucaugacugacauuccuauaacaaaauacagauuaacaagagaaaagcaucacaaauauauuucauuaugguuuuacauaacaugggagcccucaggaugaagaauuaaaggaacagggaaaaguauccauuuuuaugcuuagguucaaugaagaauggacaggcaugcagaacugugauuagacaaaaggaucuggucuaauucuaguagacccagguggggaaacccagccaggcuuaucuggauucuucuuggccucucuaugcgguguuccuuccuccugaauauggugcuggacacuuucuggaauggcugccaucaaacgaggaaggucagagacuuucucuauggccagcucuuacccagauaagacaggaaaauaugacaacaauauuuuuagcuuguauggcuggcuuugggaaaaagggcuucugguuccuaagaccugcucuggggagaugaauucuaguuuccauggcuugucucagaggagaaugaguggcucggaauaggaggccagagauaaacuuugcuuccgaggcugcuucugaggccuucacuuuugaguaugguuuucugagccccaacaauaccaaaaggauccaguucagaaucccaugucacauuuaguuuuuaugccucuuucaauccagaacaguugcuuuucuuucuguuacccucacaaccuuguuccuuuuuuuuuuuuuuuuuuuuuuuuuugagauggagugucauucaguuguccaggcuggagugaaguggugcaaucuuggcucauugcaacccccgccucgccucccagguucaagugauucuccuaccuuagccuuccaaguaccugggauuauaggcaugugucaccacgucaagcuaauuuuuguauuuuuaguagagacgggguuucaugauguuguccaaaaugguccugaacugaugaccucaggugauccaccugccucagccucccaaagggcagggaguacagguguaagccaucacacccagccuugauaguucuauaucacaggccaguucucccauugacaaugcaucaauuuggguuugucuuuugauuccucaggaugaaauucaggguagguauuuuggcagaaauacacgguggugaagcuuccucagauggggcaggauauuaauuuguuccauuuauggugauacuaacuuugauaacaugccagcuucucuacuguggaagguaccauuucuucccuuuacaauuaagaauuauuuggggcggggggagguacauuuagaagauguaaauauuccauucccuaucacauuuuaaccugcuaguuuucucagccaguauauuucuuagcagcauugauuaucacuacaaugauugcuauauuuugauuuccugauuccaucauuacuucugcgcugacuaguugguacucuucuacaagaaaaagcuuucucuucucuccauuuauuuacucaugucuuuguccauaacuauaugaacugaaagauuccuauuuuauucagugaguuauaauacgguaguaucacuacauaguuugaugcucaaauuguuccagauuuggccaaugguauccccucuaaacucacugcuauguacuucugccagguuaccaucauccucugguauuuccuuacuuucuggcacaaauagauauuuuagauucauauauacgugucuuguuucagccccaaaagucaucauuuuuuucaagaaggcauaauccauuaaucaaaaaugauacuaaagaaccaaaauucaucauuuuuuucaagaaggcauaauccauuaaucaaaaaugauacuaaagaaccaagaucuaggccaggaaugguggcucacgucuguaaucccagcacuuugggaggcugaggugaauggaucaccugaggucaggaguucaagaccagccuggccaacauggggaaaccgugucucuauuaaaaauacaaaaaucagcuuggcgugguugcgcaugccuguaaucccagcuacucgggaggccgagguggaagaaucacuucaacccgggaaguggaaguugcagugagcccagaucaugccacugcacuccagccugguugauggagcaauacuuugucucaaaaaaaaaaaaaaaaaaaagaaccaagauauagacgccugguguguucaaugauacuggagcauacuggagcauuguugcuccuaggcucuuccacugggcagagcuacauagaaauuuacaucaguauguauuuucauauacaucuauauacauuaauaacugugaaaacuguguagcuucuaaagaaucugacugauuuuguugaaacauugugacagucacacuccaaaauuuaagcugaugacuuaucucuuaagcucuagguagaaggaagucuauagaauuugcugcuaguugaagcucucauuaauguugggaacuagauugauaaauauucuacuagauguugaguuaagcuauucuauauuuucccuacuaaaacaaaagccuuauuuuuaucugaaaugauccauauuuauauguauuuccuuucauucaauugaauugcaaauucaaaauaaacagcuugaaaaguccacuggcuacuaaugauacccuuuugaagggaaauuauuaauucagcacaacuccaagugaaauaaacaacacaguucuacagccaagguaaaugcacauaucggacuaagucuggaugaaaacugucgguugucaaacugcuaccauauaauaaccaccaauuuuguuagacauuauauggcuugauuuuuguucaugaguccuuuucucaaucagacauuagguuuuuauaaaucugauguuuuauaagcagaauggggaaaaaucggaugauuaucagaacauugaccuuaguguuuuugaauuacucccacuacuaaauaguaagacauacauguuagcaagaggugauacauuuaacaaaguaaagacagauagguacacuugacauggaaacuugcgcuacuuauauguauguuuguguauguguuuguguuuucuauauaugcauaaucuagaucuuuggaaggcauuuguauaauuuuucuauuuuuuaaugaaaagcuuuggaguaauauuaccccaaaauagcccaauugagcauuaaaaauauuuugaacuuaaggcaacugaaaaaaaaaaaaauccaaacaccagaagaccucucugcccucccccuaucuaccugaacacacaaaacaacuucucuuugugaaggcuaugucucucuccucuuucucaauuuuuguaucagaaaaagaauaaccacuuuaucacccgagacaacaagguacagagaaaaaguccagauaaauaaaccuuacgaacuaggcuuuaucuaccauuagucucccuacauauuugccuuuccacaauuugcuggccgcagagguucaaaguccuuuucuuuuguuuugcugcuuaucuauaaaauuauuuuugucagaaugcuauauaagccuacauuguaaccaauccuuugaguuacuuaugacggcguacuuacguguguaugcacaauguaugucuuaaaaaacuccuguuuuuuuuauuuuguuuguuuucuuuuguuaacuaaucuuucuucagucuaauuugcagggacccaaccaauaaaccuaauaugaauagaggaaaaauauuuuuuccauuuccuaaaauuauaauuucuugaagcaaacugguucccacaccagguauaguaaacuaaaguguaaauuuugaaaaugaaucaccauaguaagcgaccucuucuugaaguauugucagaugaagaccauaaaaauuauaguucauucucuccuuauauauuagaaauaauggaagauuuagaaccagcugguucucauuauuuucugcuccuccuuccuugaguaggucauucaauacgcuuauaaccaggauuaacaagucacggucuuuccuuauuguuacuacaaaugauaguuuagaauauuuugcuaauggauccuaaaaaaauaaugaauagaauguuagggguugaauaauugggucuauugaaaacguggggccaccccaaauuagguguuuccuuaguggauaauauuguguugauaugcaauaauguauuagacacuugucauauuaaauaauuuuaacaagaaacaggaaaaugaacuugcacuuauuuuauuagaagcuuagcuuuucuuuccauugaugauuagggagagaaguucauuuauuuuauuuuaguguauuuuauuaugucaaaagcuauuaaggaaauaaguauuuuuuuuguaauuuacuuauuggagagugaguaugauuuucucuuuuguuggugugacuaaagauaguucugaaguacuuacacaacccacaaccaagaaacuagaaauuaaauaugcucagauauuuuaagauauuuaauuuuaugaaagcugaauuuacauuaauuauagauaccuuaguaauucuagucagguuauaggaaacccagaaaaaaagguggcuuuuuucuuacuuacacagcccacaacccacaaccaagaaacuagaaauuaaauaugcucagauauuuaauuuacauuaaucugaugaaguuaaugaaauucaauaauauaacuauaauuauacaaaagguggcuuuuuucuuauuuuuuaaaauuucaugacaaguuacugcauuuauuuguaugaagaaaagcauuagaguagguagcuagauagacagguagauagacagacagauagcaggaaagaaagccccagaagcucuaaauaccuugcaccacuuggaaucaaugcaaaaagaaaauuuaugcucugugguuagagcaaucagaauuaacaguagccacaucugggcuuaugguuaggcuuauccagcccucacugagacuuaccuggcccuagcagaaaaaucacuucaauagggacuuuccccaguagcgagcaugugcauuuugacuuggcucacccuaaagguaacauuuugcucaucauaauaguaaaaaacacacccaugaguggggauuuaaaauacuaaugaaacaugcgacauauguacuaguguaguacacauguuuugagaccucccaaaaugugcuuacugguaacaccucuuuaugcccauuuguaaauauucauguaaaacucucauaaaggggguuccccagugucagucaaugcaucucauucuggagcagcccacccugacucggcuuucagcauguacuuuuuccuuuaaauaaacauugccauugcugaauugccccugugugucacuuggcagaauucuuuccuccaagaagacaggaaccaaggaccccauacuccccaguaacaaaagcauuacaaggaaacauaguaaaaugacaggagccucauguucucacagucuaaaaggaagaugacuagaaguguauaugaagauauuuuauacucauaaauuuuccuuauuaucacacacuuuaaaacucaaaauacagaaaagauuuaguuuagagaaaauaaauuuaauuuuucuugugggagaggaggaaucuucuuuuuuucugaauaugcauuuuaugucaucuauuuaauucuuguauuuauauugaaagguaucauaauaugcaaccccaaaauacaccucuuuagcauaugcauuauuuugagcuaaaggccccugaggaauggcagacaccagaaaagcucuaaaaacagggcauaaauuuucauuuuguaaaauaaauuuacauguauaaaggagauuucuauuuguaaaagauaucucccuuucccauaucaggcaauggauaacucuuaaaucuuauggauugagaagacaccuacauaaaucuguauaacaaaccucacuaaaacaacccuuguuuaguauacuucuccuagccacuuucccaacuaguaccccuugcccagaagcccaaaacgcuuuuuucuuuuuugagccuaagauguuauauaagccuauauucuaacuaccccuuuggauuacucauuacuggguacuccuauauacaugcaugugcauggugugcauguuaauaaauuucuauuuaguuuuaguuucuuguuaaucugucuuuuuccaguguaauuuacagggcuccagccagauggguagagccaucucuaugaugaguagaagaaaaagaaucuaaaauaaguaaaauaaaaagacuaucaucccccuccuacaauaagauacaugauacuguaggaaaccaggauaggauaccccaaaauaugucuccauaaggauuauuuugagcugauuauuuugagaaacugcagacaacaaagaagcucugaaaaugaaguagaaguuacucuuuuuaaagagaaauacuuaucucuaaaggaauguuccauuugcaaggguggcuuccuuucaguacccagaagaaaaggauaacuaaaucaccagagacucuuuucaguggagaaggcacugguuuaagucugcauaauagaauuuaucauggauuaccauacuuuucuuggucaccuuaccaucacugcacccuggcccauauccuucuuucuuuguuucaguugaaggugguauuuaggccuaaucucuaagccaugucuuugacuuacucauuuuucuggguaucucccacauguaaaugagguauacaaguuaauaaacuucuuuuugcuuuuauguucuucauuuguccuuuguugcaggggucuauuccagcuaggaacccaguaggguagagaaaaaaauuauuuuuccuucucuacaauacuuuuguauaauauauuuaaaauauugguuauuguguauggaucauaaaaaauaacaaggguugcuccuaggaauaucugugagauuaaagaggagacaacaauguuaccgauuacaucauuucccuuuuuaaaguuaugaaauauuccuauucccguggauagaaaaucagagagaauaauacaaaaauaacuaugucacaccucccagauuuaacaaguauuugaaucuuaccauauauuuuggaucauuuuaaaaaauaaaauaugacauagcuuugaagcucuuccugauauuuugauccugccuccggagagaccaauacuaucuucaguuuggugggugucuuccacaucugugcuuuucugauuuuggaauaagucacuguauuauuuaaauacacauaaaacuuuauuuuguguuuuaaaacuuuauacauuuaucacuguuaugugcucucaacaauuuguuuuuacuucuuacucaacaauauauuuuccaguauauuccauauuaucuaguugauucguuuuaacacaagcaaaacuagcuagguagccuuggagaagcuaauuaauucuguaugcuucaauuucucaucuacaaaauaaaggcaauaauaaaagugugaguugcaguaauuagaucaguauaugugaauuaaacuaagauucuguuaguguaaauauucucuuaucaggaacauuuaucuuaucaggaauauuaacuuucaacuccgccauacgaugacaguuuaacuauuuguaaaagugauuguaccaaccuagacuuuuaaguaguauaugaggcaaaauuucucuuccccacuugccaguaaauauuugguauuccggaaauuuauauuuuuaccuauauagccaauaagaagugucauguuuuuguuuaauuugcauuuguaaauuuuccuauauuuauuggacauuugaauuuuuucuucuguuaugaccaauugcucauuuuucuacaaggucaauuauuuucugguuuauuuuuagaacuuuguauauucugaaaauaaauauuucauuuguuguuuaaguuucaauuauauuaucccaaucuauguaauggcuucauuuucuuccuguaguuuucuuguuauuuuuguuaccguuuuucuuuuucuuuuuuuuuuuuuuugguauaugaguuuuaaguuuuaauauuauugaauucaucgauuuuauucuucaauaguuuuuuguacaucuaaccaaauauauuuccucgccaaauaucauggaaauauauucuuauuuugaauguauuguuauuguaccuaauuaacaagcaaaaacaaaguuaaaugauauuuugaaauuucugagacagggucucugucacucaggcuaaagugcaauggcauaaacauagcucacaguaauuuuuaauuccugugcuuaaggaaucuuucugccucagccaccugaguagcuaggacuacagauaugcaccaucaugccuggauaauuuuuaaaaaauuauuuguaaauaugggggcucacuauauuaguccagacuggucuugaacucccagccucaaacaguccuuccaccucacucagccucccguaacucugggcuuacagacaugagccacugcacccaaccaguuaaauggcauuaaacgguuccuaacaaaaguagacauuucuuugcuuuaucucucaaaaucaccauuauccacucuuuacuguggcauucuuguauauauaucuuauauauaucucuaaauaauaugcaugcguaucuauuuguugauuuauuaauuuuaaauauuuucuauugacugauuuuaguugagauuuuaacucuuacguuguuauuuccucuauuccccauuuuuuaucauagcaguuuaguuauccugccuuuuuugguuuaauaauauuagauauuuguauuaauauaacuuugcaaguauuauucaaaauuuaucaguguaguguacaauaauuauuuuuuucucgcuuuuuguuuauagccccuuuuuaacuugcuacuuuuuugggggggguugguuugccuauucuuauguuuuaguagucucucauuauaauuacguacaagaucaaucacauaauguaaucuacuugcaauccuacauggagaacucaguucuaucggaauugauucugcucuagucaugcuauacagcugucaauauaggacuuucauuuuuugucagccucagaauuuaauuugccuuuuauguagcacucucuuuaugcucccucuaauaucuuccuuauucauuucuuuguuugaaaggacagauagucacucugggacuucucuuccucauaaugcuagagauacaacccuuuucuguuaguccuuugguuuucuaaauccuugucuucuuuuccaguuugcugcuucuucuuuuuuuuuuuuuuuuuuuuuuuggaaggaacauccuugcuauguucugaauguuugugucccccaaaauuuauuuguugaaacccuaaccugcaagauaaugauacugggagguggggaguuuaugagcuguuaagguucuaagguaagugcccucaugauuaggauuagcgcccuaaugaagagacccaauagagcaaguuagauucuuccacauguaaggacacagcuagaaggcaccaucuaucagccagaaagcaagcccucaccaaacaaugaaucugcucauacuuugaucuuggacuucuugacccccagaacugugagaaauaaauuucuguuauugauaguuuaugguauuuuguuauagcagcccaaauggauggaaauaauccucuaguagcuugcuuggcaugaaaguaaaggggguaaauuucgugacguuuuguuugucugagaauguauguguucauucuaacaacucauuaauaauuagcucacuauagaauucuauacuggagauaaucuccuucagaauucuauaggcacaacuggauuaucuucuagcuuccaguaucgcuguuggaaaguccaaagccauuuugaguuucgauccuuuguaugugauauauuuucuguuugcuguuguuuuuguccccacaggaagcugcagaaccuucauuuuacucuuaugguucugaaguuucauaauuacaugucucuaugugaguguauguucauccauuuggcuggacauucucuuuuuauuuuuaauucugaaaacacauagcucacaguaaauuauuauauaauaaaugcaucuuuuaaaguuucucuuuguauaauuuucauuauuuuaauauuuguuaucacacuuuauuacccuaccuauuauauauuucuauuacauugccuuauguuguuuuacuuaauggaugauuuccuuucucaacuuuauuucucuaaacauauugacuauuuuuuuaaaugucuccuauuacauuuuuaauuuaccaugucuuauuuuuaauuuccaaacacuauuuauuauagcauuuuuaaauaaauuauuuggaucuaucuaaaaauauuaauuuuuuaagcuuuccuuccccuguacaauuucuauuuauuccaaguuauuuuuuccuuauauuuuguuucuuuuuuauucaguguuacaucuuuucuuuuuuuucaaauaccugacaagcuuuguuacaggggaaccuggacuucagaucauuauaacuauccucauggggugguaagauuucuagaguccucuaacuagaggaauuuggaaauaagucucagauuuuaugaagaauucauggcuggagauaagaauuacagcaucaucaguguuuagaaggcauuuguguuggaaagacguacagaauuuaaaaaaugaagaagaaaaugcccagcaccaagccuucuuuauagguaagccacaauuaugauuuucucuauauuaagaucuaugguaauuucuuuaaaccaauauuuauuaccuugaauaaauucacauuugauucuuuuacucaucuguaaaauaauuaaaagaugcgugucuguuuuaaguguuccauuuaaaggugcccaauagaaaaaggacauuaagaauagucaaaccugaggagggccgagcaagacugucaauuaagacucuccagugaucacccaccggaagaaacaucaauuucgacaacuauccauagguaaaaauaucucacaagagcuacgaaaaccaaguaaaagaugacuguaccuugucauagcacaauaauuagaaaagacacaccaaaaaagguagaacggacauuuuugcauuucccauguuacccaaccuccaaccccagguagcacagagcagagagagacacuguucacuugggagaaagagagguaagcaaucguagaacuuugccuuggacacaaauaccaggcccaccacaguaaaaaccagcauuagguagaccugcaugaucucugauuuuagccugguaucuguagccugauccuuuagacccaccauagugcaagauaggaacccccaggcccugcaagaaugacucaaauucuaguucacauaacuacuggccaacuauagcagccuuggauucuaaauaaccuaccacaacaggcagaccucagaggucaugggauuuagacaugacccacugcugcacuagccucagcaacuaugggcuucaagcacacccuagcaccgcacuaauuauagaauucauggacuuuuagcccugcauuguggcaggcucuguauccauaaaauucugaccagucacuauaccagccauggugguucaggauauagggcacccccuaguacugcaauagcugcaguggucacgggcuuaaggaucacaccagguggcccacucuuaaccucuggacaggcuuaacacugaaggauauucauagacaaaggcagacugcaaagacuggaauaaguaucuacuucuacaguaugcagacaucagcacaugaccaaaaaaaucaagaauaaucaggaaaacaugaagucaccaaagggacaaaaguaauuggcaacaacuaacccugaaaagauggagauguaugaaaaaugccucacgauaaaguaaaaauaacuguuuuaaggaagcucaacaaaugucaaaaaaauacagaaaaacagcuaaagguaugaagaaaacauugugacuaugaugaggaaauaauaaauugaaauaauaauaauauuaaaucaaacagaaauccuagagcuaaaaauuacaacaaaugaaauuuuaaaaaucuauagagaguaucaacagaagaacuucguaaguggaagaggauucucuaaacugauacacaaguuauuugaaaauauacaaaggggaaaaaggaaauaaaaauaaagaaaaugcagaaagccuacaggauuucugggauaaccuuaaaugagcaaauauaauaaucauuggcauucaaaaaaaagcaaugacaguuaaagguaaaauauuauuuuaaaaauugaaggagaaaacuuuccaaacuuggagaaagauagaaauauuuacaggaagguaaaaagucuucauucugauuuaauuuaaaaaagauuacccucaaguuauacugcaacugucaaaaucaaagaaaaaagaggauuuggaaagcagcaggagcgaagaagcaaaccacaaaugacgagagcucuaauaagccaauagcagacaucugaagaaaaaucuuacgggcuaagagagagcaggaugauauauucaaagugcugggggaaaaaacugucaacaaaaaauacuaugcccugcaaagcuguuuuucagaaauaagauaaauaaauaauuucccagacaaacacaagcagagaguuagucaccaccuuacaaagaaugcuacaaggaguucuucaagcugaaaggaaaggacaccagugaguaaaacaaaaaucacugaaaguacaaaacucacuguaauguaaguacacaaaaauucagaauauuuuauuacucuaugaugguguagcaaccaaacauuuuaauaugacaguuaagacacaaaauuauuaaaauaauaauaacuaaaauuauuuguuaaucgauaugcaauauaaaaugauguaaauugugacaucaaaaauucaaacuguuagggaggagucgaguaaaaauguaaacauuuuugcuuuugcuuugucuuuuuuuuuuuuuuugcaaucaaacuuaagcuguuaucagguuaaaauaacuuguuacaacaauaagaugauuuucauaagccucaugguaacauuaacucaaaagccuauaacagauacgcuaacagaaaaagcaaagaauaaaacaauuuucaugaaaauuacuuaaucacaaaggaaagcaguaagaaagaaaggaagaaugaaucuguauaacaacuagaaaacaaguaacaaaaagacagcaguaaguuccuacauauaaauaauaaaaaaauucucuaaugaaaagacacugaauagcugaaugaauuuaaaaaaaugacucaauuauauguugaaaugcacuacaagagacaguuucacagguaagggcacauauggacuaaaaaugagggaauggaaaccauuaaagugcaaggcuagguauaguuauaucagauaaaauagacuuuaagccaaaaucugugaaaagagacaaaaaggucauuauaaaguagucaauucgauaagaugauauaauaauuauaaauauauacacccaacauaggaccaccuaaauauauaaaguaaauauuaauaaaauggaagcgauaggcugaaauacacuaagaguaagcgacuucaucaccucacuuucagcaauggauaguucauccagacugaaaaucaacauagaaacaucauguugaaacuguccuacugacuaaaugaauauagcagguauacagacauaagaacaagccauccaacagcugcagaauacaccuccuucuuacuugcacagggaauauucuccaggauagaugcuauauuagaccaucaaacaagccuccacaaguuuaagauuaaagucauaucacguaucuuuucagaccacagugacauaaaacuagaaaucaauaacagggggaacguuggaaaauucccaaauaaauggaaauaaaaagcaugucccugaacaaacaaugggacaaugaaaaaauuuaaaaaugaaauuuaaaauauucuucagacaaauauaaaugggaacacaacauauucugcgggauauagcaaaaguaguucuaaaaaagaaguuuauagcaauaaaugccuacaucagaguauaugaaaaaucuccaacaaccuaaucuuguaucucaaagaacuacuaaagaaaaaaacccauaucuaaaauaagaaggaagggaggaaauaauaaagauagagcaaaaauaaauaaaauacagacuacaaaagccuuagaaaagaucaacaaaacugaguuaguuuuuugaauugauaaaugaaguagacaaaccauuagcuagaguaagaaaaaaagagaauacucaacacauauucagagacaaguaagcagacauuacaaccaaugccauagguauacaaaauaguauaagagaacauuaugaacaauuauauuccaacaaauuggauaaccuaggagaaaucaauaaauucugaacauacacaacuuaccaagauugaauuaugaagaaguagaaucucugaacagaccaauauugaauaaggagauuaaaaagaaauaaaaagucucccaucaguaaaaagcccaggaccucauggcuucacugcugaauucuaccagacauuuaaagaacuaauaucaauucucagauuuuucuaaaaaauugaaacaggaaaaaaauacuuccaaacccauuagaugaggccagcauuauccugauacaauuaaaucugaacacaaacuacuggccaauauuccugaugaacauagguuugaaauccuuaacaaaauacuaguaaaccaaauucaacagcaaauggaaaacaucauucauugugauacguuagauuuaccucagagaugaaaggauggcuuaccauaugcgaauuaauaaaugugacacaucacacuaacagaguggacaacaaaaauaauaugaucacuucaauagaugcagaagaaaccuuuuuacaaaauuuaacaugcauucaucauaaaaacacuccaugaauuagguauagacaaauaccucaacauaauaaaguccauauaugaaaaucccacaacuaacauauuaaaugggaaagaugaaaucuuuuccccugagaucuagaacaaaacaaggacauccacuguauuaguuuguuuucacgcuguugauaaagauauaccugagacuggauaauuuauaaagaaaaagagguuuaauggacucagaguuccauguggcuggggaggccucacaaucaugguggaagguaaaagucacuucuuacauggcagcaggcaagagagagaaugagagccaagcgaaaggagccuccccuuauaaaacugucagauauugugagacuuauucacugccacgagaacaguaugggggaaaccaccccuaugauuccguuaucuccccacggggucccucccacaacaagugggaauuacggaagcuacaauucaagaugagauuuggguggggacacagccaaaccauaucaucugcuuucaccgcuucuauuaacaugguacuagaaguccuagccagaacaauuaggcaaaaggaaguaauauaaggaauucaaauuggaaaaaaaaaguuaaaguauccuuguuugcagcugacaugauccguuuuauagaaaacucuaaagacuccaccaaaaguugucggaacuaacaaacacauuuauuaaaggugcaggauaaaaauuaacacaaaaaucaaaaucaguaguguuucuguacacuaacaguaaacuaccugaaaaagaaaucaagaaaauaaucuccuuuuugauagguauaaaaaaauacuccaaaaauuuuaaccagggaggugaaagaucucuacgcugaaaauuaugaaaaauuggugaaacauauugaagaagacacaaauaaaaaggaagacuuuauguucguagauugaaaguaguaauauuguuaaaaugucuauacuacuuaaagucaucuacaaugcaauucgaucccuaucaaaggaccaaugacauucuucacagaaauaaaaaaaaaucauaaauuuacuuuuucacagccaauugauuuccuacaaaggcacuaagaccacaaaaugggggaaaaaacagucucuuuaauaaaugguauuggauaaauuggauauacauaugcagagaauaaaacuaaauccuuauuucucaccauauauaaaaucaauuaaaaauggaacaagacuuaaacauaagaugcaaaacuauaaagcugcuaaaaaaaaacaaaaacaaaaacaaaacaggagaaaacuccaugacauuggucugggcaagguuuguuuuguuuuguuuuguuuuguuuuaaauaugccuccaaaaacacagacaacaaaugcaaaaaaauagacaaguggaauuaccaaaaucugaaauguuucugcauagcaaaggagaaaaucgacagaagaaacaaccuacugaaugggagaaaauauuugcaaacuauacaucugguuaacuacacaucugauacauucauggagugcuuuuaugauaaauguagguuaaauuuugucaauauucaaaauguauaagaaacugaaacaacucaauagcaagaauacaaauaacucaauuuaaaaugggcaaagacauuaacacacauuucccaaaagaggacuaacaggcauauaaaaauguucaauaucauuauucaucacagcaaugcaaaucaaaaccaaaaugagauauuaugucacuccuguuagaauggcuauuaucagaaagaaaaaagauaacaaguguuggcaaggauguggagaaaacagaagucuuaucaacuguugaugggaauauacauuaauauagucauuauagaaaauaguauggauguuccagaauaaauuaaauauugaacuaccgcaugaucuaacacuuuuguuaaugguauagauccaaaggaaauaaagucauuauguugaagagguaucugcucucauuuuuauuacagcgucuauucacaauagccaagauguggaaucaaccuaaauguuaccaauggaugaauggauuuuuaaaacauaguauauauacacaauggaauacuguucagccauaaaaaugaaggaaaucgugucauuuaucacaaaucgaaucaaucuggaggacaguauguuuagugacauaagcuaggcacacaaagaaaaaugucacaugaucucacucauauguagaaucaaaaaacaaaugaucucauagaaguagagaauagaauggugguuaacagaggcuggagugguuuggagggaagaauguggagauguucucaaaugaaacauaauuacagcuaaauaggaggagagaucuauuguauaguauggcaaccauagauaauaaucauguuguauucuuaaaaaacacaaagagaguugauauuaaguguucucaccacaaaaauaacugugaaguaauguauuuguucaccaaaaacauccacaaugagaaaaguuauauuuaagauuaauaaauuaucuuaauacucauaaaguaacuaguuuccauuaacacccaugugugugagaguuuuaaaucaccacagauauguaaaacugccauuuuacaauugaguauuugaaaugauccuacaaucacuaguuacauucuugggauagaggaaaacagcugcaugauguaaugacaaaaaauaaaauaaaacaaacccaaauugcuuuaugugagucacucauuuagcagaaauaauuucgcaaauuugcugcaaaguguauuucuauuuuucaugauugucacuauaaaauuuaaauuguauauagcucgaaaaauugcuuuccuaaucaucauaaaauuauucuuaagaauucaucacgucuuuaaaauuacacauuugaaaaggaaaugagaacuuuaacaguaaugcacaaaauaggaacaauaacacucagcugugcuuaaaacaauucaugaaauuccuuucuugaaaaggaaaauagagugcaguacaaaaacucugaugguaagauuacuugcucugugccugcaauaaaugcauuagaaaagaauuuguuuaaaaaaaaaucaaaacccagcucccuuaccacuuacuacuaguaaccuaugucauuugucacuuguucuauuucacauagauuggacuuaaauaaguuuuuaauuugaugcuguauuauguauuguuaguuccaugaaucaucuacagaaagugaguaccccacccacuuugcauugccuaaaaugcaacuccugauuagcaauagaaaaugaugauaauauuuauuagguucacaguaguucagcugccagacacauucuggcuuacuugauuuagagcaguucaaagugguauugguugaaccuggaaaauacuaaacauguugagaaauugucaaaggcaagccuuuuuuguuucaucuagaauaacuaauuugcaaugcucaagaugacaguaguggccaugacaaaauagucauauguagcacgacuauuuuuacaccacuuuaauaagguauuaaaaaagcuguacauauuuaauauguacaacuucaugaauuuggggauacguauacaccuguaaaaucaucaugacaaucuauauagcacuguuacaguagguaguaacaaggcuugagcggggcaggagggagcucucccugcucuccaccaggaaugucgggccaccaucaggugaugggcaggugguuguuaacugccucucuaaaauaauaacuggucacagccagcgccaggaaaaggcagucucccaauagauagaaaaaaaaccugaaacuggugaugcaaucagcaggaguucagggaguggacucaagcaugagcuuuaagaagcaaaauggcagaguuuacuuguuauaugaccuucuagguucauucgauuuguaagggaagaaugccucaccugagcacgcauacaaguccaguaaacacacugcacuugcucaccucccaagugccagcagcccacugcacaugcagacagcccaccccaaggcaagaaucaggggagaagagaugcaagacccuagaaauaugccaaccccaagucagaaggucaaauagggcacuugaucucucaagucacccgcuuggccuucuuccaaguguauuuuauuuccuuucauuccuucgcuaaagcuuuuaugauaaacuuuuacucaugcucuauugccuccaucucuccugcguucugccuccuugguugaauucuuucuuuggaggaggcaagaacugagguugcugcagacccauacggauucacugcugguaaccgcauggcaucuuaaaacaugugugagcagagaauagaauaagaaaacggauucacuagcaauuauaauucugguuaucaacuuguuacaaugugaggaauacauuccuaggaaggagauaaagcauuaauuuguuuuaaaauauacuuucaaauuucagagagcaaaguccuagcaaggauuuauuuaaaaauuuauauaauaaguauuuuuguacaguuuuguuucuaauuauugacaguuauguuagauaguugguucuagaaaaaaaaaaucuuaguaugacuacuuuuucuucauauugagacagccagguacaaagggguccccagagaaacucuaauuggccuguguacagggagaaugggguggagccgguaaguucuuuccauuugcagggggcaggagccuggccucuccuguucugggguggaaccugggauucaaucuaugaggcaggaaaccugguagcaggacuccggcuuugcugagagucccuguuccuuuuuauuuguuuuuacccaauaaacccugccauucucacccuucaaagugucugugagccuaauuuuucaugguugugugacaagaacacuguuuccagcugaacuaaggagaaaguccuacaacaauauguauuaaauuuuauaauacuugaccuggcaauaggaaaauauguagcauaaaacgaucaucuuuccuaucuuuacuaacgcucaugggaaggagguauuacucuaagauuuuuuuuaaaaguaguucugcugauuuuuaccuucuuuaacaugaaacuauaacaauacacauauaaaaggauuucuguuucuaaauaugauuaucuaaaagaugcuauguacuguuuaugcuacacagucauuccauaauauugauucauagcagaaacccuccaagggagauguguguguauauaauaguaccauuucucaguuggagucuuuugcuugauguaacaccaaaaccuugaaaugaauaguguuugcugagugaguaaagggacaaauauacagcuaucaucauucaagcaguaacaauacauuuaugauaaagcaguaauuucuucuuagcgaacucuuguaaaggcauucagcaaugcauaaucacuuauucuucaugccauucacauuguuaaguucuaaauacacaaaucaccauaacaacacggaagauuucaaaaaaugaucguguugaguuuuguuguucaacgaucucagcauuuuucuugauucauuaugugcccaauuguuuccacgagcaaaauugaauaaucuucaccauuauguugcacuuucuuuucaaaaccagcuuagcuaagucaucagagaggcuuauguaugcccagaauuuguaaauccacuccuauauugguuuuacaauguguuauuacacagugaaaauuugaugaaaacaauucuguucguaacuucuuucuuauuuaacaaccuugaaacauuucaucauauuucaaggugugccccacuguggcaguaauauuccgaucauguugggguggucugcauaaauauguuaccacauggguugguccugcagaaucauuucucucuucuucugccuucauucugaccucuaaauuuaaugauauugaagugcauaucagguguccuuccuuuacauuugaauuaaauucucuagcuacauuaugaacugauuucaaucccaaaauauuuaaaaauuaaugguauucuaaauuaaaugauuuagaauacuauauuucaaauacuauaucucaaaucuuucaaucaaauuucaacauuucaacugccauuauuuuuccuuucagacugggcuagaucuaauuuuuucuuuuuuucugaaugcauuuaguucuuucuugagccuuuaaaaguuuuuuaaaccuuauuuauguguguuaugcuuuucucaccuauuaaacugaaaccaguaggcacuggaaauuugccuauaggauauaagaaaggaaaucaaccaaaauggcaggugggguuucacauaugaacuaauucuuagggcuuucuauuucccccagaauccucugacuauggcacgacacuccagcuaaaccaaaguuuccuuggccguuuucuccuugucuaugaucccuucuuaaaacuguguggugacuucaaaaagucauuuucccuuugacugagucaaugagcuuuucuuauuaaugucuuaaaauuaaauuauccccagcaacauacacacagaccacaaaacaugugucaaucaaaacccaaacaacuucuaaaaauaacaucagagugacagaauuccaucacucuuuugauugaaugguuucucucugaaaccaagccugagguaagaaauguuuaauuaugaacaagguuuucuuugugaaaaguacuuggaacucaggggaagagaaaucagggagaaaaaaaaaucagccacagaauaguauauacucauaaaugaaacaaucuuaaaaccaaaacaacuaaggcuaggugucuauuuuuagugguaaacaagguauaaauugagaaagaagguuaaaggaacuuaaacacaacuaacauuccaugaucuuacaaggcagauauacagucagaccuccauggggauacacuuguuuuuguaauacaugugagagucucaagucaguagggccaaguuuuguaaaacauucuguccauguguauaccucauagcuaauugaacuaaguguccuagcaacucauucauugaaugauugagacucaggacucagcauggauaaugccaaaguuuucaucugaccuuaauuaaaauggaagauguuacucauaagaacaaguccacagaaguucaaauaucauuguacauuagaucuguguaacuauguccucuugcaaauccucaaccccuuuuuuuuuauuuuuuauuuuucucuacaggaccuaaguaaaauuguagguaaauauggcuuauuggacauaauaucccuguaaauaugaccagauaacuaugugauauuugauuuccauauaagccaaguagaucuuuuauuuuagguguuaaauguaaaaaaaaaaaaucaauggcacuaacaaagcaaaacaugugcuuggaagauuggggugacaacaccuauauuauuuagacagacagugguuguucuugaaucauaagcuaagaaaugcauuuuauucuguugccaauggagagccaacgaguuacuaaacgggcuaauuaugggcucauggaagcauuucaugagguugaaaaaugcgauggauaagggauggauuggauagaucugauuuaggagguccuacuuauucauaagugccuauguuaggcacuauaagcuccuaaccuagauuggugguugggcagcaagagaugagauuuggaaauuuaaaaucaugaagaaaacaagaucugaucauguauaauagcuuuuuguggguuuguuuguuuguuuguguuaaaggagucuccaguggauacuguuaugugcugacaagaucucuuccugacugaagaacuucuuagcccuuuuagccaaauuucuuuggcugagaaaaagucacuuuguccuacaucuacuacuuguuuccuggggcaaccuguauccagugacuggccaaaguggagacaaaagccucagucccaucaccccaacacaggccaguacugaagggacauccuagauuuaaaacugcuaacgaggucagcucuaggcuuugguaagaguacauugcaucccaaguuuuaucucuucccaauccuucuuucuuuccuucccuuccuuuccacagguagugaucccaagagcaccccuacaugcuccuacacgcuaaaccuccugcauacuuaucuccaucucagacccaaucaguaacagaaucaaagaugaugcugaguugccaagauuagggggaaaagacaauugugauauaaagcaaacaucuggcagacaagaagaacagguguguaagaaagaaauauggagaggaaaaaugaguggauuucagaauguuaacagugaggcgauugugcaguacaaaguagaaauguucaucaggaagcugaaaaacacagggcuccgauuugggagcaaguucacaacagaugcagauguugucauuauccacauggagcagagcucaauuccuacuuugaguauugcugucacugccuuugcuucuauuuuccugugaggaaauccaaauagccuaagaucuauuacaugauucuugauaagauuucuuuuaaacaauguucucuuuggucuguguauuagucauguguucaaauggucuaacugaagauacauaucagcaucuuggacaaguuuugagcaguguuaaacuauuucaucagcucaaagauacaauaacugauccuuuauaaagcuuccaacaagauaagaaauacccccuacccaaauaagucauuuucguggggacaauagagaauuuagugaaaucucgaaucauaccaaauacaaaguuuaagcauuucaaaggauaucaggcuaucaggacucaaacagauuuuuggaagugauuaaauguauuuuuucuaccucugugaaggacaaaaccuauauaguggcuaauuacgaucugaaaauaagauagaaaacauauccauauauauauauaaauacccuguuuuuauauucaaugugcuuaucaaaagccauuuuaaccagguuuucuaagauuuucuuucucugguaaguugaauucuagaauucaaaaauguuauauucuacauuaaaacuuuauucauuuuaugugaccgugaauuuuaauauugcacauuaaaagacauuuccucauauaggaccauaacagcaugugcauuagaaaguaaacucuaaaggaaauauauuaauucauuaacuuacucauuugcuaaaauauuaauugaacuaaaaacuaaaucauagaauuucagaaaguaagaggccuuucgugagaaaauugaggccuuggaaauagaguuacgggaauuuggauaagaauuaaaacuugaggacuuuuauguaccugucauuauacuaugcuagguucuuuaaugaaaguuuaucuuauuucauuuuuacagucacucaauuguuauaggaugauuauaaaauaguuauaaccaccuuauuguuaaccauuguacugaacaauaaauuugagaccgaaagaguuuaaguaugucaaaguucacaucauuguuaaguaacuuuccacuugucccugguaucuuucuaugaauauauauacauuuuucaguuaguuauuuaggcauugguaguacacaaaauacacaaaaugcuucaacuuauuucugugacaauaucaucacaguaacuauacuacacagcugucuucaaagaccugcgaagaagauagaaugaggccagaaaaaucucuccauuuuagacuaauuugaaguuuugcaaacuaauccauuuugaauaacaauuaauucauccaaaucuuuauuaacaugauuaucauaauuugcauaaucucagagugugaaaugucuauaggaauccugacauacuuagaguucaauauuuucauuuucauuuauuuguauuuaccuuuuaguacaaaaauacaggugcauuaugcaggacuaaaaguagggugcagugaguacuaauuaaugaauuucuuaauaauaaaugcuuuuaaaauaaaguaguucaaaaauugucaucucaaauggccuuuacaaaaaaggauaauaccucaaguauaccuugaaacauuuuucacaagaauuaagcauuuuggaacguauuugcuaaucauucuauaucuaauguuggcaucaaagaacuauguagcauguaaguccuuagacacugguuuugcucaccagcaagaaugcaguuugaauuuaauaaaauuauugagcuuugccuguguuccagguucuuuguuaagaacuuaacaaauauuagaccugacagaauuuuucuccagacgaggguucucugcagguucuucagagaacgaaacaacuuuauuuauauacaauaauugcuaauugccaaaugcuaguaaaacugaaucauaagaaugaucuaguaaaaaagaaaaaaacuauuuuauuaaaacaguggcagccuagaaaaaaacgaacaauccuaucaaagagugggcuaaggucaauaaacaauucucaaaggcguauaaauggccaacaaauauaugaaaaaaugcucaacaucacuaauaauuagggaaaugcaaaucaaacgcaaaucaaaaccacaaagcaauaccaccuacuccuacaagaauggccauaaucaaaaaaucaaaaaaucauagauguuggcguggauggagugaagagggaacacuucuacacugcuagcgggaauguaaacaaguacaaccacuguggaaaacagugaggagauuccuugaauaauuaaaaguagaacuaccauuugauccagcaauuccacuacuaggcaucuacccagagguaaaugagucacuaaaugaaaaagauacuugcacaaaaauguuuauagcaucacaauuugcaauugcaaaaauauggaaccaacccaaauguccauuaaucaaugaguggauaaagaaacugcgguguacauauauaugauggaauacugcucagccauaaaaaggaaugaauuaauggcauucacagcaaccuggacgauauuggagacuauucuucuaagugaaguaacucgggaauggaaaaccaaacaucauauguucucucucauaagugagagcuaagcuaugagaaugcaaaggcauagaaugacacaacggacuuuagggacucauggagaaagggugggagaggggugagggauaaaagacgacauauugaguacaguguauacuacuuggguuaugggugcaccaaaaucucacaaaucaccacuaaagaaguuacucauguaaccaaauaccaccuguuucccaauaaccuauggaaauaaaaaaaauuaaaauuaaaaaaauugcaaccuaaaguguuaccaaaaaaucauuuuuucuuaaaaaaauccuuuuuuaauaaaaauaauuaagauuuuaaaaacagacuuuaaauguuuaagugucuuggaaaaaaauugaaugccaggguuuggacacacuuaacaauugauaguuggccaauggcauuguuuaauagcuuuaauguuguccagaagaaauauuaaauauuuaaaauagaaacuucuuauuucuauaucugguuucuuuauuucaaagaaaagggagaauauuugugaaaaacuuaucgacuguguugaugguuaacuuuacugaauaugauuguuugaauuuucucauuaauuagcucaagaauacauauuaagaguaaauuuaaaaauucaguggcuuacgccuguaauccuagcacuuugggaggccaaggcgaguggaucacgaggucaggagaucgagaccauccuggcuaacauggugaaacuccgucucuacuaaaaauacaaaaaaaaauuagccgggcaugguggcaggcgccuguagucccagcuacuugggaggcugaggcaggagaauggcaugaacccaggaggcggagcuugcagugagccgagacugcaccacugcacuucagccugggagacagagcaagacugucucaaaaaaaaaaaaaaaaaaaaaaaaaaaaauucaagcauuuuccacaagcacuuuguuaugucuagguauuuugucagugucagacaucucaccauuaauauuuuuuuugauguaaugaacuggaguuucacgucaaugucccauacuuauugcuggcacuucacagaguaauuaaggacuccuagguguacauucucuuuucaucacugcuuuuaucauucuaugacuuaaauuaggaagauucauucuauuauaacuacauagaacugacugaaaacagugugaaaacuuuugccuaggauaguguguuuuugugacaaaagguuaauuucacuaaauucauuccauuagaacucagagagggcuauuucacucagaugcugaaacacaugaauucaaacugucaaaugcaaauucuacuaaaauuaaaugucuacuuaaaaagaacugugcuugaauuucaacagcauuauguuuagcugacggcaugcaaaauugccagaccucaauacugauuuauagcauuuccacugccagcaaacagggacaaugggagagccagaaggacucaaaaagaaaaccuaaucuuuccauggggaaaaaauauuagagacagaaauacuauaaaaauaaacuuaaugaggauguggagcuauuucaaugaaccacaccauugggagaagggcgaaauccuugccguggagauguaggacaccagccccucuuacuucuguuaucaucucauccuuucaaugacaggacacauuagcucucuaaaaugacauugucuuauagccaugacuaaaacugcagccauucuucacaccaagggagaauauaaaguggaacaaagaauaaaaaacagaauaggagagagaaaaaaaaauaaagugaaaacuaggaaagggaaacaggcaaaagcaacggagggaaaagcagguuaagaaaucuuuuuuuuuuuuuuuuuuuugagaugggguuuugcucuuguugcccaggcuggauugcaguggcacaaucuuggcucaccacaaccucagccuccaggauucaagcaauucuccugccucagccucccgaguagcugggauuacaggcgugucccaccacacccgacuaauuuuguauuuuuaguagagaugggguuucuucauguugaucaggcuggucucgaacucccgaccucaguugagccacccaccucagccucccaaagugcugggauuacaggcaugagccaccgcgccuggccagauaaaucuuaacaaggcaaugaaaaugauggagaggaagaacaagaagggcaguaggucugcaaagaaagcaagagccaaccugcaggcacauguuucuaauugcucauauauccucacuguauuugguaaaacacaaugaauauuaaagaaaacaucuucuaaguaggucuuuuucaccauggguauuuauaacauuucagagacaaauauucuuuauaaauucuuugaagcuguuaaccaguuccugcacuaugucaauugcaaacauauuuuuauuuccagcccuucugauggugacaaacaaauuugcucuagaagacuugaaaacugugugcuucacaaauagugcuccaaugaagauaucuguaccguaacagacaggagaaugcagcacacuuguuuuucaacucgccaaauggaaaaacaauggaagcccucaugcuuacuauggguacacccauacauacucugcuuuuccuggaaaaagaagauucaaauguaauauggaagagaguaucacauuugaaucuuggcguuuguaggguaguuguguguagcgauggggcaagggaggcauccugaagcaacucuuuagugcauuaauacuuuuugcuucacaucaauaauugccuuuuguuugguuuuguucuguuuuuuuugucuauguuuucuaaaauuguguaccuuuuuucaaguacaaauugcagaaaguguugaauuuccugagcagaggauuagggaauauacacuggcacucuuccucuagguaagaggguaaauaaaauuucagagcuaaucaaaaacaugaaaugaauauauucuuuccuaggcuucacacucccacuuccauucagcagaaucuuucagcagaaaacacaauuuuaaaagccauuuuuaggagcuuuuguuccagaaaugauuaauuaauaauugcagucuagaagguuggcauagaugguugaaggucuucuccaauugggacaauuuaucagucuacuauuucaaguagguaauuaucaaacaaaacuaucaguguacauuauguuaacaguguacuuuaauauugugguuuaacaaugaaucugaauuaagccauuggcagcauauuuucuaaaucuguacuuuuuuuuccaauuuugcagcuuaggcaaauaaucccuggauacguguagauaauaacaaacagauaucaaacauauaaauuuaaacaauaucaaagaauuggaaaugggcauuuauuuucaauugcuguuaauccaaaugcaaaaguagagcugucuuuucuucucuggaccuuuugacaugugcagcaacacauuuugcauuuuacucugucaucugugauacuggaaaugaaacacugagucugaucagaggcaucaagcaugaagccaagcagaagauacauaaguaucuuaugguccauugcccuuggugauugagcuagugacaucuaaaaggaacacagagaggucugacacacaacagcaucuuucacccucuuaaucacacacauagcaacacguguuccugugaagaaauacccuucuccaucuggcggcuacuaauugacuaauugagcaucaagacuuucaaagagugcuaaacaugagcaagacugaaaaugucuccucuguugaacugaccuaggauaauuuccuauagcuucauucguguaaguaacaacaaaaacuucucaaaaaaacacaaagaaugggguguuaauguuuguguuaaaauuuuguaguacauaacaugaucuuauauauuauauauuuuuaaaagauauuuuauaaaguuccacccuaaaugaguauguagaauauaauaauuaauguguuauaauuuacacagcuuuggguaaaauuuucuaaauuagcuuuaaauuguauuuuuauguuaauggcucuauauaccagggguuauagccuaugggccaaaccagcccaccaccuguuuuugcaugguccauuuacauguuuaaauggugagggaaaaucaaagaaagaauaauguuauauaauguaggaaaauuguaugaaauucaaaguccagugucaauuaauaaacuucuauugaaauacauuaacacucgcugguuuaugcuuuugcccugucucugaugucugcuuucaugcuguaauggcagaauugaauauuugugacgaagauuauaugcguucugcaaauccuaaaguauucacuguccggcccuuuucaauauaagguuugcuaacuccugauuuauaccaucuucaucuacuuaauuugaaauaaaaauauuuaaaguaagucuaaucguuuuguuuuaagccuuuucuagacauaccuuccuccuccaaaguuauuaacuuaaugauucaugaaaauauuccacuuuucuggaucuuucuuccccugugaccucuucugaaauaacuuuaaaguguucuaagccagaauacacauuguuuacccaauaauaaaacugaaauauuacuuugagauuaaaaaaauggaaaucaacguaaauuaggaauacaggauuuuaguuaagaaauccauacuagguuuuuaaugggcuacguaucacaccaagauacauucauauacaaguaguucaauccaaucagcagcacaguuugagcuaagaaugaggagaauuuaugcaaguuuauucugaaaauggcaaaauguagcaguaaaaaggguuuauauuuuugcuggguuaguaauacacauguacuuguuuucuacuguucucaucuauuuuucuaucccaaaauuuacacgaauaaaucagaaauaucuuugaauuaccauaauucauuuguaaaucuuauuucuuccaauaaguuauaacucuuugggagcagacacaaauuaccauguaguccuauauuuuuaggagaucaaucaauauuuaugaagugaaaaaugacuuaguugcacaaauuucuaaaguaucacagaagaugggucacugcccaucauuauuucugcuucuccuuccauaauauaaaucuauauccaagaaauagcugcuucuaccaacuacauuuuuuggcuccuuugcauaaccaugggaccuugugccuagggaauaugaguagaagugauguguauaauuucuaggcuaagggguagaaaaagcaguugugacuucucuugucuguuuuccacacucaguagcugaauguaggggacucuggaacccuaaaauagagugaggccaaaagaaggaaggaacccgaugauauaauuuugauguuugucuccucagaaucucauguggaaauguaauuccguguuggaggcggggccuggugguagguguuuggauuacaagggaucaugaauaguuuagcgcaguugccuuggugauaggucaguucaugcuagaucugguuguuucaaagagcauggcaccucccaccuugcuuccucucuugccacgugacacaucuguuucuccuuccccuucugccaugacuggaaacuacuugaggacaucagcagaaacagauguuuguaccacacuuccuguacagucugcagagcccauuaaaucucuuuucauuauaaauuacccaguguuggguauccuguuauagccacucaaaaacagauuccacaccuggucuccaauuauuacaaagcucccugccaaccaagauuaccuggacuguucugcuccugagaaucaaccuuccacugggcaaaccauugucaaucaaggacuuauguguuacagcagcuugaguuucaccgacacauacagcucaguccuuaccuguauuagcuuuuucauagcauuaauaguguugaucacuugcccccuucugacauucuguuuugccuuuugguuucuuuacuagaacuacauagguaacccccaccaacauuaccacaucccccuauccaccugauuuccuauuaaucuuucuggcuuuucauuuucauccuccucugccuguucauauccuccaaaaacucuguccugggcucuuuucuuuuccuggacaacgucaaugacuucaaaucuaauggaaaaagcaucacuaaccaacuaggacauccaccuggaaaaagguuacauuuaucagguuggugcaaaaguaauugcaguuuagccauuaaaaguaaugucaaagccacacuuauuuugcaccaaccuaacaugacuuagguuaaacuaaauauuaacaaaacaugugaaaauauuauaccuucaucaucugauuuauauuuuacucuucucuuuuauaguccucuuauaaggagucaguaauacagaguuuucagcuuacauaguuauuauuucuucuuuuuacaaauguaacccucuuggugcccucauaauauuuagacagauuuuacuuuacccuuugcauaauuugugggaacuagaaguauuucuuccuucaacaaacauuuuuuuggacuuauggcucaacacugcucauaguguuggagauacaggauuggagagaucacacucugcuuucacggaccuauuucaauuagaggaaaccagaugauaaacaaauaaaauaauuacagacacaaaggcugugaaaccuuaaauuguaauaauggaaaaacauggaaugaaauguaauuguggggcaaggguguuguuauuuaguuugaguaucaauaaagcacucucuguggagacaauuugagaugcgaucuggauaauaagaaggagccagccauauaaagauuggagggaguaguauucuaggaagagggaaacaucaaguauaaaagagacagcaaucuuuguaaaaauagaaggcggccaguguggcuaucauacacaguauaagacgaggccagggaaguagaaagggaacaggcuaugggaaggaauguggauuuuagagguuuuaaauacacagggcaacauuuagaguaaagacaacugggagaacagaagaguuaaggagaucuucaaauuguuaccacuaacaaaaucaauacugggggaaagucacuugauucucagguguuuggacucacuuugcuaaacaugggacucagaauuaauaggcauuaauguuuuguccaaauguagaaaaucaauaagaucuucagaacuuccacaggagguauagcuaaaccauaaauuaaccuuacucaaaaucucaaacuuuuaaaagugcucuguguuuaacuguaacaaaauuuuauucacacucuugcuuuaauacuacaguagaacuuacuuuucucauucauuuuccccaaugcacugagagcuacuugaaaggcuggacacuuucuuauuuauuuugggaucuucagagauuaacauguaauacucauuucuauuaauaaauauauauuuaguaaaguagcaagaggagaguuaaauauauauauuauauauauaugaucuuauuaucuaaauuuggacaaaauauuaaugccuauuaauucugugucccauguuuagcaaaaugaguucaaauaccugaugaauauauacauuuaacuagagagagggagagagagaacacaaugaggacugaaaaaucuccccuucuuaaauagucuuuugacaaauauguucccaaggcuagacucacagugccuuagauauuacuuagaggaaacuuuacagaccauguaguuuagcauuauuccaacuccuggaaaugucauuuuucugaacaggacaggcuuuucuggugucauuugaaagaguccuuuggcuggugauacucagcuggugcccuccaugugcagccuggcacagcgcuggguugaagaccgggucaaguggccaugaucuuugguuaaacacugaaccaccuuaucacuugcagugagaugcugaaauggcaaaccucuuacaaaacagaucuguuuugauuuugcaaagguaguugaauuuuuaaauagucaaauuaucucaaauuuuuaaagaauagcuucaaugucuuagcugaaaggguaaacuauaaauuaauaguuugcugaacuauaaagggcuccuauccacagcuaauagccuggucuaggguaucauucuacaggaagaaacaagggaaugugcuuuuugcuucacugccugaagucauuuaagaccuuuucuauauuuacuccuaucuuaucuuuuaaaaaauuccauuucuuuacacagucuucaaucccuuuuuauuuuuaagccaaaugugugugguaccacacaaauauuauaguggaguuuuauuuacuuaucucucuuccauaucaacccauguaauuugacaggauuacucauuugagcuuuugaagaucuaaaacucagacagcgcaaaggcauuucacuuggaaguucacugacaauugcaguuuucaguugcucaccaaaauaaauacauacauaaauuuaaaaauuauaaaauauaguaucuaagagaauguuccacaucaaaugccaguuuuucaaugcauauuauuuaagaguuuauuaaaacauuugauaaagugaaauaguuaauuuacccugucaugauuauguguucaacaauuuuagcucuggucucaacacugucuguuauuaucuuucaccuucagaguguuaggguucacauguggcaaaaagggcuaauaggccaucaaggacaggagacuccuccugagagucuuccaaaaccacuccaugaacgaucacucaauaauuauaucguuucauucucuacuggaauaacuguuuguauucucuuacauuucuauuccuuuccuucucuauucauucuuacaggaaguccaucuaugcacauaugguaucuuuaugucuccuucauucugauucugauucuguguguauaugugugugugucucuauguugugaacaccaagacagaagaaugauugaaguauuauucuucacucauuucucucugcaaguuuuacauugagucauaaacaauaguagccuccucccuuuuucauuauuauuuuauguuuuuuauauauguauuuucauuuauguucuggcucuaacuccuguggccuuuguuauaacguugggguucuuuagaccucaggagcaaaccucagaaaacagacucucucugccuuucuccucccuuccuuuuauccacucauuuuucuccccagggcaggaaucuuccuccgccuuucuguccuggagggggcuacaaagaaauucucugaucugcuugucugauuguuguucauaggcccccauuccaggaguccugccccauuccugggagagaagaauacugcacagcgaggccaagaagaaucgacagagcagacagaacagacaggcuuugccggguuucgcuacccagucuaugaggacuauaccuuacccuucuuguguaaugacauuucuccaugcuucaaucaugccuguccaaugcaaucuccauaaaagguccaagaggacaggguucgaagagcuucuggacagcugaacacauggagguuccuagagggugauguccccaaagagggcauggaagcuucaggccccuuccugcauaccucacccuagacaucucuucaucuguauccuuugucauaucuuucauaauaaacuggaaaauguaaauaagucuuucccugaguucuguaagccacucuagcaaauuaaucaaacccaaggaggagguggugggaucccugacuuacagcuggucagucagaagcacagguaaaagagccuggggcuugcaacuggcaugggaaguggagggcaggccugugggauggagcccucacccugugggaucugaggcucucuccagauagacagggucagaaugcaacugggcuggaggacagucagcuuguguccacugcagaacugguugcuuacuugguacauggagagaaagucccacacacagacgccuucugugcccacuguuguagugcgagagaagcaggaaaacaguuuguguuuuuaccucacaccuggccucugugauauuuuuagguuaacucaccacuugaauuaacaaaucuccaacaaacuugacaccauauuucaaauuguauuuuaagggcuccuguuuucagauuuuauuuuccugguuguguccacaaugaugccucaauaauuacauaccgguuucuucgcucaucaucauuagacuuuaagugguugacucuaugccaugaaagguaagaaauuuagcucccuuacaggaucaucugucuccccauccuucccugggauuugcugauaaaaauagcguuuucaugccucugcuaguuaccauaugucuuuaaacacuauuuugggacuucaaguucuuaauucacaugcucucuaaaauaucugaaaugucuaccuaggaagguguauguccccuaaugugugcucuggcaccucaaaauaaagccuuccuaauuuugagaaugggagauggaggagcacaucugugauuucaucuugaaauuuaucaccgcuguuauugucugugugucuagggugggagggguaaaacaucuuaguuucccuuagaucuuucaguuaaggacccugauuacaaucccgaacugacuauacuucacgccugcacucucagaaugcacagcagugauguggauuacgcgccugugaaacaugagccacuauuuuuuuuguuuauuauuauuuuuucuuagacagagucucacucuguugccuaggcuggagugcaguggcaugaucuuggcucacuuuaaccucugucugccagguucaagcgauucuccugccucagccuccugaguaucugggacuacaggugccugccaccaugcccagcuuauuuuuguauuuuuaguagagacgggguuuugccauguuggccaggguggucucgaacuccugacuucaggugauccauccaccucggccucccaaacugcugggauuacaggcaugagccaacgcgcccagccgugagcuacugucuuauucacucuggauucucucuccuugugcucccuucagaguccauuuuucagauaucacccaaaauauguacuucuguucuauccuaaaccagagacuucaaacaacuauuugcgaaaauauuaaauuaauagaaguuaauauacguauaccuggugaauauacugucuauucuuguuuugcuuuguuuuguuuuuuuagauagagucucucucugucacccagacaaucucugcucacugcaaccucugccuccuggguuaaagugauucucauccagguagcugggauuacggguaucugcuaccauaccuggcuaauuuuuguauuuuuaguagagaugggauuucaccauguuggccaggcuggucucaaaccacugaguucaaguuauccacccuccucagccucccaaaaugcugggauuacaggugugagccacugugcccaguccuauucuugcuucuaaagaguaagucauucuuuuauuuugcaauuuaaauguaccaacaucaauaugcuuuuacuaaaugugaagacucuauuuaaauaagauuacuaauuuccaauuuggagagauaacuuugccuacaagucgucacauaccuaagaguuucagaauaauuuugacuuuacauaacagaaaaucuaacucuaaauuugacaucuauaguuaaagguaaauaaguaacugacuuuauuuuuuauuuuuuuauuuuuuauuuuuuuuuaagacggaguuuugcucuugucgcccaggcuggagugcaauggcaugaucucggcucacugcaaccuccucuucccagguucaagugauucuccugccucagccuccugaguagcugagauuaaaggugcccuccaccacaccuggcuaauuuuuaguagagaugggguuucaccauguuggccaggcuggucuugaacuccugaccucagguaauccacccaccucagccucccugcccagcccaaguaacugauuuuuagugauagugugugauguucucauccccuguccucuauaugucuucaucuucaggcuagcaccuuucagggcaacaacauaacuaugauuauucuggguaucaguccacacaccccagcauccgguaaaagugagaaucuaucucccucauccuaaagcaaaacugcuggacuucacuuuguuuugaccuuaugaagcucuuguacacccuugaaucaagcggcaucauaggaggaauguaauucaugguaggacuggggccugagcucaauucauauucaugaagucaucauuguggcaaagggaagagauuaugauuauuucuuuuagaaaagggggaucaccuuggaaauccaguuggaacuaaucacacagaaacuucaugaaugaugccaauugggaagaauaugagagggauaccaggaaauuuacuaaccauguuuaugaugacaggcugccauucauauuaacuauaauuuuuauuaagcuaugaguguucacauaucaugccuuuuuaguuagaaauuagaguuuccauaaagcaucucacaguggaucuuuggaauaugucucaugaugguauugauuuaaucaggaauaaccuuaacauagguuuauuauccuaaugguuuuuaauuauccuuaaaagucaauauuucucuaaugacuuuacacugcauuuacuaucuuuugacuaaauaaaauugcaaaggagguuaucguacaucuuacaauaauacuggcuaauaguacuuucagugugaauggaucuguuccaucuacaucugcacuguccauuaguugccacaaaccauguguaucuauugagugcuugaaauauaaccagugugggccaggcgcgguggcucacgccuguaaucucagcacuuugggaggcugaggcggguggaucaccugaggucaggaguuggagaccagccuggucaacauggugaaacccugucucuacuaaaauuacaaaauuagcugggcaugucagcacgugccuauaauuccagcuacuaaggaggcggaggcaggagaaucacuugaaccugggaggcagauguugcagugagcugggaucgugccauugcacuccagccugagaaacaagagcaaaacuuccuuuaaaaaagagagagagagaaacgaaacauaaccagugugacugagaaacugaauuuuuacuuuaaugugaauuucuaauuuaaauagccacaugugaccaguugcuaugguauuagacagcacagaaucaaacacuguguguuuaauucauuagugccucugacugagguguguuaguuacaauaaccucaaaacugaugagccaggaaaaucaaccaaaucaguuuuucucucauauuccaauccaacaugacuauuuucaaauacauuaauaaaagguuuucaagcauuaaauggcuuucaaggaagccuuuugaaugcugcagaacauuuaccuccaaacuucucuuuauaacuaagcuacaagauucaaggcagcuaaacaauugaaagagcucuguggaauaaaucacccacaaaggcagacgcaguguuaaucuccaaaauuuucauuuuauauaugaaaaaauuuguuacaucauuauuguuuauuuuaaauuauauuaccugcuuuauauggucauugaugcaguuuagguucauacacagauaguaaauaauucuuuugugcuauguauuccauucuguacauauaacauacuugaaaauuguauucauuaaaauaaaacacaaauguuaaauuuugaaauuuaaaaauuugugcauuuuguaaauauuucagagaaauaagcuuuccucuguauugauuuuaauuucaagaauacaauuuuauuuuaaaugaaauacuaggcuaccuguauauguacauaguauauaguaucauuacuagaauauacauuaauaaagguuaguaaaauuauuaaagauugauaaaaucauauuuguugacuugauacuuguguuuaaauaugcugugugcuaauucauuuaguaucuaaucaucuucaaggaugauuuucccccucaacauuacaaugaccauuaauuguagcugguuaucuugucagucaucaagaggccauuuuaacaaguguacaugucaaggcuuuacccaagccacuaagaaaauucaaguacagauggaaguaaaauagcauauaugggaaaaugcacgaagaugaacauguauuagucuagcuauagcaucgaaguagaugcgugauauaaauuucuuaggauuaaaacagagcguuagauaagcaauaaauauacucuuuauuauggucugaaugcaaaauucauauauuguaguucaaaacuccaugauggguauuagcagguggggguauuagcagguggggucuuaugggaagugauuaagucacaagggcaggcagaguucucaugaauggaaugagugccuuuuuauaguaggccagagagugaccccucuccacuucucccauaugaggaugcaacagggaguuggcaaucugcacagaaaaggacccucaccagaggacccucccuagaaaagccucuucagcagaaccugacuacgcuggcaaccugaguuuggacuucccagcuuccagaacugugagacauucauuuuuguuauuguugauaagcuauccaccucuaaggaauuuugcuauacgagcccaaauagacuuagauaacccuucuauuuccucugcauuuuucucagauauagacaccuauuauucauaucgcuaguguuugagaacaaauauagugccuuuuuauuuuuuccucaaaagaaagccuuuccaauuuuuaguacacaauagauguuuaauaaaugcuuuaggauaaauuaagcuucugucagaggucaacauuuauuaagaguucucucuuuguacaauaauauuuuagggaaaaaagacuuucuuuaguauuaacuuuuuuuuuaauuauacuuuaaguuuuaggguacaugugaccaaugugcagguuaguuacauauguauacaugugccaugcuggugugcugcacccauuaacuugucauuuagcauuagguauaucuccuaaagcuaucccucccccuccaaccccacaacagucugcagagugugauguuccccuuccuguguccauguguucucauuguucaauuccugccuaugagugagaauaugcaguguuugguuuuuuguuauugcuauaguuuaccgagaaugaugauuuccaauuucauccaugucccuacaaaggacaugaacgcaucauuuuuuauggcugcauaguauuccaugguguauaugugccacauuuucuuaauccagucuaucauuguuggacauuuggguugguuccaagucuuugauuuugugaauagugccgcaauaaacauacgugugcauguguuuuuauagcagcaugauuuacaguccuuuggguauauacccaguaauaggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuauugauugccauucuaacuggugugggaugguaucucacugugguuuugauuugcauuucucuaauggacagugauggugagcauuuuuucauguauuuuuuggcugcauaaaugucuucuuuugagaagugucuguucauguccuuugcccacuuuuugaugggguuguuuguuuuuuucuuguaaauuuguuugaguucauuguagauucuggauaguagcccuuugucagaugaguagguugugaaaauuuucuccgauuuuguagguugccuguucacucugaugguaguuucuuuugcugugcagaagcucuuugguuuaauuagaucccauuugucaauuuugucuuuuguugccauugcuuuugguguuuuggacaugaaguccuugcccaugccuauguccugaaugguaaugucuagguuuucuucuaggguuuuuaugguuuuaggucuauuguuuaagucuuuaauccaucuugaauuaauuuuuguauaagguguaaggaagggauccaguuucagcuuucuacauauggcuagccaguuuucccagcaccauuuauuaaauagggaauccuuuccccauuguuuguuuuugugaaguuugucaaagaucagauaguuguagauaugcggcauuauuucugagggcucuguucuguuccauugaucuauaucucuguuuugguaccaguaccaugcuguuuugauuacuguagccuuguaguauaguuugaagucagguagcgugauaccuccagcuguguucuuuuggcuuaggauugacuuggcgaugcaggcucuuuuuuggugccauaugaacuuuaaaguaaacacacauaggcucaaaauaaaaggauggaggaagaucuaccaagcaaauggaaaccaaaaaaaaggcagggguugcaauccuagucucugauaaaacagacuuuaaaccaacaaaaaucaaaagagacaaagaaggccauuacauaaugguaaagggauuaauucaacaagaagagcuaacuauccuaaauauauaugcacccaauacaagagcacccagauucauaaagcaaguccugagugaucuacaaagagacuuagacucccacacaauaauaaugggagacuuuaacaccccacugucaacauuagacagaucaacaagacagaaaguuaacaaggauacccaggaauugaacucagcucugcaccaagcggaccuaauagacaucuacagaccucuccaccccaaaucaacagaauauacauuuuuuucagcaccacaccacaccuauuccaaaauugaccacauaguuggaaguaaaguucuccucagcaaauguaaaagaucagacauuauaacaaacugucucucagaccacagugcaaucaaacuagaacucaggauuaagaaacucacucaaaaccgcucaacuacauggaaacugaacaaccugcuccugaaugacuacuggguacauaacgaaaugaaggcagaaauaaagauguucuuugaaaccaacgagaacaaagacagaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggaacugguuuuuugaaaggaucaacaaaauugauagacugcuagcaagacuaauaaagaagaaaagagagaagaauuaaauagacacaauaaaaaaugauaaaggggauaucaccaccgaucccacagaaauacaaacuaccaucagagaauacuacaaacaccucuaugcaaauaaacuagaaaaucuagaagaaauggauaaauuccucgacacauacacccucccaagacuaauccaggaagaaguugaaucuccgaauagaccaauaacaggcucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcauuauccugauaccaaagccaggcagagacacaacaaaaaaagagaauuuuagaccaauauccuugaugaacauugaugcaaaaauccgcaauaaaauacuggcaaaccgaauccagcagcacaucaaaaagcuuauccaccaugaucaagugggcuucaucccugggaugcaaggcugguucaauauaugcaaaucaauaaauguaauccagcauauaaacagaaccaaagacaaaaaacacaugauuaucucaauagaugcagaaaaggccuuugacaaaauucaacaccgcuucaugcuaaaaacucucaauaaauuagguauugaugggacguauuucaaaauaauaagagcuaucuaugacaaacccacagccaauaucauacugaaugcgcaaaaacuggaagcacucccuuugaaaacuggcacaagacagggaugcccucucucaccacuccuauucaacauaguguuggaaguucuggccagggcaauuaggcaggagaaggaaauaaaggguauucaauuaggaaaagaggaaguuaaauugucccuguuugcagaugacaugauaguauaucuagaaaaccccauugucucagccuaaaaucuccuuaagcugauaagcaacuucagcaaagucucaggauacaaaaucaauguacaaaaaucacaagcuuucuuauacaccaauagcagacaaacagagagccaaaucaugugugaacucccauucacaauugcuucaaagagaauaaaauaccuaggaauccaacuuacaagggaugugaaggaccucuucaaggagaacuacaaaccacuucucaaugaaauaaaacaggauacaaagaaauggaagaacauuccaugcucauggguaggaagaaucaauaucgugaaaauggccguacugcccaagguaauuuauagauucaaugccauccccaucaagcuaccaaugacuuucuucacaggauuaguauuaacuuuuauuucaagaauauaguuuuguuugaaaggaaauauauagguuacaugcauaugaacauaauauguaauaauguuacuaaagucuacaucaauaaaaauuauuaaagaacaaaugaaaucauauuuuccaccugacaucuuuaaguuauucaacaauuuguuacacauaggccuaucaugaagauuaaaugagguccaauguaaaaacguuuaguaagguaucugacacacaaaaccagaucacuaaacauugaucuucugugaucaauagauuuuuccccuuccuuucacccaagcagcaucaacuacugugcaccguuucauguacauucuaccaagugcuucacuuccuuuuggcugccugugucccaccuccaagaaauuacaauuuggggcuaccaugcguugugugaucaugguuuugcuuuuuaaaaauuaucuauuaaauaccucuuuuacacuauuuaguauacaauagauuuaggcugaacuagauauugaauccagauauugcugaggcaggaguacagaaaagguuuuucugcuaugauauauggucugguugaucugaagcucaaacccugcuaaugaauaaucaagcaucaucuuuuccugaguacauuugcauugugaauuggaugcuuguguucgucauuccccauccuccauauauacuugcucauacuguguaacacaggaaccuaagaaucauuugucuguaggagaaauggcuggggaugaaacccucaauaguagcucaaagauauaaauauucaucugguggauugagcagcccuaaauggaggccagauugcagauauuaaaagaguaaacuggugaaucaccuuccacacuaaggccuacgucaaaggcggcagcugguucugggcacagccugagcucuugggcacagugaaugcucccuggcaggagaauuccauuuuauacaugaauuuucauguaagagugugugucuaagugggaaauauuguacaggcaugggugauaacccuuugggcucagagaguuugugccuuucauaaagcauacacagaugaguagacaauuuucccaaucaugcuaccagaauacuucuuccuguucaucucugugcauguuacacuaagaccagaaggaguaagagugagacugauaaggcuuaaaguagaaguugcguacagagacaaugacaaucccaaauaauuuacguuuccauuauuagacccaacuagagaggcucaaggagcaccacuguggagcucuauggggagcagaaauugugguguccagccacaaaggugacauccacuuccacuucacuaagagaagcagaacaugagagagucagaacugaugccaaggguuaccucugaacaaccauaaugauauuuuagaggagauaccuggaagauugaaguucuugcuagucuagcguaagguuucucaaaaccauggucauguguauauuccugcaaaugacaccuguuguacucaaaagugugcgaccccucacauaccuguuuccaugaugugucuaauucuuagucauuaucccucugaauaaaguuuagucaagcacuacauaacgguuuucuauagccuggauauuucagcagauucaccucucuauaaaucaucauuuuaauuaucuuauucuauaauuuaaaacuuuuaaggguccucuucuauuucccaccuaaacuucaaacaucuuugcauucaaaaccauccaacuucugcuuguacccaaaauuuucaaccuuuacuccuauuuaguacaacaaaauacccauguuuaguuaggcuagaguguacgccauucaagaaaaaugcaauuuaauacaccuugccugaaugaccugcaagaauguauugugcaaaauccugagggauuugaaguaagaaaaacccaaugugaguucugacucugcuaauuuguccaacacugguuccuagcauccuccucuauaagacagugauaugaauaguuacucugcauuuagagaagaacaaagcagcccaaagacugugagauggguggaaagaacauggcucucccaggguuccauuaugcucucuucucuacagggcagucuccauccaucaggguacugcuugacagcuuugagugccugcaauucuuccuuaguuuuaaaugauugcacccccucuccucuguacacauggaccccaccuuccugccguucuuacaugacucuuaucaugcaccuucuucucuuguacauuucaaguuuuacuuauuauuuaaguauuuaugcauaagcuucuuugauuuauaucauaugauaagcuccaggaggggaguagcacuguuuuuuguuuuguuuuguuuuguuuuuuuuauaaauucauuuccuaaacgauucucaacacaauguucuacauuagggguuggucaacucuggccagucaccuguuuuaguaaauaacauuuuuuuuuggaacagucagccaugacuaucugcuuagguauuguccauggcugcuuucaugccacaagggcagauuugaauauagagacagaaacugacaucguuuggcugaccgauaaagccuacaauacuuguaucugguccuuugcagaaagaguuugugaaccccugcuguacauaaaaaggagauucaggaaacauuuguucaaaaauuuaacauuugccccaaacuauuucuacacucauggaaaaccauuucuacauaaauuguuccucugaguccaguuccagguuuaagauaucuuaacacugaaaggagguaauauauuuuaucuuaauaucaccuugucaguuuuagugcuggaagauauccaacacugcagcuaacaaauugaucuguacuugguguuaaggagcugaacacagugaauaccuuuguuuuaggacuuuacugucuucuauuaagacaucugggaauuuaaauuuaaacaaaucaguuuuaaagacaaccccaaagaauacuuaguuacaggcuauucuuuuacagaaacauaaacuucauuaguaagugacaaugauuagaaauuuugcauguuuuuguaacacuuugcagcaaauucuauuguuuuccaaauguucacuaagguuuggaucuuaauuaagaucacaguauucaaaauaacaccaugaugaagugauuuuaauucagaaacaguggacuaaggcuaugaagaaaguuuccaauucugauuuggaucacaaauaggacuuuaauagaucaagaggaaacucauggauuuucucauuuuuugccuccacugcuggugaucaguaaauugagauggcuuguuguucagaacccucuuccucagaguuuucuaaucuuccaaaaggcauccacucaacauaaaaaaaaaaaucauccugucuugccuaauacagugaaauaaauaaaccagugucuuccagccugggaagaugagcuuucagacuguuucuuugcaaaucagaauccuacaguguugagccauuuaaacuucauaagcuacacaauauccaaggcaguucuacucagauagcaaugcuuuaauugcuuagugauaacaagggacaauaugaaacaauuuuuauaaaucuaaauaaauauuaaacaccaaaucgauuuuucaacacuaugaaauuuuguuuuuuuuuacuuauuaugcccuguuuuaaaucuggcugaauauauuuaggcacuauacaucgugcugucaaaaaaaucugaauuaauuguguuacuauuuaagacauuguguuuuauucuugaaauaagcagguuacaagggaauauaauauuaaucuauuaaaugagauauauuaaaaaugaguaaggcaaaaacuaaaccaugacacuugaagcacaauaugaaaacacauuuugagacucaggaaguaaaauaaauaacacauguuuaggacauuuuucuuuccucuaucaaagauuuuuaagacuggcuaaauuucauggcauuaagcaaagauacaugacauuugagacaaaagaauuacuguucaaacaaagacaaguaaaauugaagguaggauucagaguaauuuagguaauuaucaaaugaaauaaaauuagaaauagauauauuuuagagaacuucuagucaacuuuugucgaucauuuuuauuucauuugaauucuuuauuuagaagucaacuuacauuucgcgguagccaaacucuuuauaaugaauuuucucaucaguccuccguggugagguaucaagugcuucguaauaguccuggcucugucccacacggaucaccuugcauaggcacacuaacuguuucuccugaaugucaucaucagaugcaauuuucaugcucacuuuuuacauuuuaggaauaggccuguuuuccuucaaaaucuccaguagcuccugaucuugggagagcagucuagggugaaugugaaauguugaacucaauuaucuuucagauguccuuaauuuaaaauucuauaauguuggccaggcgcgauggcucaugcuguaaugccagcacuuugggaggccgaagcagguggaucacgugaggucagggguucgagaccagccuggccaacauggcaaaacccugucucuacuaaaaauacaaaaauuagcuggaugugguggcgccugccuguaaucccagcuacucaggagucugaggaaggagaaucgcuugaacccaggagguggagguugcagugagucaagaucgugccacugcacuccagccucggaaacagagcgagacucugucucaaaaaacaaacaaacaaacaaacaaaaaaacuauguuaacuaauuucauuguaguuuuuugucucuuaguucaaugucauauuuuacccaaaguggguuaaaauaugcugacucccuuacucccuuacugauaaacuuaggaaccuucaauccugcaucaucucaaguauuccuuacuuagucagaagaagaauuuugcacucaaauaugaacucaacucagguugaucagcaacaguaaagaucggcagcaguaaaaauagacuguguuaaagaaaaugcacaaaacacagcucuacaguugcucauucuuucauuuguucaacaguuaucuuauuuagcaaaaaucuacuguuuuggaagcucuuaaugcacugggaauauaaagaagaaauaacauacagugucucuguucucaagaaucucacaacaguaaagaucaaguuuauguuagaaaacaaauuauacugaaugaacaacaagauuauaaaaucuaggagaaauaugguguuuagaguuaucuaaacaggucacaaaaguaaccacugcguaacuggaguaucauuuucuauguuuuaagcaagauaaugugcauuaauugucuuuaauugccuaagucucucuaugaccucaagcagcucauuagucacuccaagucuguagcacauucagagaccguaaucccuggcaccauggugauuucaggagucaaauuuagcucauuccccagagaaugauucauuuuucauuuucagauggugagaucaugcugcaacuuccuaauagcucaugagcaccucaagacugugucuugugucauacauuucccuauuucuggcacauguggcugugcucagcauugcaagcauucccuagcucaacaauaucagccgccugucauuccaccaugacgauauuauuuucguucccauuucucauuaaauuuuccagggacaggagucaccaauauaugacauaauauaauggcauggaauacaggggcagugacugaagacugaagacaacuuucaggguagaggguguaaaaaugaaagaaaguuacccuuagagagaaaauggaaaaguuccaaugacaaaugccccagcucucauaguucuucacuucgaauuacaccuuuaucacucaaauacaggucacagcaaaauuguuaauauuugccuguuugcuucacauagguagacccaagacccugaccagcguuauuuaggucccuacaugugggcuaaugguugcauucuuuauuggcaccuaggggaccugccccggaagcaguccucccugggcugagugguggcugugccugcaggggucacuacuagcugauaacugacaaagggcuucacugguacugccagcaggggaaugaaaauguaaauggguucacgggucacuuuaugucaaguggaaaaugaauaauaguuuuguuccugugagccagagaaaagcacgcaucauugaucccucaaggauuaauuucucaugauaaauguaauugucuaaaauaauaguggggaagaccaaucauucuaaaugcaaagcccagagaaugagcgggugagagcugcccacuuagaaaaggagaaagaauucaaaaggaguagcaaaggaguagcuaaagcauguccuuuagcacacagugaacuacuggucucuggaaccuaaggauucucucacagcuagaggucacaaguaaaggagaccuacaugggcaguauguuuauaacugggcuauuaaauguauggggauuuucuaaaaggaaaaaaaaauaccauauuuaaacuuuggagaaccuuagccuuagauuggcugaaauuacaauauugaaacaucauagcaaguuuucuugcauguaaggauuugucuauuguuugcagugauauaaagaacaacuaauauuuucauuguaauucuuaccaaugcaucucagauuguugauaaauuuuugaauaaauccuuauaugccuuguaugacaauugcugcaguguaaaauauauucacagaaacugcaggagaaagaguaauuuuucugaaugccacaucauauuucaaaugaccacuaugaacuccguaaaaagaaaaacugcaggucauaguuuaaucagcacaggcacugcacagaaaaguacaggaaacccagagccugcuuaagacgauuguccaauuccuaacuggccucucucugagacccagcugucaaagacucaugaaaugcuaaaacugagaaaauagaaacauucucaaaauaaguaauaagaauguuuaaagaaaguauaguaacuauuugcaaagagaaagaugugcauuuuggaccugaaugggauuauuaaguguuguaauguaguuauguagcagggagaaaaagaaacuuauuuuuuuccccaguaggauggcauaaguuaggagaacuuucagugcaagaaaaggaaaaccuagggcaagaugugguaggaguaagguguggccugcaagacuggcgagaagagaaggugagugucaggugacacgaaaacauuugcgaguggacaaccugugccccagggucaaggggaaaagaaaugcuaccugugacagccaaguuuuaaagccccugcucucuucuuacuuaugacagccuagaugcuccuagucuaaaguuggaaucccuaggucucuccaauaauuacugacuuuaaccucagcuugacaaucuaagucccauauucugugcauuugaccuuauccuucuugaaaccuuugcuuuggcucaagugugcuguuccuauuuuacaaucagccuggaaaugugauugcaguucguauucuuauuucuuucuuuuuuuuuuuuuuuuuuuugagacucgcugugaugcccaggcuggagugcagugguaugaucucagcucacugcaaccacuaccucucggguucaagugagucuucugccucagccucccaaguagcugggauuacaggugucugccaccaugccuggguaauuuuuguauuuuuaguagaggcaggguuucaccauuuuggucaggcuggucucgaacuccugaccucaagugauccacacaccucagccucccgaagugcugggauuacagaugugagccaccaugcccaggcuucuuucuuuuuuaaaaaaaauaauuuuacggugucaucuugacucuagauuguguaucugaguuugagcagaaucauaccaauaagagaaagauuugcaucuuuucucgcuacagguuauaaaagucaugauccuaggccuggcgcgguggcucacuuugggaggccgaggcggacagaucacaaugucgggaguuugaaaccagccuggccaauauggugaaacgcugucuguacuaaaaauacaaaaauuagccaggcgugguggugggugccuguagucccaguuacucggcaggcugaggcaggagaaucgcuugaaccuggaaggcggagguugcagugagccgagauggcgccacugcacuccagccugggcgacagagcaagacuacaucucaaaauaaauaaauaaauaaaauaaaauaaaauaaaaaagucauuauccuaauucaaagagcuauggaaaucauggggaaagacacagaauaugauagaaacgacaaucuuauuaguguugaguuaaacuaagaaaaaugauaagaagaggauuucuaaauuuaagcuuaaauuaagaaucauaaugaagagaaacucuuguuucagucaugcauucaauuaauuuuaauuggaugccuacuaugugccaggcaacaauauauugaggcuauauaugacagaugaaaauagcuaagaaaacuuggagcuuaaaagacauaaaaaugggccggccgugguggcucacaccuguaaucccagcacuuugggaggccgaggcaggcggaucacgaggucaggagaucgacaccauccuggcuaacauggugaaaccccgucuccacuaaaaauacaaaaaauuagccgggcguuguggcgggugccuguagucccagcuacucgggaggcugaggcaggagaauggcaugaacccuggaggcagagcuugcagugagcugagauugugccacugcacuccaaccugggcaacagagugagacuccgucucaaaaaaaaaaaaaaaaaaaaaaaaccauaaaaauguguugugaagaaaaaaaagcaucagcguaguuuuaaaaaaaauuuuagaugcgucauuuucuucuguguuugguacaugaugugugagaacaaaaguauguucucaaacaugcuauugcucacugccuuccuccaucuggauagguucuauuuguauuucucaaggaagaucaaauaucauuuucuaaauguuuucuucccuaugucacguaaaggcagcugcaccuuccugaggugccauucgccuuuggcacauguuagagacccaguaaaugcuaguuucuugucccucccuaauucaucucuaauuguaccauccaguagaaaccaaaugaauagacaauuucaagaauauguuaauauagugaaauuguacgcuauauucuggcuagauucuaauggucaugccucacuauaaauucuguacaucuaaaucauucuugauaguuucauugauuuagaaugauaaagauuguuucauuuaucaugaaugauaaagaauuaucauucuugauaaguccauguguauaaacuauuacacacuuggauuuauguacacccauauaaauccauuauucuuuguucauuguucuaauuaauuuuucauuucuguggguacauaguagguguguauuuuuauggaguacaugagauguuuugauacaggcaugcaaucugaaauaagcacgacauggagaacgggcuccaauucuuuuucaaugacugucaaaggcucucaguauuucacugucuaccccaagacugccauuguuucuaucacucuccuuuucccuggcuaccuaagcaaugaacuuuaccuuuucaucuauggccuggaaaacuuuaaaauaauuugcacaauuacucuaugcuuuuguguaugcuugcaacauguuuuuaaaacuuaauugcauuuaccguuuaggauacauucucacagagugaaauggagacuaaaauggucuaugcaacuuacauagauguacagucauaugccacauaacguugcagucaaggacacacugccuauaugauggugauuccauagauuauaggggaacugaaaaauuucuaucaccuggugaagucauagcuauccuaacauuuuaggacaaugcauuacauuuucuauauuuagauaugcuuagauauauuaauacuuccauuguguuacauuuacccacaguauucacuacaguaacaugcugaaaauuuuuauagccuaggaaaaauaggauauaccauauagucuaaguguguagggggcuauaccaucuaggucuguuuaaguacccucugugauauuuacacuaugacaaaauugccuaaugacacauuucuuggaacauaccccgguuguucagaaacacaugacuguucaugaugaugcucacaugaugagaaaucuccuaaggacgcaguucucaaaagguaucccugucacuaaaugacacguggcuguacauauuuuauuuuaaucuuuuucucuuaaugggaauacaguuaaauccccuuaaguuuaauguuccugugagauaauucccccaugcuauucuuguuucguuacucuuccaaauccauuuauccagugaucccauuuauauuuacucaaaacacaauagucuaugaaaacaugcauccagaaugucagccauuuagucgcuuacaagcaaggagacuuguacuucuucaguuuucaaggggauauuauacacagaagccuaaaucccaaaagaaaagugcuggaaauuguccugaguaggaaauacauuaaguauucauaauacugucuguuuucugaucucacacucuuuucacagagaguauauuuaaaauuuucccucucuuugccagcacaagcaggaaaaggagauaauugcaaauugcaauguacacuuggcuguaagcccagcugaaacccaauguggaagacagcacuuuuccuuucuucuaagguagaccuacaggacaugcucagauucaagaggaaacuucaagugauguagugaauaaauaggaguaaacaagauauuugcaauaauuagagagaugcaacuugauggcuuuuuugaaaaagggccuuguagauacuuacgcaaccauuugauauuaccacggucaugcacuacacaaacucuaaugaaggucagugcagaauaucucugaagguuuccuaacugaauuguuuacaucuucauuuuuuaauaccaagucuaaacauaaaacaaaaaacaaacaaaugggaaaguuagaaagcacuuugguucuaaaccaacuuguauuacaacuuuuccucugcuagaaucuaaugaucuccuucaucucuuucauuuuuaaaaucauuugugcuaggauugaauauaaaaacugacuuggagggggaacacuauuaaugaaaaaaaacguauacauaauaagaaaggauaaaaauccaucagucauggccaguguucuacaagaugcgaauuaucaaccuacugacuagugaccguuuacugcgguaaguaauacauuuaauauuuuguauucauguuaacugccagagacucugugaugacaaaccuaucagaauuaucucuuauauucgacacugcacaaauuaaacugcuaauuaaaaaaucaaacaaaaaugacauauucuaugcaguacaaucauuguaauuuucauacaucucuuccaacuaaaauuaggguaggaguaaugcauuuuaaaauaauaauuguaacaugcucuuaaaagaauuauuucuaggguugucuuaaaauguauacuucuguaauaucuucgauaaacuuaucauauuuacaauuacccuauuaauuugaaacaauaaaugauaccauuuucuauguuuaccuuagugaggcacacuguagucacuguggugcaaggagcucaaaauuuauacaaaagugguuuucugguuagaaaagauuuuuguuucuagugucuuuuucacuccuauuagcagggcauugagugacuaacuuuuuaagagacacuuguguggcauauaagcaggucuucgugcuaggaaaaguauaaacagcuuuuagaggaaaaaucuuccaacuacagggauaaacagucuuaaaucuucuuguauaugagaaauauuuagcaaaagaagaugaauguuaucagcuacuaacagcaaaugcuuggcaacaaugcugaauaaucaagaggugcaucaggcagagguagaagaacacaaugaagucgaugauaacagugaauauaugauuaaaucuauauuauaaguuuugcucaaguggguaccuaaauauauuuugucagggcaaaaaauuacuuacacuauccaaugccaaauaagguuguuugacaugucauaggaggugacaguuccaaacacaaacaagaguuuuaaaauaucuuuuuuguuucccacugcaaaagguuaucaucuacuuccucucucuuucuauugaugcuggggagcuuugcaugguuuaagacaaagggcauauuacaaaucagugaagaaauguggaauaauugauaaauguuucugggacaauugaauaaaggugaaaaaaguaaagcuagacuuggauuucacaucauauacuaaaauaauuuggggugaauugcagugguauaagugacaguuugaaagaaaguguaagagaguauaacauuuaaauagagaaauuuuuuucuugugagcaauaaaacacauaucacaaaagaaaauauugaucaauuaaagaacuuugcaaaaaaacaaaaagauauagaaacaaugugaaaaagcacagaauagggaaaaaaaauauuuaaaaguccaccagauccaucaauuacaauauaaaguugucugcuccaauaguugaaaucuugcugucaaauuccugacugauucaacaauucuuuuccagaaguaagaauauuuacguaaagaaguauguuuccuuuucuuuccacauuauaguucauugcuuccuucagugaacugaaacauaugcacagacuuuuuucaucuaugcauacuuuccauguuuaaugagccauuagugcagcauuuccauuacauugauugcauucauucugcuccagcaaagcauacauuucagaauguaacauguaucugcuguguguccauucaauguuaccuucuaauuuuagaaaaaauaguagcaguuacccuuaauaccauuuuauuaaacacuaggagaaaccauugcgugagagauuauaaguuaacacgauuuuauugcaaaggcauauaaaugcaagaaauaaaauuucaaagcaagaaauacgauuccaaagccucuuccuauauggaguaauucaagaaaaacaaaugaaauaagaguugcuuuuaucugaaaaucuuauaacccacguuauauggugguaucaaagcaauaauaguugauuauauacagcuaucagcaaaaacuagaaacaagauauaggugugcccuacugccuuuaauuuacauuucaauauuuauaacacuaugcugaaacagaauaaauauuuuuuuaccugauuauuauuugcaauagcuuauuucccuuuuuuugguaucugaaaguuaacuuuuccauugacaaguuuguguuauaugaugauuuuaauaacagagcuggaauuguucaaucagucggcauuugcuagcuuugucucagguacucuacuagaaauggggaauaaaaagaugaaugugauaucuccauuuucaacaaguucauagccauuugggggccaguaaaauuaauaaacaaagauuuuuguucaaaagguaauuuaauguuugauuauauaugaugcaagagguauuguuuuaugcuuauuucgaauuucguaauuggaauucguuacaaaccuauauagaaguuauuuucccuaguuuccagaaaaguaaaaauagcuagcauuuacugaaugaaugacaaaugcaauaauuuauguaaaacgagaugucaucgcuuuuuauuuauacuacaaucuucugaguuaguuuuuuuuaucaucucguuaaacaugagaaaacuaguuuaaacuacaaguugcagaacuagugacauacacacuaaaugauacauaugugauuccuaaguacacauacauucuacuauaguuugguaacuuuaauccuuaaaauaguauugguucuuuguggcugguacuucuugagcagcaaaaaugcuuauaagaccacuuauuauauggcucuuuuucuccaucaccugcuauugauuacucagaucuaaaauauccuugacuauccaucaaguuuuuucuacccagauauugucuugcugagaccagccuugagagcuagaauauucuaugaucuguucauuuacuuccaagauuucaauagaaguaauuucauucucacugaauauaauaaucuuaagccaugaacacagaucaacuaucaucucagaggacugucacuuacaauaaacaugugcuugcauuuccuuuaaauagguggcaugaagauuaauauuuuuagguucagaaauuccuaugauucugucuauaaaaaauuuguacuagaggaaugaaaauaaaucuacuggacaucuucugucucugugaucuuaugugccuuuagaaauguaagaaaaguccuuucuuauuuccuugagcugugguuuguaguucuccuuaaagagguccuucacaucccuuguaaguuguauucuuagguauuuuauuuucuguguagcaauugugaaugggaguucacucaugauuuggcucuuuguuugucuauuauugguguauaggaaugcuugugauuuuugcacauugauuuuauauccugagacuucgccgaaguugcuuaucagcuucaggagauuuguggcugaggcgaugggguuuccuaaacauacaaucauauuaucugcaaacagagacaauuugacuuccucuuuuccuuuuugaauacauuuuauuucuuuccuugccugauugcccuggccagaacuuccaauacucuguugaauaggaguggugagagagggcauacuugucuugugccaguuuucaaauggaaugcuuccaacuuuugcccauucaguaugauauuggcugugggucugucauaaauagcucuuauuauuuugagauauguuccaacaauaccuaguuuauugagaguuuuuagcaugaagagguguuaaauuuuaucgaaggccuuuucagcaucuauugagauuaucauguagcuuuucucauugguucuguuuaugugauggauuaugucuauugauuuguguauguugaaccagccuugcaucccagggaugaagcugucuucaucauggcggauaaguuuuuaaugugcugcuguauucgguuugccaguauuuuauugaggauuuuugugucgauguucaucagggauacuggccugaaauuuucuuuuguuaugucucugccagguuuugguaucaggaugauguaaaaacauuccaugcucauggauaggaagaaucaauaucgcgaaaauggccauacugcccaaaguaacuuacagauuaaaugauauccccaucaagcuaccauugacuuucuucacagaauuagaaaaacuauuuuaaauuuuauauggaaacaaaaaagagcccguauagucaagacaauccuaugcaaaaagaacaaagcuggagaaaucacacuaccugacuucaaauuaucuuacaaggcuacaguaaccaaaacagcaugguacugguaacaaaacagacauauagaccaauggaacaaacagaugccucagaaauaaugucacacaucuacaaccaucggaucuuugacaaaccugauaaaaacaagcaauggggaaagcauucccuauuuaauaaaugguguugggaaaauuagcuagccauaugcagaaaaccgaaacuggaccccuuccucacaccuuauacaaaaauuaacucaagauggauuaaggacuuaaauauaagaccuaaaaccauaaaaacccuagaagaaaaccuaggcaauaccauucagaauauagacaugggcaaacucuucauauguaaaacaccaaaagcaauggccacaaaagccaaaauugacaaaugggaucuaauuaaacuaaagagcuugugcacagcaaaauaaacuaucaucagagugaacaggcaaccuguagaaugggagaaaaauucugcaaucuauccaucugacaaagggcuaauauccagaaucuacaaggaacuuaagcaaauuuacaagaaaaaaucaaacaagcccaucaaaaagugggugaaggauaugaacagacacuucucaaaagcggacauuuauguggccaacaaacauaugaaaaaaagcucauaaucauuggucauuacagaaaugcaaaucaaaaccacgaugagauaccaucucacgccaguuagaaaggugauuauuaaaaagucaggaaacaacagaugcuggagaggauguggagaaauaggaacacuuuuacacuguuggugggagcguaaauuaguucaaccauuguggaagacaguguggcaauuauucagggaucuagaaccagaaauaccauuagacccagcaaucccaugacuagguauaugcccaaaggauuauaaaucauucuacucuaaagacacaugcacaagucuguuuauugcagcacuauccacaauagcaaagacuuggaaccagcccagauccccaucaaugauagacuggcuaaaaaaaauguggcacauauacaccauggaauauuaugcagccauagaaaagaaugaguucauguccuuugcagggacauggauaaagguggaaaccaucauucucagcaaauuaacacaagaacagaaaacaaacaccacauauucucacucauaagugguaauuaaacacugagaacacacggacacagagaggggaagaucacacaucggugccuguuggugguggggggcaaggggagggagagcauuaggagaaauaccuaauguagauggcggguuaaugggugcagcaaaccacuguggcauguguauaccuauguaacaaaccugcacauguaucccagaacuuaaaguauuauaaaaaaagaaagaaaaguaauugucugcauaaagaauggcaaaauuaggauucccaaggauagaagguuauuaaccauuuaucuugaauuuuuauaaacaucuuuaaagaaagccagaccaucuacauguacuuucagauaauauaauuauuucagaaaguuguuagaugcacauguuuucauauuaaggcaauuauuuuucuaauggauuuaggaaauuuguauuuuggggccucugauaccuaaggcaaaaaucacuguuguuauuguuucucuuguuaaugcuuccacauuucauccuuggaaucauauuaaucauuuccugacagaugagcaccaauuuuugcuaaauucuucgcacauaguauuauuaugucauuguuuuccucaagugauuagcaagaaucaauuuacagauuaaaaagacaaaaacaaaggaaaacaaaacccacagagcuuugugcucauauccuucaccauggcucugcaccacauaauggaccuugaacagggagaaauguuaagaguccuggaucaggucuguaagugccucaacaucaaagcaauggcaccaugagaacauuggccuauucccuucuuuaagggacaaauuaggaaaacgaggcuugaagaucacaauuucaauucaacaaaugcauugugauauaacugagaaaacaaaacaagaaauuuagauuucuucccagaaauaauuaugacuaaauaaugcaaggguauuuguagccccacuuccacuagaaccucaggaaauuugucuaaauuagcagcuuugaaaaggauggugauggaaaaaagaccugcagaagagggacaguuuucagaucagagucaaaaccucaggaccauagagguuuaccaggcaacguggagaaaucagacgagagguuguggcaaaagcaaagaacuauaaaaauagaaucugaaguaccgauguaguucagagacaucaggggauaagacugcuggaagagugcgaucugaggucuguuuccguauaggggaaaugcccuggggcagaagcuugcauguaucuugacaauuucauuuauccuaucuaucuuaaugucacaauaaaaaauaugugcccaucuaggcuuuauauaugcuuugauuggcuuucaaaauuguuuuaucuuuccuucuauguauccugauaugcaaagaugaaccuauuaugaagaaaaugaagcuuaagccccucacuuacacagucgguuaaaggcccugggaggagcucuugcagugucuucucauagcagguauuuucauaaaacuugcaaaaguaauauaguuaagcaugacuggcuauaaccauuguauuauuccugcuuccucuccaucacacuuccccuaaagccuaguaauguugaaauugcuccucugucuaccugccagucuauacagcauugcuacaugaauuacacagugugagguugcauaaugauaggaacaagucauaugaggcccaacaucuguguccuguguuguaaagaaaaaagcuuugucauguacaccaccacaaguuaauuuguggagaaugcuugcaacaaucagauguauaaaauugcaaggaauguauuuaauucaacaccucauccaaagaguugucuucuacuucauaauguaucauacacaauuauauacucaaaauuuauuguuuuacugaaggaaauacauuuuauaaagcacuuauauacuguaaugugaacauauguuuuggaauguuugauuuaaauauaauugagaaguucaaacuccugauuaggcccuaaaugaaggcuauuuuuuuugucagacuaacauuaauuuauaaaaguauagagauaauauuuagaugcaaaauuaauagaaaaugacacaacaaauaaagauaagcaauaaaauuaacagaaauuauuuuaacauugagaacaaauuauaacaaaaauuaccacaaaauuaucuuacaucaugaacuuaauuuucugucaaaaauaauuuuucugucuuuauuuuaggcuuugcaggcaacauggucugugucaccacuauccaaccccagagucauaggagaaaauaucacaugcaauaugcaaagaaauuggcauaaaauauuuggcccuuguuuuaaauaauaccaaacaagggauuuauuaagagaaaaagauaaauagcaaacagaauagcugcuuggcuuuuuuugauaauccaaguaguaacuuauaugaauaccuucauucaaauguaccuuuugcucauuugacaaaauacacuaacaucaacaaagguaacauaaaacuuuuuauaugcuauuauaaggugagaaaaauuuguuauaaauuuuaaaaagcauuuaaaauuaagggcuacaucaaauauuauaaaacuugaaauuuuguuguuguuguugcugaaacaaauucugccuuugucauucaugcugcagggcaauggcaccauuauagcucgcuguagccucgaaguaauagguucaagugauccucccaccucagucuccugaguagcugggacuacaggcaccccaccauguccagcuaauuuuauuuuauuuuuuguagcaacaggguuuugcuauguugcccaggcuggucucaaaccccugaucucaagcaaucauccugccucagccucccaacauguuugaauuacaggcaugagcuaccaugccuggcuuugaaauauuuugaaagauauauacauauauauauauauauauauauguauauauauauauauauacacacacacacacauacacacacacacacauacauacacacuauauauaucuagaaagauauauauguauauauauaguauauauauacaauauauauagaaagauauauguguguguguguguauguauauauauauauauauauagagagagagagagagagagagagagaaagagagaaggaacuugauagggguguucacaaagcugucaauuaucuuaaaaauuuacaaauuuauaugacauugcuaaugacaauuugagaagcuggagaaaaaaauuuaaaaaaugacaacucaaaauguacaccaccacuuuagcagaaugaccaaacuuuuuuuuuucuaacuucauauuuuuagccaggugugauggcaggugccuguaaucccagauacucaggaggcugaggcaagagaacuacucguacaugggaggcagaaguuacagggagcugaggucacgccacugcacuccaaccugggcaacaacagugaaacuccaucucaaaaauaaauaaauaaauaaauaaauugauauuuuuauugcaaauaauugucauaagaaaugacaaugaaagaagaugcagucuaaaucuacaggaacaaaaauaucuauaaagaugcuuuuuuggggggauuuugugaaugcuuguauuugcucuuuuucaauuaucaguuuuaaauaaugaucuuuuucuaaucuaauauuaggugagugaaaaaguaauugcaguuuuugaguuguuggaaccagcaagauguagaaaaugcuuuccaagaauucaucaaauccugaagcauggcuuuuuacgcuacaggaauaaauuuacuucuccuuggcaauaauguguugauuguaaugguuccuauuuuaauuaauaaagauguguuugagccuaguuauacaugauuuuaaauucacagacugaaacuguaauuacuuuugcaccaaccuuuuaccuuuaaagcucauuaucuauugcaauuucaaauaauuuuuuucuaauagccaguuccccaaauuaagccuccccuaaaccuaaaaaauguuauuaaagcucaauaaucaaauuuuuguuuuggauacuuuauuugaaaugaagauuuuuuacuuacuuuauauuauaucuguuccaucaauccuauaacuauaaauaccuaaggaauguuuuauuaaaauauaucauggaaauauauuuagacaaauaacauaaaaacaaugaacuuuuauuucuaugcuuuuaaaaaucacagacagggaagaggaaauaguaaaagcuuuuccgaggcuuccuuagucugguagauuuagacucaagcagucagauauuuucugauucuacaggggaauaaaaaguguauuugaagcagagagagagagagaaagaaaagggaggaaggaaggaaagaagaaaggaaggaaggaaggaaagaaggaaggaaggaaggaaagaaggaaaggaaggaaggaaggaaggaagggaaggaaggaagggucuccuuuucaguaucuuuuuaaacuuauugguagaaaacccaccaaaggucucucuuuggccccaccuuucccucuucuaaauuggagaaggugggccaugguggcaaucuaggcaggaggaggucuuagcacaacggcgaaguaguuuuaguguugugaugauuguucaaauauaaagagacaaagaaaaugaucauuguacucuuucuggagauggugggggcuuuggagauguaaaaugaaauaugaaauaaaauuuucuuuacauuuucuuacauuuccaacauggauuuuaagaaaagcagcaacauuauuauuaauaguauggagcugaaugcaguaaauuguagaaagcccuucgagacaagaacgagucagcauuagucugauucuagggccugagcuaaauaucuuuccuaauucuaugaaaagacgaagggaugaguggauuaagugauucgccgaccaagccuggggaaagaacaauuuuuuucaauuaagauccuucccaaucucucaaaauagcuguugcugcugcgccuuuuuccuccuccccuucuccucucucuucuuauuuucuguuuuccauuucuguuacgauuugauucaagauuugacuaaccauaaauacuuaaacaucaguauuguaauuaauuuguccuggugcagaaauggauauucccggguugagacagaaaaacgugccucagaaucuguuacaaaaaucaagcugaaacaccaguuauuucuauuuaaccauagcuaagucacacaaguuuacauuagaacauaaaacauggcagugccgugcuaaaggagaugcuuccagcuaagcagugauacagauguuagauaaagggugcagacgauaacaagaacagacaagaucguuuuuacacaugcaguucugaugcccauugcaaugaucacaaugagaaauaaaaccuagaggcuuuuuucaaaugucagugagacuauacagaaugcuuuauauguuuauuaucacgugcacugaguauuuuuauagcaacagguguucacagaagaaaaauauaaaaagaaaugccaacagaaaagacagaacauaaaucauucauaaccccaccaccuugagacaacuaccauuaaauugcuaugcauagccuuacgauuuuucuuuuucuuuuucuuuuuuuuuuuuagacggagucucgcacugucgcccaggccagagugcaguggcacgaucucggcucacugcaagcuccgccuccuggguucacgccauucuccugccucagccucccgaguagcugggacuacaggcgcccuccaccacguccagcaauuuuuuuauauuuuuaguagagaugggguuucaccguguuagccaggauggucuccaucucaugaccucgugauccgcccaccuuggccucccaaagugcuggcauuacaggugugagcccccgcgccugggcagccuuaagauuuuucuaugcauauguauaucuacauuaauaaucuugcaaguuuaggaaugucaucguugcugcuuaguauuuuaccuuauccacuuaacauuauuccuuuaugaauauuuucuaauuuauuaucauauuuauaacuacaguagguuguuucauaaaaauuaagauauaacacagaauuaagauucaauauaccauaugcaacacauaauaaaugugcuugauaacuguaaaauuaaaaaaaucuacaguugaucuuugaacaacauggguuugaacuucacaggucuauuauacauggauuuuuaaaaauaaacguauugaaaaaugauuggagauuugcaacaauuugaaaaaaaaaaaccuguagaugaaucucacagccuagaaauauagaaaaauuaagaaaaaaauagccaugucaggaacauauaaaauauauguugauacucgucuauuucauaauuuacuaccauaaaugauacacaaaucuaguaugaaaaguucaaauuuaucaaaacuuacacacagaaacgcagaccauauaugguaccauuugcaguugagagaaauauaaacaaaaguaaaggugcaguauuaaaucauaacuauaaaauuaacuauaguacaaauuaaacuauaguaauaacuuuauaguuacugcuauugcggugagcugguguugucaguauccuccuaaaaugcuguguuaugcuaaucaucuucauguaagcaguuuaucucuccaguaauugaguauugcaguaguaaguaauuucucucaguucuccuguaguucuuaucauuuuuagugcaauacuguaaaucuugaaugacaccauggggcccauacaaggugccacuagugaugcucgaagugcucccaagaagcagagaaaagucaugacaucaccaguaaaagcuaaauggcaugauauguaccauagacagaagccugcagcugcgguugcuacuacuucagaccaacaauucaccuuguaaacagaugauguaacuuagaguauugauaaauacaguacaguacuguaaauguauuuucucuaucucucuuuuucuuuguuugcuuuguuuguuugagacagaaucuuacucugucacccaggcuggagugcaguggcaugaucucagcucacugcaaccucugucucccagguuuaagcgauucucuugccucagccugccuaguagcuaggauuccaggugcaugccaccacacccggcuaauuuuuguauuuuuaguagagacaggauuucgccauguuggccaggcuggucucgaauuccugaucucaggugaaccaccugccucggccucauuuucucuuucuuaugaguuucuuaauaccauuuuccuuucucuuuaaaguaagaauacaguauauaauacauaaacauaaaauacacguuaauugacuauauuacaaguaaggcuuauggucaacaguaggcuauaauguuuuuuaggagucaaaaauuauauauggguauuugacugcaugacaggggggucugugcccuuaauucucacauuguucaaggguuaauuguacacucuauuuuauuuuacaguuuuaagccaacauguaaaaaugaacacuauuucuaaauuuuuacugugauaaauuauguuguaauagaaacauuucaauguccuuuaagagcuauucccaaucauuuauaauaaaagguggaauaguaaggucaaagauuaagccuauuuuaguguugaugcaggcaacauucaaugucgauauuuuggaaagauuauaacaauuaacauuggcauuggcaguucuccaaaacacacuaacauuggcauuauacauaaauuugauucucagucaauagguaauugugguauuucauuuauuauucuucuuaaugauagguugaacaugcauucuuuguuuuucauuggccacuccugugucuuuucaguaaguuauucuugcauauauauuguccuuuuccucccacugcagugucggccuuuuuauuuuaauuuaugcaaguuuuuuguuuuuaauaauaacugauauauagcuuguaauaacaguuacaaucauuuugaaacauuuucuguuuuucagccacauucuuguaauaguccuuguaccucacuccuuuuucccaaucuucuuucauucucccauguauuauauauuucaauaacuguaaugucauuuauuugaauuugaugagcgccuucacauaucuuauucucucugcugagggagaguaagugaguaaaguugguuuuucuuuuaggcuccagcauauauaaauuuguucaucuaacccacuguuucacugauaguuuaguuauguagagaauuuuacaucuauauuuuuucuucauagaauuuugaagguauuuuuccauuccauuccagugugcauaagaauuaugagacaacaucaaaaaagcaacuauaugaguuauagaaguuaaauaaaggaaagagaaauauuaaaagaauagaaagcauauuuaaagaaauaggagcagaaacauuuccaaacucaggaaaagauaaaaauauccagguacaggaaggucaaaguucuucauucagauucuauacaaauaagaauaccccaagacauauuaaaaucaaacuaucaaaaauugaagacaaagagagaauucugaaaacagcaagacuaaagcagcaaauaacauauaaggaaguuccaauauaccuaacuggagacacacucagcagaaaucuuacaguccagaaaagauuuggauaauauauccaacaugcugaagaaaaaaaaaaaucugucaaccaagaguagcauacccaggaaaacuguucuucagaaauaaaaaagagacaaagacuuuucuagacaaacaaagcugagggagcucaucaccaccaaaccuguguuagaagaaaugauaaagaggguucuaugaguugaaagaacaggacacuaagauuaacacaaaaacaucugaaagaauaaaacucauugguaagagaaaauacaaaguaaaguucagacuaucuucauacuauaauggcgguguguaaaucauguauaucauuaguaugaagguuaaaagacaaaacuauuaaauuaguaaucacuacaguaauuuguuaaggauuauccaauauaaaaugauaaaaguugugacauccaaaauugaaauguagaggggaaguagaguuaaaguguagaguugcuuuuuugugaucaaagauaaguugcuuuugcuuaaaauauccuguuauaacuguaagaugacuuuugcaagcuucaugauaaucacaaagcaaauaacuuugauacacuaaaaauaaaaagcaacaaaauaauuguaccacuagagaaaaucaccacaaagaagacaguaagagaagaagaaagaaucuucaaaacaacugggaaacaaugaacaauauaguguaguaaguuauuaccuaucaauaauuacuuugaauguaaauuaauuaaauuauccaaccaaaagauaagaaguggcugaaugguuuaaaaaaauaggaccuaacuauaguacagaaauggaaaaagaugucucaugcaaauagaaacuuuaaaaaagagcaagaauagcuagaauuaaaccagauaaaauacaauuuaagucaaaagcuguaaaaagagacaaagaugguaauuauauaauuagaaaguggcccauuuagcaagauaauauaacaauucucucucucucucuuucucucucuuucucucuauauguauauacacacacacacauauauauaacaacuauauauacagcaacuguauguauacgacuguauauauauauagugcaguguguguguauauauauacacaccauauuguguguguguguguguguguauauauauauauuuacuacacuaauguguagucacaaucucuguggagcuuaaauucaauuucaacccaguuuggccaacaagguaucaugagaauggcuucuuaucacugcauguguaauaugguaauacauacacacagcaaacacauaauuuauuaagaccuuccacacuccaccuuuaacacucuguuaaaaaaauaaggggcugggugcgguggcucacgccuguaauccuagcacuuugggaggcugaggcaggcagaucacgaggucaggagaucaagacauccuggacaacaaggugaaacccgucucuacuaaaauacaaaaaauuagcuggacgugguggcgggcgacuguaaucccagcuacuagggaggcugaggcaagagaacucgggaggcagagguugcagugagcccaaaucgugccacugcacuccagccuggcgacagagcaagacuccaucucaaaaaauaaauaaauaaauaauaaaaauaaaaaaagaaagggaccaaaauaugacgcaugagaauguuuuucgugacaucaaugaaauauuaaauuuuaaaaaauaggcaguauagauguaaaauucuaacucuauggcaauaaguucugccacuccuuucguacuuucuaaauuggcaauugugccaaaacacucuuuucuguaguguaaaccacaccucaggguuaguuuggcaauguguuaaauucugcuguaagcauuaguccggugagacuuuggcaagccgacacuauucaaagcagucaaaaauaaaauguaaaaaacugaaaaaaaaucucauuugugccaaguuaagaaagaaauacaaauauugaaaaauuuaaccuuuaaugcauuuugguuucccuugcauuuccauuuuauuccuuuaguuuuuuuguaggugcuaaaaccacuaagucuuugcucaaaaggaaacauuuugucuacuaagucugguuucuauaaccauaaaauugggaugcucuugagacacugagccccaucuauuacaggcaaauuaaaaaacugauggguuaagaaugaaguauaaugaaggaaaagagaaucaaggaaucaaaaaauuucuucuucucaugggaaccguaaaauccugaaagguaaauggcaaucacauucccacagcuauugcagugcuucuaaauagauaauuauuucaaaccauuuauuuugcuggaaaagauauuucagagaaagaaguaaaaauaaaaaaacccgaaguuuuaaugucgccuucauuauuuauguguugcucacaaauggaugagaggcaauuuugaauuuacuguaggcacauuugcuauauugaauucucuauuugcuaguuauagauguggacaaauggauaagaaauagauuccccaaauggaaaaugagcuacacagaagaauucaaaacgaacuccuauugugaguuucugaaacauacuauagaacaagaaaaaacauuguagacugccgcuugcuuagagcuacuaguagaagaaaaaaugcauuuuuucucauuuggggguagauuuacaguugaucauguguuucuuuggucaauaccuagcauuuguuaaguuuucuauuuuuuccuggguuggcagugauaaauauuuuuccuccuagauacauuaugaaauuauauuuucuuguaaaugucagguuuccauuuguccuacaguaaaggcuagccugcauugacaaugucuuucugcacuaaaacuuagauagaaggaugaugaauuuguaaauucacuuucaauaaucacucaauucaucaggauuguuagauuucugggacuaccaauaucuaaugcuuggcuugguauaucguaagcucaauaaauauuuguugaaugaugaauaagacaauagauuugagcacacaaaauaaaaaugaaaugcguaauuuuuugucccucgagaagcugaugggcuaauaaggaauauacagaauaauaagauuagcaagacauuucaaaaauacuuuacaauauuuuaacgaaauauuuuuacauggcaaucagaauaaaaauuauaaacauaauacccuaaacagaaucuaacauuuaaauuaauaagugauggagcauuaaugagaaauguuucacuguaacauggauguggaguggagggauuuguuuuugcagugaugucauucuuagaagcagaauacaauguacaaaagaaguaguuuuauauauuauauauacauauauauguguacauauguauacacacauguauacauguacacacauauauguauauauaauauauaaaacuacuucuacuucuacuacuuauauauuauauauguaaauauacagagagauauauauaaacacacacauauaaagcgcuguaucuauacuuaucuguggauuguaauuuuaggacgcucuuaauuuauuacgccaaggggaaaguuaagcuuuggagaugagucacauaguaugugugcaaguucagcuucuuagauuauagauuuacucucuucuucauuguucuugcucuguaaaugacuaggggagacuagagaucagacaucuuaccccuucaauucacuuaucuuuguuauagauuaacuaccucuuuuauugucauguaccuaacucagaccagaugguucaaacgaccucaugacuguuacaucuucaggguggaauguuaaauauacccuuccugaaagaaaaauacagucucaacuaaucagaucauuguaaauaugcauccagccuuguacagaaagauguugaaauucuuuuuagcuuccuuaaacuuugucucuauaaacaacccuaagcuucuaccaucagaacacugacuuuuagucuuuguaaccugugcuuccugaguggcugucuucaaacuuugugcuugaauaaacucuuauuaaacuagauucuaacccuuuuuaauuauuuuagguuggcauuauuuauaauuacaacauauucaacaccaucucucuuacacgugcauuuuuuuaauaaaauaaaaguaagagcaagagccaauggaaguuuccagggcaggugucagguacuuuacuaccaaccuuugcagccuugucccagccacuuuuuauaaaccaaaauaaaccacauaauuucaggcaagugccccugugagaaaagcuugugagaaaagcacuacccauagcaagguuuccucuucuuaacagaaauaaagaaauccuggaguuaacucuagugagaacaacuuaaacuuuaaaauauucaucauuuugaaaguguacaaguauuaacagucgguuuucgcuuuuauuuauuuuauuuuauuuuauuuuuauuuuuuuuuuugagacaagagucucacccugucacccaggcuggagugcaguggcgugaucacagcucacugcaaacuccaccucccgggacuacaggcgcgugccaccacacccugcuaaguuuuucuauuuuuuuuaaguagagacgggguuucacuguguuagccaggauggucuuaaucuccugaccucgugauccgccugccuuggccucccaaagugcugagauuacaggcaugagccacugcgcccggccgguuuucacuuucuaaaucccucgaugugagaacauacuuugggguauuccuaaacacuguuuucaaauaaauuaaaugaagcuuuuauugaucuuacaaaacugccaaaaccaaccuagaacucauguucaugaacacauuuuauuuuauuuuaaauuuaaaggaguuuagugaagcaaugaaaccuucgugaaucaggcagccuccagaaucacagcagguucacagagacucuaguacagccacaugguggaagaagaucuauagacauaaaagggaaguggccuacagaaauuggaagugagguauggaaacaacuggauugguuacaguucaguguuugcccucuuugaacacaguuuaaacacucagcagucuaugacugguugaaguauggcugcugggauuugccaagauucagauauugugacaaucccauacuucuaagucagguuuucaaucuugucuaccuauuaaguuagguuaugguucauccacaaggacucagauauaaaaguaaggaguccuucuuaggccacaguuaguuugcuuuaacaauuccccgcuuuuggucauuuucucaauuuugagagauuggccaaaacuuuauucaucgaugucacuaucaccaucguaaauguacuuauuuggucuugaaacccacuggaaaacaguagaacaguggguuuugcaaggugggaaugaggauugaguagaugguaccuccuuauacagaaacguccuguuugcaggagaaaaacaaaaccucgucuguucuaggaucuauguguuuccuuaaagucuuagcuugauuaugucacacuuagcacaagugacuccauuuuuauacaguuucuucuguuggugccuagugauugagcucaguccaaacaauagccucccguaauuuuguuuuaagaauucccccuuuuuggucagguucucauuuaggugagagugugaccaaacuuuagggccuuaaugcuacucucaguuaccaucauuuuggguuuccggucuuagcaccucauucauagauuacgguuuucccaugguugcauaguucuuucagcucuugucauuucuguugaagagagacuaccugacauucuggagaugucugaaugcaaacauuuaaaaccuuugagagcauacagcacaccagggagacuucuauuaugacuaucgggaggauaacaccaagaguugaaaguauggucccuacuagggucuccauaaaccaaaucacuuaaaaucaaauagaucaaagaaugagcuagauaaagaguuuacucgcuugauuaaguaguccucuucuuaauccccuacaacugagugucuguaauacccaaugcuuucuccacaagacauaagugccagcagcugcacagauacuucuguuuagccagucagcaaucuaaagcaauucgauuauuuagcauaacuuucacaagagaauuuaaaaucugcuguguaauuauagccuuuaaaguagaguuugcuagacagcuuaucaugagggauacauuucuaaucauugcuucuuuuacuccaaaccauggaaaaaguaccuaacaaaugaugcccuucuagaagagugaaggccuccuggcaaccuucucuuuaacacaugaugugggucaaagggagugaaccaaaguucuguuucugacugauuaugaggcaacguauguaccauuuaagucucucaccuacauugggcuuucauauuuuaucuaucaaaauauaagguuaucuacauauaagucuggcugccaaauccuucacaaguaaaaguauacccaguaagugcacacagaagaccucuuuucauuucuauuguucauagaggccuaaacaaggggaaaaauuacucaaagauaagagucucaagauaguacagaagucuugauucaugaucuugggaaaagcuguucacaucaaggaugccaucuucuucugaggagaaacuucccugguuagauuuaccuuaaagguuccaaugggugcacaguuccaagaauguggagggacgccucucaauugugaaauuaugaacacaaggucaugaacacauuuuaaaucaaaaguuucuuaaagguuucaucaucaaugucacaauagcaaauggacuauuuagucuauacauuccucuaaacuuuucucugaguuugucaaauuccagaaagacagugaucauaaaaggucauggucacuguuuacauggcauuuguucgguccacagcacggugaucucugaugucacagugucuauccuuauccaauaagaggcagagccuggaaguaacugauuauauauuuaauguaaguccccucuucccagcacugaacuugacuuggucaugauucagugaaaauaaugucugccauuggggagcuuaaaauaguauaaaaauaccauuguccauuuuuuucuuuucaaaauuauaaaugcgaauacauguccauuguugaaaauuugaauugaacaauuuuuuuuaauuuuauuauuauuaaaguuuuaugguacaugugcacaaugugcagguuaguuacauauguauacaugugccaugcuagugugcugcacccauuaacucgucauuuagcauuagguauaucuccuauugcucucccuccccccuucccccuccccccaccccacaacaggccacggagugugaugguccccuuccuguguccauguguucucauuguucaauucccaucuaugagugagaauaugcgguguuugguuuuuuguucuuguaauaguuuacugagaaugaugauuuccaauuucauccaugucccuacaaaggacaugaacucaucauuucuuauggcugcauaguauuccaugguguauaugugccacauuuucuucauccagucuaucauuguuggacauuuggguugguuccaagucuuugcuauugugaauagugccgcaauaaacauacgugugcaugugucuuuauagcagcaugauuuauaguccuuuggguauauacccaguaauaggauggcugggucaaaugguauuucuaguucuagaucccugaggaaacgccacacugacuuccacaaggguugaacuaguuuacacucccacccacaguguaaaaguguuccuauuucuccacauccucuccagcaccuguuguuuccugacuuuuuaaugauugccauucuaacuggugugagaugguaucucauugugguuuugauuugcauuucucuaauggccagugauggugagcauuuuuucaugugcuuuuuggcugcauaaaugucuucuuuugagaagugucuguucauguccuuugcccacuuuuugaugggguuguuuguuuuuuuuucuuguaaauuuguuugaguucauuguagauucuggauacuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacauuuaagucuuuaauccauccugaauuaauuuuuguauaagguauaaggaaggguuccaguuucagcuuucuacguauggcuagccaguuuucccagcaccauuuauuaaauagggaauccuuuccccauugccuguuuuucuccgguuugucaaagaucagauaguuguagauaugcgacauuauuucugagggcucuguucuguuccauugaucuauaucucuauuuugguaccaguaccaugcuguuuugguuacuguagccuuauaguauacuuugaagucagguagcgugaugccuccagcuuuguucuuuuggcuuaggauugacuuggcgaugcgggcucuuuuuuggugccauaugaacuuuaaaguaguuuuuuccaauucugugaagaaagucauugauagcuugauggggauggcauugaaucuauaaauuaccuugggcaguauggccauuuucacgauauugauucuuccuacccaugagcauggaauguucuuccauuucuuuguauccuguuuuauuucauugagaagugguuuguaguucuccuugaagagguccuucacaucccuugugaguuggauuccuagguauuuuuuuuucuuugaagcaauugugaaugggaguucacacaugauuuggcucucuguuugucuguuauugguguauaagaaugcuugugauuuuugugcauugauuuuguauccugagacuuugcugaaguugcuuaucagcuuaaggagauuuugggcugagacaaugggguuuuccagauauacuaucaugucaucugcaagcagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggagugcuuccaguuucugcccauucaguaugauauuggcuguggguuugucauagauagcucuuauuauuuugccauacaucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauugauuugcauauauugaaccagccuugcaucccagggaugaagcccacuugaucaaggugauaagcuguuugaugugcugcuggauucaguuugccaauauuuuuuugaggauuuuugcaucaguguucaucaaggauauuggucuaaaauucucuuuuuugguugugucucugccaggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagagccuguuauuggucuauucggagauucaacuucuuccuggauuagucuugggaggguguaugugucaaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccaguuccuggauucauuaauuuuuugaaggguuuuuugugucucuauuuccuucaguucugcucugauuuuaguuauuucuugccuucugcuagcuuuugaauguguuugcucuugcuuuucuaguucuuuuaacugugauguuagggugucaguuuuggaucuuuucugcuuucuuuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcgguuuugagugaguuucuuaauccugauuucugguuugauugcacuguggucugagagacaguuuguuauaauuucuguucuuuuacauuugcugaggagagcuuuacuuccaacuauguggucaauuuuggaauaggugugguguggugcugaaaagaauguauauucuguugauuugggguggagaguucuguagaugucuauuagguccacuuggugcagagcugaguucaauuccuggguauccuuguuaacuuucugucucguugaucugucugauguugacagugggguguuaaagucucccauuauuauugugugggagucuaugucucuuuguaggucacucaggacuugcuuuaugaaucugggugcuccuguauugggugcauauauauuuaggauaguuagcucuucuuguugaauuaaucccuuuaccauuauguaauggccuucuuugucucuuuugaucuuuguugguuuaaagucuguuuuaucagagacuaggauugcaaacccugccuuuuuuuguuuuccauuugcuugguagaucuuccuccauccuuuuauuuugagccuaugugugucucugcaugugagauggguuuccugaauacagcacacugauaagucuugacucuuuauccaauuugccagucugugucuuuuaauuggagaauuuaguccauuuacauuuaaaguuaauauuguuaugcgugaauuucauccugucauuauguuagcugguuauuuuguucguuaguugaugcaguuucuuccuagcaucgauggucuuuacaauuugguaugauuuugcaguggcugguaccaguuguuccuuuccauguuuagugcuuccuucaggagcucuuuuagggcaggccugguggugacaaaaucucucagcauuugcuugucuguaaaggauuuuauuucuccuucacuuaugaaucuuaguuuggcuggauaugaaauucuggguugaaaauucuuuucuuuaugaauguugcauauuggcccccacucucuucuggcuuguagaguuucugccgagagauccgcuguuagucugaugggcuucccuuugaggguaacccgaccuuucucucuggcugcccuuaacauuuuuuccuucauuucaacuuuggugaauugacaauuaugugucuuggaguugcucuucucgaggaguaucuuuguggcguucucuguauuuccugaaucugaauguuggccugccuugcuagauuggggaaguucuccuggauaauauccugcagaguguuuuccaacuugguuccauucuccccaucacugucagguacaccagucagacguagauuuggucuuuucacauagucccauauuucuuggaggcuuuguucguuucuuuuuauucuuuuuucucuaaacuucccuucucgcuucauuucauuuauuucaucuuccaucacugauacccuuucuuccgguugaucgcauuggcuccugaggcuucugcauucuucacguaguucucgagccuuggcuuucagcuccaucagcuccuuuaagcacuucucuguauugguuauucuaguuauacuuuugucuaaauuuuuuucaaaguuuuuaacuucuuugccuuugguuggaauuuccuccuguagcucggaguaguuugaucaucugaagccuuauucucucaacucgucaaagucauucuccguccagcuuuguuccguugcuggugaggaacugcgugccuuuggaggaggagaggcgcucugcuuuucagaguuuccaguuuuucugcucuguuuuuuccccaucuuugugguuuuaucuacuuuuggucuuugaugauggugauguacagauggguuuuugguguggauguccuuuauguuuguuaguuuuccuucuaacagacaggacccucagcugcaggccuguuggaguuugcuagagguccacuccagacccuguuugccuggguaucaguagugguggcugcagagcagaggauuuucgugaaccgcgaaugcugcugucugaucauuccucuggaaguuuugucucagaggaguacccggccgugugaggugucagucugccccuacuggggggugccucccaguuaggcugcucggaggucaggggucagggacccacuugaggaggcagucugcccauucucaaaucuccagcugcaugcugggagagccacugcucucuucaaagcugucagacagggacauuuaagucugcagagguuacugcugucuuuuaguuugucugugcccugcccccagagguggagccuacagaggcaggcaggccuccuugagcuguggugggcuccacccaguuccagcuuccuggcugcuuuguuuaccuaagcaagccugggcaauggcaggcgccccucccccagccucccugccaccuugcaguuugaucucagacugcugugcuagcaaccagcgagacuccgugggcguaggacccuccgagccaggugcgggauauaaucuccuggugcaccgcuuuuuaagccugucggaaaagcacaguauuagggugggagugacccgauuuuccagaugccuucugucaccccuuucuuugacuaggaaagggaacucccugaccccuugugcuucccgagugaggcaaugccucgcccugcuucggcucgugcacggugcgcugcacccacuguccugcacccacugucuggcacucccuagugagaugaaccugguaccucagauggaaaugcagaaaucacccgucuucugcgucguucaugcugggagcuguagaccggagcuguuccuauuuggccaucuuggcugcgagucccgaauugaacaaauuuuaucauuaaaauaaaauagccuaugaacacaucacccagaacgaccaacauuaaaauuuugccauggaaacauauccauauccacagugcuuagaaaauuacacaaaucaauuuuaugcaagacuguuuagagaaauguuaguaaguaaagaggaacuuaaaugauaaugacagggauuuuauugcaaaauuuaugguaaaacaauacaguugaauauuauucacccauuagaacuuuuggacacuuguuuacuuuuuauuuuuacacuggucauuguuuuacaaaguaucuaugacuuuuguuuagccucucauaaucagggcaaugacaaagagaaauaccaggaguagccagcccaggcagugaagaaugcagguagaaacaggaggauggaggacuacaggagggauauuuuauaaggaaaauuauaugcauauacauauauauauuuauauauauauauauauacacacacauuauauaacuuucucuauauauacacuguaacuauauauacauauguauacacacacacucucucuauagaaauauauaaagagauauagauauguccugauuauuccauuuacaccugugaaauucucugaagaaagugcccaagacauauacauguauacauacacacacacaaacacacacacacauuuaaagugaaagugauugcuuccagagacuggugaucaggguuaggaccaagaaaaguaaugauguuuuuagcauagauauuuuaaaacaauuucuucuuaaaaaugucauagaaauguguuaccuuaacgaaaaaaaggcagugcaugcaugcuauuauuccaggaguaauauuguauaucuuuauacaaauuguauauuguauaucuuuauacaaauuguauauuguauuuacacaaaaagauuuuacauuauguuuuaaaguuaaucuauuagauacugcuuuuacuuacaaaauaaguuuuucaagggaaauaucauuauauauauuucuaauucuggagaaacugcagacuuuuuaaaucagauuuacuuaaucauagcuagaucacugggucauggucaaugauaaauugccacaugaugguaagcaaaaccaaccucuuucagcaaauacaguuuucaacuuuaagagacuaaaaaacaguuuucuacaauacauuuuaagaaaugugaaagcuuucccaguuucaagguuauaacucaucaguucuuggaacuuaaaauacacaucuaagucuuacaggagaacucuuugcccuucccaguaaacagauuuagaaaauuaaaguuuugaugacaugaaaagagaaagacuguuggaauuuuacaguaaguugucugccaagauugcuucuuuaucucauuaagcaaagacccaggacuaacucaaagcucuucugucaacauucuuuuugcugaaaguuucucucaaggauuucuucuuguuaguggaaacauguggcuucgggguuaaaggcugaaucgaaguuauuuguguuuucuuauuuuauucccauauccauugagcaauagaagcucuaaaauguaucacauuuuuugauaauguauuuaucuuugaacaagaaaagugauuuccauauuuuuggauuguauacagauaaacuacuuuuuuguuugguuuuguucuagaagagcucccuuacaacuuuguaauauuuauauuuaggugaaauuuaauucauagacuuuauaucauuccuacuguaacaaaagucacuuaaauauuuugauuguuuuaaaaauuguuuuguuagauaacauucaaaagcuacaaaauauuucagagaucacaagccuggguaauagacugaguacuaaaauuguggaaggaggcccguucaagaauucauucauucauuccacaacuacuuauugaggaucuguaauuugucaggcaucacgauaagugcucaaaagcuuacuaccuaggaaacucacagucuaauucauggaaaaguuuaaaaaguucaaauucagacauaaacucaguuggaauuauaaacaaauaucagaggaaauuuuucuacacaaaguacugacagcuaaaaacagacuaaagaagaguacuguuagaggagaagaguauccuuuucaagaaaguuaaaauuuuuguuauauugucaaugaaucacacacacacacacacaaauguacacagcagauugguuuuaauauacaauuugaaacguacuaaucagaaauauaagaauucaugguuaguuauuuaauaauaaaauauucugaaagauugguuagcuagcaacuaaagaauuguaauccaaaggccauguaccacagucagcuacuauaagcauuugaguauuauuaucuccaaucaaggcuagaggcuugauaaauaacauaagcauacuuucaaauugaauagugaaacggcuggucuuccaguuuggacaagauagaagugccauacaauugcuucugcacaaaagaaugaaguagagggacccagagaucucaauaacuuacagcccucuggauugucaccuuaaccuugagaauugaauugucaguguguucggaagcuuauuuggagauuuuguaugugcccugauuuugaccaaaagguuagcugaauguugcugcuacaauauuaugaauuauaucucaaguaaacauucaagguguugucagagcaucaaaaagaacaggaucuggaauuuaauagagcuuagagagugguaugacacuuguuaugccugcuuuuaauguuauuugcucugagaccaguuuuccuugugacauacuacauagcaaggacaguuagcauccccgccuucuuuaacuacuggaucuuccucccucacuaaugaucaaauuaacaacauaauuaacauaauauaauuaacauaacaacauaauuaacaaaugaucaauuuaacguagguaaauucauaacaauagaucauuugacuauuuggauguuuccacuacauuuuugucaccuugcucuucuuaauaauguccaacauugauuuccacuacauuuuugucaccuugcucuucuuaauaauaauguccaacauugauuuuuaaugaaaguaaauucauucucauguuuaacuuugauaauauguauuuauugaaacucauuuugaaacuuacuuucugugaaagccagaaauaaaggugcgauuuauauauaugaugggaaaauuacaagugauuaaucuuugcauuugcuucaacaguagauguacucauuauuuucagaaaaaaaauguaagagaagucaauaugggugcauauauuauuauauucucuguguaaaacagagaaauuuuaaaagggucagcacuauguacuucuacuagaacuuacaaccauccaaagaguggugugugaggcugauccauagcaauucuuaugauuuuuaaagguccaggaaaauaagaauauggcauauuaaucagaaaacauacauuuuuaauuuuuuuugcaugacauucuauuccuguauggaaucacaauucuuggcaugccaauauuuuccuucaguguuauggguugaaacuucuaugaaucaaaagauuuauaaaauaauuuccauucauaagcuuugaaauagcuuaagcacaaauauaaaaaacaaaaacaaaugaacaaacaaaaaacucuucaggucuuuaaaugagaacuacaauuaagauuagaauuuuuuuucaaaaaauagugucaggucaaauaguuagguaagaucaucugacuuccuacucuccugagaauagagugauauauuuaucucacuauuacucuauuuaucaccuuauacuuuuuucuuuaguaauaguggcuggcccucaaaggucuuucaagacaagugugaugacaucaccaagaagucuccucugcugaccuccuaaggaaagugaacucuggcugcugaaugucucacauugacuaacuguuaugaacauuauaaaucuaccauauauugcuaaauacuuugugauuugugaaucagagagggaggcuguagggauuccaugccuaccucagugaauggaauaacauaacagaguccaacagcauuaagacucuuuaagucaccagacagugaaacugaucuguggugcagaauuagaccucuagacaccaggaucaacuuucuuaaagaaagauaaaaauuuaaaaaaaaucuaauuuuauaggugacaacuuggaaaggucagaaauggaucuagagacaagaaaccugacaaggccugagugucagccuggcacucuguggaacccacuauugggacagaacauggcagggaugucauuguucaguuuaguuacaagaauucauucagcucaaguucuauaauuuauuccaagaaccgcggcagaagaaaaaaaacauauacuuuaagagagagacaacaguugggggaagcuaugaaagcaguucuuaaauguuugagugcaucaggauugcugggagggcucauuaaaauacagauucugugacccaccuccugaguuucugacucaguaagucugggauaggucccaggaauauucaauucuaacaagucccaggugauacugaugcuguuuauccaggcacuacacuuugaaagccaauauacuaaauaaaugagcuuggugcauaaagaucgagagagaucuugaucaaauuagaggaccuauuugugguugggucagaaguaauuauaaugacgaaugcgauaauaacaggagcaaaauccaccaggaguagcggacaacaaauaaaagcagccaaacaauaauacuguuggaagcagguaaaacagccacuaaagagugagaucucuuucucccuugaagggaauucaauuuuucuuuccucaaacucaguuuucauuagaaaggagguguguguauuuaucauuacaguuacucaauuuaaaaauauugcuaagcacauauuauaugcuagcgacugugccaagcaaugagaauacagagaacgaaacccaaucucuucugucaggaagaucaauuucuaaaguagugaaugcuguauaauagcagagaugaugccuugugcaucuugauguuucuuacaaacuucaucacaaugccccauacauaguaaacacucagugaacauguguuaaguaaaugcuaccuucaugcauaccagcauguucugcuuaucccuguauuuccuaaaccuugacaguguaccagacacuaugcuaaacauccucucuuuuaauucucaacaaccacccuuuaaggaaaguacuuuuauuauuccuaaaacacagagaggaaacugagcuuuaaaagauuaagcaacuugccccagaucacccagccaaaagagucaaggcuggaauuuucugcaugaccuugucugcaugacuuuucuagacccuucuacaucagcuaugcugucuuaaaaugugauugaaaacauuuuucccuuauguugucaagcaugcauuccuguggucuuuacucuaguaauacacuuaagaaguaaaaccuuuuacauacucgucuuuuuuucucccauuucccguagaguaaaaaauauuagauauauuuuaaugaguuaucucaaugugcugcucuaaguaauagaaacuaacaguuaaccuguuccaggcaauguguuaaaugcugcaucucauuuuauuuucaaaaagaaacccuauaguuuuauuauuacuuccaauuuacaaaugagaaauuagaaucagaggaauuaaguaacauuuuuacaaucgcagagcuaauauguggcauaugaaaguugaauccuguuuuucuaacuuuagaauucucacuauacacugcaauuccauacugccucucuucaauucucaccuauucauaggucuuuaggauauuuaucauuguuuucuuuaccuuuuuauuuuaaaauauugauugauuaaccucccaaaacaaccauauauauugauacaggagugcagguguucacucaaaugacuugccucaccacuacguucaggacauggggggacuuuuuuguauuguauauaaaagucaauuaacuggaaaggcuuagaauuacuaugcaaauuugacacaaucuauacaaugucaauaaaagcaaaaucaauuuuguccuaagagaaaacugaaaaggcugaaaguggcguuuuuuuuuuuuccuuuauuaaguuuucuuugcccauagcauauaacaugugaaggaauuacagggcagaaauguacauuuaauauaucucaauauuaucuuuaaguuuaaacagacaauuguuuuauauauauauguguaugauuuuaaaaugauugugcaugucauauaaacagacuacuggcauuauuacugggugggucugaugugauaucuaucauucugaaaggguacaaugagaugaaauuuucuauuauggguggcaguggcauccauggaaggaaggauuuauauucaacggauguuuuucuuuacuccauuuaucuagcuucugucaucucuuucuuccucuagauucaaggcugucuaggaccuagaaugaccuucuacauuagcagaaaauucacagaagcuuauuucaggcacaguacuaugucuucguguucaguuuccaucugcuaccugaucucauuauuucccacccuugcuuuccuuaggagacucaggccaccugaaaugguuuggcuguguccccaccccaaaucucaucuugaauugcaauaauccccacaugucaaagguggggccagguggagauaauugaaucgugaggugauuuccccaauacuguucucguaguagugauuauuuaauaaaugggaauucccccgcacaagcucucaugucauguaaaacgugacucugcuccuccuuugccuuccaccaugauuaugaggccuccccagcuaugcagaacugugagucgauuaaaccccuauuuuaaaauaaauuacccagucuuggguacaucuuuguuagccgcaugagaacuaauacacgacucuugccuuccuguuucucaaacaaacgaaggauguucuggcuuagguuucacuugcagauccaucugccugggauucaucauucgcaucucaagucauauauccuguucucaggacauuguuuuuccuuuucauuaguuuuuauuccuaauuaauuuauaguaaaaauguacccuuuuuauguugcaauucugcaaguuuugagaaacacauaauauaauuaccaccacaaucaagacauagaacagucuaaucucccauaacaccucacugugccucuugguaguccaccucuucugcugcugcaugccccaggaaaccaaugaucuguuuuguguucuuauaauuuuuccuuuucuagaagauauauucauggaaucauacaacauguagcucuuugagcuucaguggaauguccauuuuuuacuaauuacauaacauugcccuaaaauaugcccuaccauuuauuaucuuaauuuauuuucuuuacagcacuauucucugaaagcauuguuuuacugguuccuguaucuauuaucuguuuucuuugcucugagcugcagcagcuggcauuuaugucacuuuuaugcaaaauuagaaaaaaggaaacuauuuucaggcuuacucacaacucgugcacuuaaacaaaauuuagucugcaaaggcauuuccaaagugaaagauuaacuaaaauccacaacccucauaguggacaguucaacauucaaugaaaaaauuuaaguauagaacuauacuuuuuauuuuuauuacaauuuuuaaaacaugaaacggcuacagugugaaauuauuaaagacauaguaaauaugauuuaccaucugauuuccuuccaaacaucuucuagaaaucacuuuuucuuuuuaauuauauauugacaaauuauuguuguguauauuuaugggacaaaaagugauguuauuauuuuucaauacaauauggcaugauuagaucaagguaauuaaccuauuuaucaccuucaguauuugacuuuuuuuuuuuaauggaguuucauuuuuggcuuccaggcuggagugcaauggcguggaaucucagcucacugcaaccuccgcaucccaguuucaagugauucuccugccucaaccuccugaauagcugagauuacaggcaccugccaccaugaucgacuaauuuuuguauuuuuaguagagauggaguuucaccaccuugcccaggcuggucuugaacgccugaccucaggugaucugcucuccucggccucccaaagugcugggcuuacaggcauaagccaccacgccuggccaguauuucacauuuuuaugguaacauuugagauguacucucuuaguaauauuuccccuugucaggcuuuucuaucugcuuauaaaaucaugauuuuauuaaaucuuauuauuauguauuaaauguuugucaucuccucagaauccauauguugagaauggaggaaaauuggcagauaggaggaaggaccaacuugcagcucccacuuagauggacagagcagcauguggagacccacauuguaaacuugugcuccaagaacuacugcaggaacauaccaggaaagccaaaagaauccacagacccuuugaaagagguagacugcugcuacaggcuccaugggacagucaaggaacucugaagacaaaggauguaaucucuugggagcuguaugccccgcccacugccugauccuccuuauacugccuuagcugaugugcucuugaacgugccaccuccuggcuggaggcgagcaaaagcaaaaccagagcauguaacaaaaauacaaccaaggacccuaacagaguccacuucacuccccugcuaccuccacuggagcagcugcugguauccauggcugaaagacccgaagauggaucacaucacaggacuguuugcagauacucuccaguaccagccuggagcccaguagcucuacugguuggcuagauccagaagacaaauaacaaccacugcaguuuggcucucaggaagccccaucccuaaggggaagaggagagcaccacaucaagggaggacccccaugggacaaaauaaucugaacagcagcccuugagucccagaucuucccucugacauagucuacccaaaugagaaugaaccagaaaacaauucugguaauauggcaaaaacaaguuucuuuaacacccucaaacgaucacauuacucaccagcaaugaauccaaaccaagacaaaaucucugaauugccagaaaaaccauucagaaggucaacuauuaagcuaaacaagaagacaccaaagaaaggugaaauccaacauaaagaagucaaaaaaaugauacaggauauuaauggaaaacucuccagugaaguauguagcaaaaaauaaaauauaaucacagcuucuggaaaugaaggacacacuuagagagcugcaaaaugcacuggcaagucucagcaauggaaucaaacaaguagaagaaagaaccucagaggucaaagacaaggcuuuugaauuaacccaaucugacaaagaaauagaaaaaugaauuuuuaaaaaaggagcaaaccuccaauaaguuugcaauuaugguaaaugaccaaaccuaagaauaauugguguuucugaggaagaagagaaaucuaaaaguuuggaaaacauauuugagggaauaacugaggaaaacuucccugaccuugcuggggaucuagacauccaaauacaagaagcucaaaaaacaccugcgaaauucauugcaaaaggaucacugccuaggcacauugucaucagguuaucuaaauucaagauaaaggaaauaaucuuauaaguugugaggcaaaagcaugagguaaccuauaaaggaaaaccuaucagauuaacagcagaucucucagcagaaacucuacaagcuagaagggacuggaguccuaucuuuagccucguuaaaccaaacauugucaggcaagaauuguguaucuagugaaacuaagcuucauaaaugaaagaaagauaaucuuuuucagacaaacaaauuuugaaagaauucacuacuaccaagccagcacuauaagaacugcuaaaaggagcucuaaaucuugaaaaaaauccucgaaacacaccaaaauagaaucuccuuagagcauaaaucucacaggaccuauaaaacaacaacauaaugaaaauaaaccaagguauucaggaaacaaauaacaugaugaauaaaacaauaccucaccucucaauacuaauauugaauguaaauggccuaaaugcuccacuuuaaagauacagaauggcauaaugaauaauucaccaaccaaguagcugcugucuucaagagacucaccugacacauguggacuugcauaaacuuaagguaaagggguggaaaaagguauuucaugcaaaugaacaccaaaagagcacuggguuaucuauuauucuaucagagaaaacaaacuuuaaagcaacagcaguuaaaaaagacguauuaguucauuuuuacacugcugauagagacauacccaagacuggguaacguggaaagaaaagagauuuaauugacuaacaguuacacauggcuggagaggccucacaaucaugguggaaagcaaggaggugcaaagucaugucuuacauggauggcagcaggcaaagagagaaauuguacaggaaaacucccuuuuauaaaaccgucagaucuugugagacuuaaucaacaucauggguauagcacaggaaagacccaccccaugauucaauuaccuccaacugggucccucccacaacaugugggaauugugcgagcuacaauucaagaugagaugugggugggggcacagccaaaccauaucaaaagacaaagaaggacauuauaucaugauaaaagcacuagugcaacaggaaaauaucauaauccuaaguauacaugcaccuaacacuggagcucccauauuuauacaacaauuacuuacuggaccuaagaaaugagauugacagcaacacaauaauacugggggaccucaauacuccacugacagcacuggacagguuaucaagacagaaagucaacaaacaacggacuuaaacuauacccuggaacaaauggacuuaacagauauuuacagaacauucuaaccaacaacugcagaauauacauucuauuuaucagcucauggaacauucuccaagauagaucauaugauaagacacaaaucaaauuuaagaaaaucaaaauuauaucaaguacucucucagaccacaguggaauaaaauuugaaaucaacuccaaaagaaacucucaaaaccaugcaaguaccuggaaauuaaauaaccugauccucaaugaucauugggucaacaaugaaauccagaaggaaauuaaaaauuucuuugaacugaaugauaauagugacacaacguaucaaaaccucugagauacagcaaaggcagugacaagagggaaauucauagcauuauaugccuacaucagaaagucugaaagacacaaauagacugucuaaggucacaccucaaggaggcuagagaaacaagaacaaaccaaacccaaacucagcagaagaaaagaaauaauccagaucagagcagaacuaaaugaaaucaaaacaaacaaaaaauacaaaagauaaaugauacaaaaagcugguucuuugaaaagauaaauaaaauuucuagacuauuagugagauuaaccaaaaaaagaagagaaaagauccaaauaagcucaguuagaaauaaaacaacugcuaccacagaaauacaaaagaucauucaaggcuacccugaaaaucuuuacaugcauaaacuagaaaaccuagaggagauggauaaauuccuggaaauauacaacccuccuagauuaaacuaguaagaaauagaaacucugaacagaccaauaacaaguagcaagauugaaaugguaauuaaaaaguuaucaucaacaacaacaaaaguccaggaccagauagauuaacaguugaauucaaucagacauuuaaagaauaauugguaccaaucuuauugacaauauuuuuagagaaagagaaagagaaagagggaauccucucuaaaucauucuuugaauccaguaucacucuaauaccaaaaccaagaaaggacauaacaaaauggaaaacuauagaccaauaucuuuaaugaacacagaugcaaaaaauucucgauaaaauacuagcuaaccaaguccaacagcauaucaaaaagauaauccaucaugaucaagugggucucauaacaaggaugcagggaugguuuaacaucaacaagucaauaaaugugauauaccacauaaacagaauuuaaaaugaaaaucacaugaucaucucaauagaugcagaaaaaacauuugacaaaauccagcauccuuuuaugauuaaaauccucagcaaaaucggcauagaaggacauaccuuaagguaauaaaagccauauauaacaaacccacagucaacauuauacugaauggauaaaagcugaaaauacuugcccugagaacuggaacaaggcaaggaugcccacuuucaccacuucuauucaacauaguacuggaaguccuagccagagcaagcagacgagagaaagaaauaaaguguaucuaaaucaguagagaggaagucaaacuguuuuugcugaugauauaauucuauaccuagaaaacccuaaagacucauacauaaagcuccuagaacugguagaugaauucagcaaaguuucaggauacaaaauuaauguacaaaaaucaguagcucuauacauacacagugaugaaacugagaaucaaaucaagaacucaacuccuuuuacgauagcugcaaaaacaaacaaacaaacgaacaaaaaaacuuagaauauacuuaaucaaggaggugaaagacuucuacaaggaaaauuacaaaacacugcugaaagaaaucauagaugacacaaacaaauggaaacacauuucaugcucaugcauggguagaaucaauauugugaaaaugaccauacugccaaaagcaaguuacaaauucaaugcaauuuccaucaaaauaccaccauuauuccucagaaaacuagaagaaaaaguucuaaaauuuauauggcaucagaaaagaaucugcacagccaaagcaagacuaagugaaaauaacaaaucuagaggcauuacauuacccuacuucaaccuauacuauaaggccauagucaccaaaacagcaugguacugguauaaaaacagucauguagaccacagaauagagaacccauaaauagagccaaauacuuauagucaacugaucuuugaaaaaggaaacaaaaauauaaaguggggaaaguauacccuauuuaacaaauggugcugggauaacugacaagccacauguggaagaagaaaacuggauccucaucucucaccuuauacaaaaauuaacucaagauggaucaaaaaccuaaauauaagucuugaaacuauaaaaauucuagaagauaacauugggaaaacccuucuagaccuugguguaggcaaagacuucaugaccaagaacccaaaagaaaaugcaaaaaaaacaaaaaaacaaaaaaacaaagauaaauugauggaaccuaauuaaacuaaagagcuucuuucugcacagcaaaagaaauaaucagcagagugaagagacaacccacagagugggagaaaaucuuuauaaucuauaaaucagacaaagaacuaauauccagaaucuacaaggaacugaaacaaaucaacuagacaaaaaaacaaucccaccaaaaagugagcuaaggacaugaauauacaauucucaaaggaagauauacaaauggcuaacaaacacaugaaaaaauacucaacaucacuaaugaccagggaaauguaaaucaaaaccacaaugugauacccucuuaguccugcaagaauggccauaauaaaaaaauuaaaaaaaaauaauagauguuggcguggauguguugaaaagggaacacuuuuacacagcuggugggaaggaaaacuaggacaacuacugugaaaaacaguguggagauuccuuaaagaacuaaaaguggauccacaauuugauccaguaaucgugcccuggguaccuacccagagggaaaaaaaaucacuauacaaaaaagauacuugcacauauguuuauagcaucaccauucacaauuaaaaauggaaccagcccaaaugcccaccagucaaagaguggauaaagaaaaugugguguguauucauauauauaugaauacgacugagccauaaagcauaaauaauguuuuaaaaaaacauuacuuuuaaaaagccauaaauaaugaaauauuggcauucauagcaaccuggaugaaacuggagaccauuauucuaagugaaguaacucaggaauggaaaaucaaauaucguauguucucacucauaagugggagcuaagcugugaggaugcaaaggcauaagaauguuacaagggacuuuggggacucaggggaaaggguaggaggguggugaggaauaaaaaacuacacauuggguacgguguacacugcucaggugaugggugcuccaaaaucucagaaaucaccacuaaagaacuuguucaugucaccaaacaccaccuguuccccaaaaaccuauugaaaaaaaaaagaauccauauguugauaccccacuuaucuaugugacgccauuaggagaggggcuuugggagguaauaggguuuagaugaagucauggggguagagccuucacacaugggauuaagaccuuagaaucccaagaaagcuugcuucuuugagcucugugccaugugaggauauaacaagaaguuggcagucuccuugccgaaagagggccaccaccaaaaacucaaccaugcuggcacccugguuuuagacuucucagccugaagaacugugagaaauaaauuacucucauuuauaaaccacucagucuaauaucauuuguuauagcagccugaaauaacaaacucacuuucucuucucuguguaaaaauuuucaucaaacuuuuucaccuucuaggaccuacaggaaaaucacaaaccccuuagcuuggcauuccagugccuucucugaaugaagaaggcaccaauguugcagccucauccucuuuccauauucgcagcucucuuacagauaccaugcacgucagcuaaccuggccaacuacuaguaccuagggaauccuacauauucccuaugcgcuucugaaaagacccgcugcucauuuuugccuucuaaagcauaauuaacuuucgagguucaggcccucuuucucuaugaaacuuugcugauuuaucuaacccagaaucuauagacauuacuuaaacuugucuuaugaaaagugauaaacuccauuaaccaauaaaggagucauuaauuuuccugaagacaucaucuacauauaacaugaaauuaugaaaucaacaaaggaagggagcaaaugaaauguuuacuugucguauaacauaugaguauaucaaauguuacugcagugggucaaaauaaagaauguuaaaaugauuaagagaauaaagaggcaacaauauucuaaaagaaaagucauuagcacaguaauuggcuuagggcagauacucaacaauguuauuuucauucccgcagucaaauaaauaguacuaaagccuuuguuuuucacagucuagaaaaauaauguuugacaucuaagaaaauuaugccacaaaugggaaagugaauauacauuuuaucacuaaauuaugagauuagaauaaggacucuuucuugagguuuaaaggggauauuacaaauaaaacauggucuuagcacuacagguauuugaauauaaauugaugauuucaauauaaauugauguauaguaccaaaagauuaauuuaaaacauuguuacccugaggcccugcuaaacuuacauuauuugagagcuaacauagcauuucccacaaaauuguauuuaucuuuuuucuuauuauggauaaaaaauguaauuuuccaauuauuagauauauguaaacacugauagaugacuuuauuaguaugcauguuugagaaaaauaagggaaauugcucaacuuaauaggugugaaggcaacagaauuacauugucaaaagcacugugguuacauguauuuuuaaugcuuuagaagcaccugucagcaagaacaucugcauccuaauagucuauuuuaagaaaauuuaaaucauccuuaugcugacgaauacagccauauuccaaauaugugcaucucauaaaagcuaauacauauucaaugacucauuaaaaucaaacauuuuaaaacaucgugauucaggacccaauacauacuuuuaaaauaacauuucguaaugaaaggauuguauacuguaccacaugcaaauauuuauuucauuuaauaaugaucacuauaaaaaugccucuuaaucaaaggaaagaaaucauuauaccauguguuuuggcauaaauauuuauaccucucuaugaaauucuauguguguuugagauacuugaaaauuaccauguauuauauauaaugguuauaauguucuugaagauuguaaaccaaauuuuauuauuuauuuuuuuuauuauuauacuuuaaguuuuaggguacaugugcacauugugcagguuaguuacauauguauacaugugccaugcuggugcgcugcacccacuaacuugucaucuagccuuagguauaccuccaaaugcuaucccuccccccuccccccaccccaccacaguccccagagugugguacuccccuucauguguccaugugaucucauuguucaauucccaccuaugagugagaauauacgguguuugguuuuuuguucuugcaauaguuuacugagaaugaugauuuccaauuucauccaugucccuacaaaggauaugaacucaucaacuuuuauggcugcauaguauuccaugguguauaugugccacauuuucuuaauccagucuaucauuguuggacauuuggguugguuccaagucuuugcuguugugaauaaugccgcgauaaacauacgugugcaugugucuuuauagcagcaugauuuauaguccuuuggguauauacccaguaauaggauggcugggucaaaugguauuucuaguucuagaucccugaggaaucaccacacugacuuccacaaggguugaacuaguuuacagucccaccaacaguguaaaaguguuccuauuucuccacaucauguccagcaccuguuguauccugacuuuuuaaugauugccauucuaacuggugugagaugauaucucauagugguuuugauuugcauuucucugauggccagugaugaugagcauuuuuucauguguuuuuuggcugcauaaaugucuucucuugagaagugucuguucauguccuucgcccacuuuuugaugggguuguuuguuuuuuucuuguaaauuuguuugaguucauugcagauucuggauauuagcucuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaaaucuuugauccaucuugaauugauuuuuguauaagguguaaggaagggauccaguuucagcuuucuacauauggcuagccaguuuucccagcaccauuuauuaaauagggaauccuuuccccaaugcuuguuuuucucagguuugucaaagaucagauaguuguagguauguggcguuauuucugagggcucuguucuguuccauugaucuauaucucuguuuugguaccaguaccaugcuguuuugguuacuguagccuuguaguauacuuugaagucagguagugugaugccuccagcuuuguucuuuuggcuuaggauugacuuggcgaugcgggcucuuuuuugguaccauaugaacuuuaaaguagcuuuuuccaauucugugaagaaagucauugguagcuugauggggauggcauugaaucuguaaauuaccuugggcaguauggccauuuucaugauauugauucuuccuacccaugagcauggaauguucuuccauuucuuuguauccucuuuuauuuccuugagcagugguuuguaguucuccuugaagagguccuucacaucccuugugaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcauauauugaaccagccuugcaucccagggaugaagcccacuugaucaugguggauaagcuuuuugaugugcugcuggauucguuuugccaguauuuuauugaggauuuuugcaucaauguucaucaaggauauuggucuaaaauucuguuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuagacucuuuuugguugguaaacuauugauuauugccacaauuucagcuccuguuauugaucuauucagagauucaacuucuuccugguuuagucuugggagaguguaugugucgaggaauguguccauuucuucuagauuuucuaguuuauuugcguagagguguuuguaguauucucugaugguaguuuguauuucugugggaucaguggugauauccccuuuaucauuuuuuauugugucuauuugauucuucucucuuuuuuucuuuauuagucuugcuaguggucuaucaauuuuguugauccuuucaaaaaaccaguuccuggauucauugauuuuuuugaaggguuuuuugugucucuauuuccuucaguucugcucugauuuuaguuauuucuugccuucugcuagcuuuugaauguguuugcucuugcuuuucuaguucuuuuaacugugauguuagggugucaauuuuggaucuuuccugcuuucucuugugggcauuuagugcuauaaauuucccucuacacacugcuuugaaugcgucccagagauucugguauguugugucuuuguucucauugguuucaaagaacaucuuuauuucugccuucauuucguuauguacccaguagucauucaggagcagguuguucaguuuccauguaguugagugguuuugagugagauucuuaauccugaguucuaguuugauugcacuguggucugagagauaguuuguuauaauuucuguucuuuuacauuugcugaggagagcuuuacuuccaaguauguggucaauuuuggaauaggugugguguggugcugaaaagaauguauauucuguugauuugggguggagaguucuguagaugucuauuagguccgcuuggugcagagcugaguucaauuccuggguauccuuguugacuuucugucucguugaucugucuaauguugacagugcgguguuaaagucucccauuauuaauguuugggagucuaagucucuuuguaggucacucaggacuugcuuuaugaaucugggugcuccuguauugggugcauauauauuuaggauaguuagcucuucuuguugaauuaaucccuuuaccauuauguaauggccuucuuugucucuuuugaucuuuguugguuuaaagucuguuuuaucagagacuaggauugcaaccccugccuuuuuuaguuuucuauuugcuugguagaucuuccuccauccuuuuauuuugagccuaugugugucucugcaugugagauggguuuccugaagacagcacacugaugggucuugacucuuuauccaacuugccagucugugucuuuuaauuagagcauuuaguccauuuacauuuaaaguuaauauuguuaugugugaauuugauccugucauuaugauguuagcuggugauuuugcucauuaguugaugcaguuucuuccuagucucgauggucuuuacauuuuggcaugauuuugcagcagcugguaccgguuguuccuuuccauguuuagcgcuuccuucaggagcucuuuuagggcaggcuugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaaccugaccuuucucucuggcugcccuuaacauuuuuuccuucauuucaacuucggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccacaucauuuucagguacaccaaucagacguagauuuggucuuuucacagucccauauuucuuggaggcuuugcucauuucuuuuuauucuuuuuucucuaaacuucccuucucgcuucauuucauucauuucaucuuccaucgcugauacccuuucuuccgguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaagucauucuccauccagcuuuguuccguugcuggugaggagcugcguuccuuuggaggaggagagguguucugcguuuuagaguuuccaguuuuucuguucuguuuucuccccaucuuugugguuuuaucuacuuuuggucuuugaugauggugauguacagauggguuuucgguguggauguccuuucuauuuguuaguuuuccuucuaacagacaggacccucagcugcaggucuguuggaauacccugcugugugaggugucagugugccccugcuggggggugccucccaguuaggcugcucgggggucaggggucagggacccacuugaggaggcagucugcccguuuucagaucuccagcugcgugcugggagaaccacugcucucuucaaagcugucagacagggacauuuaagucugcagagguuacugcugucuuuuuguuugucugugcccugcccccagagguggagccuacagaggcagccaggccuccuugagcuguggugggcuccacccaguuccagcuuccuggcugcuuuguuuaccuaagcaagccugggcaauggcgggcgccccucccccagccucgcugccgccuugcaguuugaucucagacugcugugcuagcaaucagcgagacuccgugggcguaggacccuccgagccaggugugggauauagucccguggugcgccguuuuuuaagccggucugaaagcucaauauucgggugggagugacccgauuuuccaggugcguccgucaccccuuucuuugacucggaaagggaacucccugaccccuugcgcuucccaggugaggcaaugccucgcccugcuucggcucgcgcacgguguggugcgugcacccacuggccugcgcccacugucuggcacucccuagugagaugaacccgguaccucagaugauuuccagaaaucacccaucuucugcaucgcucacgcugggagcuguagacccggagcuguuccuauucggccaucuuggcuccuccuucguaaaccaaauuuuauuguauuaaguuaaaaauuguuauagguuucauucugcuaauacaguaacacccacuggcuuaucacucauugcccacugaggucccaugcuuuagaaggagggcaaaugacagcuacaaagaaaaguuguuugacugucacauuagacuucuuugagucucugaaugaaaaagacuuggggaaagcuagucucuguggaagaucaaaauauuuucuaaauucuauacacuuucuuuauaaaucaagagccagacucaggcaacucugaucaaagaauuuuacuccaaacuucugcuggaaccaacucguaagaggaugaaaggggaaguccuuccaaauaggaagagaauguagaaagaauucuguaucaaggaaauuaaaggugaggugaugagaauguggauaaaaccggagccccuaagaggacagauucccaguucucugagucucaggcagaaaggugugguaggugaaggccaaauuauaaaacuccugaugaaauccucacaucccucaaaggcuaaggaggcauccaagaucuucuaggccagaggcaauuucccccucccgacuccagggaacuuuugauaaguucaggagacauuuuugauugucacaacgugaguaggggcggagguaggcauuguuacuaguaucuggcaccuguuaggccuaugggaaggauucggcuaagcaacaaugcagaggacaaucucccacuacacggaauuaucuguccccaaaugucauagugcugagguugaggaacacuaggcugguguucuacuucauugccacauccaguaugcggugguaagguguaaggacaaagggacuuuucaagguaggugagcuugagauguuacucuugguucccuucuaucugcucauacauaaaauuauuccacauuaagaaaaccauugaacuuugugagcagcacaauacgauucacagucagugacaagagcugagccccaugcucaaaagaugaauucucggccggacgcgguggcucacgccuguaaucccagcacuuugggaggccgaggugggcggaucacgaggucaggagaucgagaccauccuggcuaauacagugaaaccccgucucuacuaaaaauacaaaaaauuagccaggcgugguggcgggugccuguagucccagcuacucaggaggcugaggcaggagaauggcgugaaccugggaggcgcagcuugcagugagccgagaucgcgccacugugcuccagccugggugacagagcaagacucugucucaaacaaacaaacaaacaaagaugaauucucucauucaacaaaguuugaaugucuucucaauaaauaccugacauuguucuagacacuaaggguacaguauuauguaaaccugccacauuucguggcgagauuacagggaccgaguacagguauggggccacaauucuauagagggucuucagggauguucuaucugaaaaggugacguguauagagguccaaggagaagcaacagcaaauauaagguuccugagcagaggugugcuugcuaugcuagaguaacaaccaggaggccagugugaauggagacgaguaaguuagaggcaggguggcugaaaagcuugcuuauuggugaaaucauuaagauauugugggcuauuuugagaaccugagcuauuuaauaaguaacauggaaagcaaugaaggguugugaguguugaauuaacguuaucuaauuuauacuuuuaaaagaaauuuaacuuuauuuuaaauugacauauaauaauuauguauauuuacgguguacaaugugauguuuugauuuacauauauaguagagaaaaacucaaauuaacauauucuaugaccucaccaauuuaucuuuuuuaauggggugaaaauguuaacaaucuauucuuuuaacaauuuggagauauacauuauuacuaauggcagucacuaugcggggcaagagaucagccaaaccuauucccccagucuagcugaaucuuuguaaccuuugauuaauaucuucucuuugcccauccuuuccucucucucugcaggccucuggugaccaccuuucuccucucuaggucugugagauccgcugauuccuuugccuaagguucuaaaggagauugcaacaggaggauagagagaggucagaucuggaccagggugguaauaaaagauaaaaaucuucuugaugaauucacuaauuuuguaugaauaaaagaacaaaguugucauuucuaagauggaaagacugagaaggaucagguuuuaguuucauuuuguuuuauuuuguuggagugggggucagaaauuugguuuuuaacauauuaaguuuggggagcuuauuacaugcaaaugaaauuauugaguaugcaauuugcugaguugggagcucagaagacagaucugggguagaguuauaaauuagagaguuuucagcauaguaaugguguuuacagcugugaaaauggguauaucucauaagaaaaugauucucaagcuaucucuggugacaaaacaggauuuuauccaaccccucaagguccgauauuugaucgcacugugcauggccaguguguaauccacagaagugagucuggcauuaccugaacugaacaauacccuguuuaaugguacaagcccauagaucacagucuugaauguugccccaacgugaaguugauaaaaauguguuccaacucuugcucccaauaucgguagauaugucauuugaggaccaguaaaaucagcugguaguccagaggcagucugcaugcucuacucgaguaguucugaccagucacugagucagugugguuagagaggagacaaugacaucaugugauuugcugggcauguguuucaugaccuuaccacacgucggaaaaaccaugucaucgagggcccaucucgggaaacagagauuucauccucacugcccugaggcugcaauggcagccacaugcucucagcuacuuuauugguggggauaagaaagugaggagcagcucaugagacggaacauuuacaagaaagggcuccaguuaaccagaagagacuagguuaacguucacuggcucguuuaaacugucucuggcauuaguggaaauggaaguuugcaagggaaguuagcuuaaaugaagagaaagugaugaaagccacaggugguuguccugcauaugaauugugaaaauuuucaucugcauacuguuuuugcauacccuuuauacaguuucuacauauaagauuacaaugugguggaaacuugccauaacucuuuucuuauuauagcaaaauucaguaugaaccaguuuugucccaagugucauauaaguuccaguuauuuaaguacuagaagaaauguacguuacuguaauauagcuucuuugaaauauggaugaagaaacaaaguauauuucaaaagcacugcauucuuuagauucagaagagggauuaaaagugagaaauuaugaguaguucaggagagcauaugaugaaagccacaaucuccccuacacucacugccagccacugcuccugaggaagauaaaguaaaaaauggagcauauggcugagcacgguggcucacgccuguaaucccagcacuuugggaggccgagacggguggaucacgaguuuaggagaucgacaccauccuggcuaacacggugaaaccccgucuccacuacaaauacaaaaaaaaagaaaaauuagccgggcgagguggcaggcgccuguagucccaacuaugcgggaggcugaggcaggagaauggcgugaacccgggaggcggagcuugcagugagccgagaucgcaccacugcacuccagccugggugacagagccagagaccgucucaaaaaaaaaaaaaaaaaaaaaaaggagcauauaugcaagaaaaacuguaaagggcucaaagagcaacaaauauacuccuucaaaguucacauuaguaaaaguagaagaauaaacaauacaauuguuagcaaaaauaauuuuuuucagaguccugauauuuccccagccaucuaauacaacugacuuugucuuuuaguuuuugauauccaauccaaguaaguacugauauuuccuuuggauuuuaauauacucauugcauauuuaaguuuuuccuacugcaaauuccauaaggaaucuagaacagagaugaaauuuuagaaagugauucuguuuauuucauccucuuuggcuuuuauuuugccguuuaagucaaauuccauuuucuaggacauauauugcauguuccauuauuuagaacauugacaaaguguaaugcucuuuaauucuuucccuguguauucauccauguauucauaauaucugagaaauuauacagaaagcuauuuuaauugcuuuugcuagcuuuuugauaccaauuaugcauacauacagauauuuuauucuuagcaaacaucuggaaauaauuuuuguuuucuauggaaauguaaaacuucauugggcauuauagcuuuuacucagcagaaacuguugaggcucgggugaauuaagcacacuagagaauuauuuucuccauaauauuccuuuauuuauauuuugauaaguagcugcuguuugcauuaaguggauuuuucuguuuuuuagccuaaguuuaauaucuuaaaaaauagcuuuuguuuuaccuguguugacaucuuagguccagagauaaagaaacauuauuauuauuauuauuauuauuauuacuacuuuaaucagaauagcauuguugauuucuauauuuucugaagcauagucuuagaauauaaaauaaagcaguauauuaugaggacagaggauucauuuguucauugaauauuuaacugauauuuauuacguguccacuagggacaggaauuaugcuaagcagugaaugaauaagauggucuggauucccaagagacucggugcagguagaagagagagccaagugagcauaggaguguaaugaaauucaguaaguauucugcgcucggauagcaauaugaauagguaacucuguagacuccuaaugagguucagagaaagcugacagagguacugccucauuggagucuggggagaaacacaggaauuaagcagaaugaaucaggagguaugggacugggagugggagaggaguggaugaugaagugggaauagaaauaguggcaggagaugggacuagcaagauaggccagggcuugacuggauaaggcccuaucagccauucaaauacauuuagauuuuaucuuagagagcagagcaagguuuagaacaguuggggauggggugaagcuguggaguggagacaugguuaaguaaacugcuuucccucuugaaaaacuuucaaaugaauugacuugcagauggucaggacuagaagcaggaaggcuauuuagaaaauuauucgaguaauuugaguuggaucguaauaaggcuuaaacuaaaacagaaaaaugaauaauguauuacauuuacucuagagauguugugaugacagaacugacagaauuuggugauugacuaugcuacaggacaacacuaaaaaauaucccgauggccaggaagcuccugacaguauacuuaggaaaucuccucuuuuaguuuugagauacuguuuaggccuuuacuuaucuacuugucuauagcaaguaguuaacaacaaguaguacugaaauuauagcuugaauuacauaauggugaaaaaugaguaaauaccaaauaaaauauaacugauuuccagcucguugaggguaaacuuaaaauagucucaaacuauugcuuacuucuaacuuuccaccuucaacaaucacuuauagggacaucuaucuuuaagggaugagauacugguuaauauccaaaagcucccauaaacagggccacuugcucuuaucauaaugcacugucacauagagcaguuugcuaagcacuuguuuuggaggaugguucugacaaagauuccuugagauuaucugcuccuuagcuaacuuuggguccuccagauguuggugaaugcauauuacugagacaauucugaggcagagaaaaauuugaggaccuguccuaucccuuggauuuccugguucuucuuccgugagccuaucuaucuggaauugguuugagcagaacucaacuacugacuauucugcauucucugccaugacaccaaccuguuuuauuacaaguuguuagguagaaauaaacugaauuguuaaagugaaauuuaaaacaaagggcacaaaauacagguucaaugcaugcagggaaagugaaagagagaagagccaggaaugaaucuuggcuucuggcuuauucaacuagauguucuauuucuagaauaagaagagguuucggggcucucaccuggaaugugcugaggacaggaaugaaugcgauuugaguaugcugguuucaggaccccgaagaaaaguccaauaaacuugucuuguuggcaacuggguaagaaauucuggaacuaagcaaaugggauuguaauggagauggaauuugggaagucagcaacaugagauuaaagccaugggccuagauaaaauuacuugagaauguguggaauaagaagagaaagcagauaguggaucuaugagaauaccaacauucucuggaagaggguaauccacaaacagggugagaacaacuggacaaagacaaaaacuggaagaaacuaaagaggcuauuuuaagaaacugggaauaaaagaaaguuuccagugccacacaaagguugaauaauuuaugcacuuaaaugguuucauugaauuuaaaacaaggagaugacagguaaauuugacaaaaaucacuuucaguggcguuugcaaugggaggaagaagguagagauagcaauuuuuuuuuuaaugagaaaaaaaguggcagaucagacauuauguuaaaaaguagagagggcuggccccuuuuaaggucuacaccugcaagagucaaagugucuuuuuuuucauugcauguacucaaucgguuaaacaagucacaaauugaguaucggaagaaaccacacaaaaacaugaagacugugaggacucugucacugaggccaucuuuggagauuagguaccacaaagacaaaaguuaacauagucuuauagcugauauuuauuuuucaauacagcuugcgguuauaaugugguaguuuauacacucaauuagauuauucauacacacacacacacaauagaugccauuuccuuaggcaguaagaagaguuuuuuuuuuuauuauuauuauuguuuuuuuaaauaccaguugcacaacuaauuuaaaauaaagugguugaaacucucauuuaacuagggaaagcaaauguucagaaaauucuguauuuugagaauccuaaucaauacauauauagcuuagauccuuccugagugaugucuuugcuccauauuuuugugcucacuaagaaaccaauugaaaacaauaaaacuauuuuuaaaauuuuaccuuccuggccaauucugucacagcaggugaucucuauuuuuuaauuuguaaauuucuaaaacuucagaaauuauuguguauuuauauauuaaaauccagaagauaauugcagaauugacaauaaguuauauacuguuuguaguuaacuuugcauaucaauuuuuccauuaucuuuucaaaagaucaaaauaauauacuaugauguccauguauauuauucuaugauuauuuuaggaaucauuaagagaagcuuuaacacauuucuggaaugcuagugaaauguauauaucacaaaccauuuguaaacggcauucacugaauuguuuuuagauauuaaaaauauauauaaacauuccuuaauuaaaauucuagggggauaaaugaggcaugcuccaacaauuuuucuuaucuaauuccuaaggaaacacaaaauuauuuuuaaaaaaacacauuaaacuuagacaaauauaucucugauagucuugaaaaaaugaggcuaacuuaaaaauuuaacuauggucaauugauucugcagagugggugguaggcuauugacuuuuuaagauacugcucuagagaaaaauaucaucacugauguguacuaagaaagggcagagacaaauuuguaagggaaaaguuuagcucucaaaagguuuccacagcagaaguguuuccuaaaggccaagaaaaaaaaaaaaucugcguacugagcaagaaaucaguguauaaaauccaguuucuguagggaagcuggauugccuguuggauucuacaacguaggucucgagcugguggcuuuuggccuccacgaaccauaaagagcuuuguuuggccuagagucuuaaaauauuuuaaauuacugaccaaaucuuaaaaucacaagucuuuacacuagaauucugauaucaggauuuuccuaaagcaccagaauaugcuggccuccaaguucaaacauggccuaccuuauuguugcacuucaacugccuucugauauguguuggcauuugaauucgagaaccucaacuuaaaugucagacaaguuacguaaaaguugaaaacagguaaaauagacacugaguaguaucucaguguaaugaugggcuugauuuuccaauuucuagauuauguuacaccucuguggggcagagaguaagagugacguuuugacuuuugucuagugagagaugcccucauaaaaugagguuacuuguguucaauaugaaacuaauuucuguccagggcaauaugcagagaaauacgguuucucugucagacaucauucaguuuuguaugaaauuucaaaauauugcccuuacauuauauauuaaauacucuuuaucuaaauccuuaauugcaauuuagcccaguuugguuaucuuaaaauuucccucauuaauuaauaaguuaaauaaaucaucauuaaaaauauuuuauauuugccuaaacauuauaauuuuacuaguuauaauuuuauuaaaguaaaauuacuuacuaaaguaaaauuauauuguaacagaagaaaauaaacuaauuaucagaauuauuuaagcaaaagcuuauauuuucuuauuguacuuugcuugggcuuaguuucuauucuauuaggucggugcaaaaguaauuguggguuuugccauuaaaaauaauggcaaauuugcaauugcuuuugcaccaacauaauauuugauauugccugguuuguugaucagccaacaaaauuguauugauucuauuuauaaagacauacaguauagcucucaacaguucagaguauagugacugagaaauauuuaaaaaauaguuauuauaaugcaaacuguuaaauguagagguagauauucacaagauacuacggggaacagaaaaaaaaauguacacgugguuggggaauuagggagacugccuaguggagauaauaaggauuaguaggcaucacccaaguaaaagaguugaagaggaagucuuuccugcaagaccaggaaucaggcauugccuaaaaggguguaugcaaguuuggaauggguugggggugauaauaaaugagccuguuuuaauuguuguauuuauagcaaaacuaagaugagguuaugcuggguauuuaaaucaaucauucuggauucaugugauucugcauccuaucccaccacucugaagcuuauuuuguuucucagauuuaaauuugucugcauuugacauuuuagauaauaguauaucccaauaaaucaccuuaaauuuaaaagaaaaauaaaguuucuggaggaaggaaaacgauuauccaaaacucuuacuugacuucuuaaguaugguguacuuagauugccaguaguugagaaaaugcaauauuuuauaauaauccuccacagaaagauacuuuaguaaaucuuaguacauaugaauaguugcaaccacucaugugaaaaugagaauuuaugccgucggggacugaagcucaaaauagcuuuauucagguacuuugagacaaugacauaaugaguuaacuuuggagauaugaccauuugagggucucccauugcaucucacauuucaaaagagaaacuccuuuuucggagaaguuauguguccauggugccauguaauugucuaagagccaucaguaagcuagcaauacuuuuauguauuuccacgugauuauaucccauagauguaccccauaaauaugaacaauuauuacauacuaacaaaaauaucaaaaauggcucuaaauuaauuuauaugguguuucaauguuauguuuuuacaacuacagauacacauaauuugauuaugagauuuuauuguacucacacacauauagcuaauuacauccuaauccauuauuuguaacuguauauccugugugaauuucaugauuaaauuuaguuuuauuuggaaggcuuugcaaugcaaggaaauaggaaaaaagaaagagagaaagagagagaaaggaagggagggagggaaggacggaggaaggaaggagggcgggagggaaggaaggaaggaaggaaagaaggaaggggaaggaaguaagaauaaggaaggaaagaaaaaaggaaggaaggaaaaggaaggaaggaagggaaggauguaggaagggagggaaagaaggcuggaaggggauuaaaacaccuagauaagauaaagacacauuaaucuuaagcuaaacguacagguuuagaauaauuuuuucuuucauuauagcauaagaaauacugcaguacaagaaggaaaaacugucccuguagaugggaucccaugcauaauauaaaugcuaaauaauuaucuuacagcaguuucaaaugguugggagaauguaguaaccuaagcaaagaguacuugcuuaugaaggccagcauugaggcugacaauuuccauaguguuuucaaaaaguuuuucagaauucucaaccacucaauuauuaaauauucuucagucaaggucggccaucagcaaacacuguucauucauauuuauuggauaucgauuguaugguagcugaugggaauguaaaguuaaccuacaugaaacaccaguuuucuucaaagaauuagaaaaguaaauuaaauauuaaagaacauuuuacacuaucuguucuuacagagguauguacaaguuaauaaaaaaaugcagaccaaaaggcaaaagcacccaacaaaagagauacacaggucaaggaaauuguuuaaaguuaucacuuuaaauugaauuauuuuucauggcgaaccacaggggcagcagcauuucaagcuuaggaauucauguacaaaagauugaagcauaagaaaacaacuaguuaaaacaagagaaaaccaaaacaaaacaaaaacaagaaaaacaaaacaacaacaaaaaacacacagaguuuuaaaaaugcugaagcaaagagugccagaugaagaggagcaaaagauuaauuuggaaauauaagccacagauuucgaaggguauuguuucccauauaaaggaauuuggcccuuauucuguauacuaaccuggguuaagaaacaauuuccuaaaacacugaaauauuucuaaggcauuacuaugucauuggaaacauaggagacagagaauauauuguuuccuuuacgcccuuuccaguaaacaguauaaguauuuggaagaaauuguccaaaaguugcuugguguaugguaggaaauggccaggaaauggcagguguguuauaagugaaggacaacagguggcucgacaccucugcagugagcaaccagugguccuuucacaguuucuauaggcaguauccacugucuucucuaaauaacuaauuaacaaauauuucaagaacauagucuuaaaggauagccagaauauuacucuccuagguuuuuacauagcucgguuuguacccaucuuccacaagaggcaggaugucaucuuugacaucuucuuacuucuucuauugaaacuucuuccucuaaagucacccauuuguuaacugaugugcgcuuaguggauuauuccucaacccauagacacacauauaauugcugaagguggcaacaucaguggguaggaaaaauggcuggauuccuugaagacuauccuaaagagacaggcaguauggcugauuaugguagcuuucuauccagucuucaaauauucagcuaucauucaccaaacuucuugcaggaccggaagcuagaacagaugaauagucagucaucuauucuacccacuuagaauaucuuuuucuuaaccuguacaugcuucugcuccaggagagaaaaugcauuucccuccugagggaaaaacaaaauauuucucucucucuccauauauauauauguauguauauauauacacacacacauauauacauacacacacauauguauauauacauauauguauauauguaauaaaugaucucuauauagagauauaugauagauuuaucuuaaaauaucuauuuaccuauauauauuuaaucacugcauuuuauaacucucuucagcacgauaaauucuuuucagaaggaaucugucaaagguauaaaauuuaaaacucaaaauuaaacugaaauuaugcuuugaucgugacuaggaaaaaaugaaauagcucauuauauacugguuuuagguagaaagaacaaaaggggcaaaaugccuucuuucuucugacacagaaauagauaacaaugcaagagauauaaaauaaaugcauuuguuaacuguaugcauaucagaccacaaaaguccauauguauaaaacaucuuuacaaacaauauauauuuuuuccuaccaauuacugucacuauuauuuaucauggcuuuuccuaugaauuuauauauguuuacaaaaacaugaguugucucugcauauagagauuuaaauaucaaguuggaguccucaagaagauuacgaucagaaguuuauaccuaucuggaauaauuuugcaaacauucacuuauugaguaacauugaaucauuugaauguaaaaaauaaaucauuaaagaacugauauaguauaauuuuuuucuuugagauagugucucacucugucacccagacuggagugcaguggugcagucucaguucacugcaaccucugccucccagguucaagugauucucaugcaucagccucccaaguagcugggauuacaggcaugugccaccacgcccagcuaagauauaauucuuggcuuccuguagggcaagaaauuugaugcauguuggcuaaauauuugaagacuagauaggcagucaccauaaccgauuauacuuccuugucucuuaucucuugacuugagauaaaaauaacauuaucauaauaaauuaagauggcuacaaauucuauggcucucuucucauugagaggagaagucugucucugccucuuaaaacugagcuggcuuuguggcugcuucaaccaauggaaugauuggaaugugacagguuaccaguuucuuggcucuggaccuaaaagauuggcugcauucacuuccugugucauggaaaauucauacuugggaucaggcacugugcugucaaagucucaguaaccuauggaaaugcccacaugaggagaaaguaaggccccagaugagcucucagcugauaacagcaucaacuugccagccauugagugggccgucuuggaagaaguuccuucaaucuaagcugagccauuucagcugauggcacacaaagcacaaaugaacugcugccaccaacucuacccaaguuguaaauucaugaguaaaauaaauauugcugcuguuguuuaaagcuacuaaguuuuucagugguucaugauacagcaauagauaaccaguaauuuuauguuggccaaaacauuaauaggugggaagaggugccaaugaguaguagaauguguaugagguucauguaaaaugauaucacaaacauugucagaaauacaaaaguuauaacaagaauaaaaaaauggauaccauuucuugugccaacuucauagguaaauuguaguuucuuagagugcuguguugacgaggccugcuaugccagcuggugacagugggagcugacacugauugauuaccaccacguauuugucauuaacaaccuugagacauuugcccauuuuugcuguuguuauguucauguuagaagauccuucauaaugucauauuauuguaaaaaaucauucaccagaaaauaagaacaaaaacuguucauauucauucagguacuugggacugccaaaaaaauacacagagcugauauuucauguaugccuguaauuucuguguaauuuaucuuuugcauaacuucugacuuuuuucaccuaaaacauuacauauuuucagcuaacauacuggguaaaacaucgugcaaauuugucuuuuauuuuuauuuaauuuucauaauuucaacuuuuacauucggggguauacgugcagauguguugcauggguauauugugugacacugaaguuggggguacaaaugauccuaucacccagauagugaucacaguacccaauaaguaguuuuuuaggcuugaacccauuccugucuccuccacuuaguaguccacagugucuagcuauuauucccuucuuuauguugaaguguacccaaugcuuagcucucacguauaaaugauaguguaugguauuuaguuuucuguuccagcauuaauucacuuaggauaauggccucuagcugcauccauguugcugcaaggaacauaauuuuguuuauuuuuuguggcugcauaguauucuaugagauauauauguauguaucacauuuucauuauccaauccaccauugaugggcaccuggguugauuccauaucuuugcuauugugauagugcugugauaagcacaccaguucaugugucuuuuugguagaaugauuuauuuuccuuuggguauauacccagaaaugggauugcuggguaaucugucuuuuaauuccagggcuaauaucaaguaaugauguaugaucauaguuacacaggcugauguaaaccacaguuaaacugguucacucauguuggaaacaaagccauugucauuuucaaaauguuuaaaagccuaaagaaaauuugcauuuacuuguauaaugacugauguaaauaccaagauacauuuauuuugauuagguuuauuuaacuuauuuuuaauaacuuguuuuuuagcucaugaucaucaaaaaugaugaugagaagcuauacaugcuugauuagcaaaaguggaaaauaaauuauaacucaacagaugugguuuguuugauagacaaauauuucaaaacauggcaucucugguugaaauacacaauauaaucaguagcugacaggaaaauuuuaaaaaguggugccaugucuauguugaaaagcuggcuggaaaugaaggcugaaaccugaucuggauucuccaucuggucuacuuuuaaaaaucuguggguccuugggcaaagcacuucacaacucugcuuauuuucucacuuguggucaggacagcgauaccagcuucaacugacuacuuugaagagagugaaauaaaauaacauucuacauaaaauacugucgagaucugaagauagccuaugagugugucgugguagaagacaaaaucagggcauaucuuuaauacauuuucccacuuuuuaaauaugaaggaccuugggacacagguggcauuuucaucuuugcuuccaaugaaaguuggaaauuuggaagauaagggaugcuguggagcuuggaucucugucucaguugcuggcuggcagcacauaaugugauuuggcuuucuguaccaugaauauacccaagugauagacgcuuggcuagggcaccugagagcuccuaaugaggacgagaaagaaaaugccugccuggagaauuuccaaucucaucaauaauacucaaaucuaaauuagaaucggagugagaaaaaaguccuagauaaaauuauaaaacaggauaccaagaaagacauggggauugaugaagaaaguaugaucaagacagacaugccugguaauuuauaugauaauauaauaggaaggagcuucagaaaacuuucuguguucuccguagucuauacacuaggaauaagugaugaagaacaagguauuguaauuuuaacaagaagauguaaaaguaaaauuuuagauaugaucaagauucagugguuucgauucaacuaaaaaacaauaauggaaauguacauuuuauuuaaaauaagaagaccaugcagaauaaaauaguaaauuaaagcaaauuacagcucauuuuuaauauagagguuuaagucauaucacaauacagcuuaguauugggaagacacgucuaugaaucucacuguuuacagaugaaugacuugcaucugagaguuaaggagacuuacccaagaccacaaauuuaauaaacaguagaguuuaaauuuacacuuggccuccguccugaagucuauugcuguauucuaccauauuucuggaguuucucuguaucaaagaagauuuacacauauuuuagauucaaugacccuaggaagaaauaucuaaauauauauaagaaagcuauacuuauaacauuuuuugaaaaacagaaaaagcaacuaauuaaaacuuuuuuaaaaacugcuuuauugagguauaauuaauauagaaaaagcuguacacauuuaauguaaacaaugcaaugaguuuagggauaagugugcuggugaaaccaucaucaccaucaaggcaauaaacauaucuaucaguucccaauguuuccucccacucuauuauuuucugugugugcauguguguaucugugugucucugugguuaagaacuaucuacuuaggaaauuguaauaugcaacguaguaucauuagcuauaggcacugugcuugauacuagcucuccaggacuuauuuaccuugcauaacugagauguugcccccuuugaccaucauauccccauuuccccuuccccuuauccccuggcaaccacucuucuacucucugugaguuuuacuauuuuuaacccacauguagguaacaucauauaguguuugucuuucugugucugguuuauuuuacugaacauaauguccuccagaucaucuauguugucucaagugacaggauuuccuuguuuuuuaaagcugaauaauauuucaguguauguauauacuauauaaucuggaccaaauucuuaucaagaugaaaaaaaaauggguaggcagaauagaagugaaaaagguccuaggaaaugguggucuugauuauuucaauuuaaugauaacuaaaaaggaaagcauuagaauauaguuaaauuuaaauuuuugauaaggaaaaacacaugauguggaaguuaccuuacauaugaaaugauagaguaaaauacaauuguuaccaauauaucaauaaaagguaaaugaaaguuaauuaacaagugauagaaaguaagguaaaauuaauuuguuagccauauauguauaaaauauucuggagagaaaaaaauagaaacguuauaaaauugagaaaauuuccacacgaguucuacuauucagauaucaucagguucugcccaaaauaaaaccaaaguauauuuaaugaagguuaaauaaaaugauaccauguuguaaauaacauuguuuaaagaaauauuauauaauuuucaaagauuuggaacucuguuugaguaagaagagggaaaaaaacacaaaaaccugguccuugaggcuaaugaucuaaugucaauggaugauagauuaauucauuggcuagauuuucuaaguaaauaaauuuuggacuuaaauacuugguagucagagcuaaaaaucaagguuaucaaagauaacauaaacauauacagaacaacccuaagucaguuuauaucucuaagacuaaaaguggacacccuaacauaagaaaagaacuuagauaaauucuuuuugacuaauuguagguuauacaagaaaugcuaggguggucaaggaaaugaccugugaaguguacaucugugaauacaaucucaucuagaauaaaaugcuaaauuugcauuaacaccuuagaaaaaaagcauaucaggaagccagccugaguuuauuaaggccagacucaacuuaauucuuuuguuuguuuugacaaggcaauuagagaaaauacaggggaauauagaccguaugccuggauuucaacaaaauuucuuacugaaagaaauuuuagaaaaaaaauacagaaaaauaaaugguaaugugaaagaaaaacugauucaauggcuuuacucauacuuauuaauaaugaaggucaggcugcaggauauuaauguaaaauaauuacaauuaaaugagauaaauaaaaaccauguacuuaugacaucaggugauccgcugccucggccucccaaagugcuaggauuacaggaguuggagaccagccuggccaacauggagaaaccugucucuauuaaaaauacaaaaaaacaaaacaaaacaaaacauaaaacagaaucaguugggugugguggugggcgcccguaaucccagcuacucgggaggcugaggcaggagaauugucugaacuggggaggcgaguuugcagugagccaagaucgcgccauuguacuccagccugggccacaagagcaaaacuccacugucgcaaacaaacaaacaaacaaaaaaacuauguagauaucuagauaucugagauagaaaaaaaugaagauuuuuaugaauacuuagucugauggauagaagaguaaauaaggagacuggggaauggagagaagcaugaggggauacagacacaccauaaaggaguuaaggguuuuuacauggcagaaauauuaggucuauuuccuaugauccacugagcagcagggcagacgucacucacuggcaaauuacaggaauuuagcaaaaguuuuccagcaagaagaguugcuugaaaaugaugaguuuauaacacuuguguuagucaagcaaauacagaaaaauccauuucguguucacgcauaaagagaauucacucaugacauaggaggcuauacuagauaaacuuauuccaugugaugauuguacaauuuugguacugaggaacacguugguaugaaaauuuccugaugauuuuaagcagauuccuacuuggcacacuaagcauacagaauacuaauguuacaaaauuugaaaugccuaaaaagaaaaagaugugaucaucaauuaacauuuuuaaagagagauugguagaauauuagauuaagaaacagaaaaaaacauacaguccaggcagucccaauagccucccauguuauucuuuccauggaucugugaggcaaagauuaguagucuuauugaauauaccagggcacaaaugugaaucauuggagauaucuaccaaaaagaauuauagugcugcaauuuuuuucuuugucuguuuuagaauuaaacauuaaaaacaauaaaagaauguaggagggcaaauuuuggcagcuuugaaagugagauuggugcuaucuugguauaaagauauuucuuucuuuuuuuuuuuuaagaaaacugaacaaaaaauugauagcauaagggaaaaccuuagagucagaaaaauccugacaaauuaagaaaguaauuaccaaaauaaaacacaugaaaaaacauuccuccagcucuaggcuucagaugcucuuuuaaaaucaguuuugauugcaggguugaggggugaauaaaccuucaaauuuuuauaaaagcagccagagaaacaauuggguuaacuuuacaaggaaucguuuuagaguaauuuguacuagaauuagucuauucuugaaaucuuaaaaauguaaagggaaagcacauacacacacacacacacacacacacacacacacacacacacacacaccgacuuacauauauucagaguuaaagagcauaaugaaacacgacaaguucuauccugugcaaaauacacucacauauuauugaaaugcuuaguuuacaauucaugcugaaaagaaucuuugacuucaagugauaagucaguuguuaaaauacuggcagagcacacuccaagacaauacgguaauugaaaacaugacaaauagaaucacuuaaguuuucuuauuggcucguuucaauccauguccaacuaauugcuuuccuugcaaaaagaaguucugaagacaauaaaaauaauugcugaaacuuucucuguaagauuaaaaucuuaaauaauuaaagauauccauuuauauuaacuauaauuaucauguauugcucuugcuuuuuuaaggacaaacuagaggaaguggcagaauucaaacaaugccaacgugugugcauuuuuacaucagcuauauaagagcuuguuuugccaaauuuccuaacacuguuuaaaucccaggaaaugccucaaaguuaauuacccaugugacauuccccuauauuauuauuuacauuagacuacuggaucccugguauucucguuucuugccacuaacuuguuaauaauucauuuuuuaaaaauuuucuuaugcaaaaaauaaaagauuuauuugauguaagcugcagguuuuuuauuuuauuggaaucaacaauguaaauauccaaagacguuaagaguaacuuaacauuucggaagcaaauuauaauuucauuuuauuuacauuguuucuauguccucugaaaauaguuuuccaagaaaccacacaacuaguuggcuaaacauaaguaguuaacauaacucaucuaacauguaaacauauuuuuccaugaaauuuuuaguuugggggucugggagauacacaugcauuuaaaaaauuucauuagaccaccauugauuauaaacucuugaacuuaucaaaugcagugauuaggcuuguagagacuuaccuuuaaaggcauauaugacauugagagcuguaaaaauuuuuaagggagcuagaaaagcaaauuauaauuuugucuacaaguuuuuagaaugauaauaauuauuguacuuuuuauuuugaguagcagccuaucauuuacaaaguaauuuacucucuacuuccccucccuuccuugacuaauuuugcuugacuaauuccugcucaucagcauuuuggccccaguuagacaugggcuuucuccucgaagucuucuguugcacucuacuuaugcuccagugggcccuccagccccauccuguagugcaauguccuauucaucaccugaauguaaaucccauauguaugggaccucaucuaccucaaggaacauuguacucuccaugcuuagaacagcaucuaacccauagcugauacucaauacauacugaguaggaaacaucucacucaguucuuaagauggcacugggagguuucgagaugcccaagaagagaaggagcuguauaguaguaacagccaaaauagggaccacucuuuccacuauuccauugcuaccugucaaauuuauucuuccuccaauuuuagcugcaauguaccugcaaauaaauaauaugcaagaaaagaagcacaguugaaccucacacacaaauuugaacugugcagguccacuuauaugcaaauuuuuuucaaccaaacguggggaucaaaaauacaguauuuucuggauccaaaacccacauaucaggagcaccaacuuuucauauaccuggauuucacagagcuaacugcaggucuugaauauuuggguuuugguauaggcagacgguccuggaacccauccccugcauauacccagggacaauuauauuacggaguuuguuacugguaaaauaauaguuagaaaucagaugaacuuuucuauugaaaaugcccuauuuacaugcuuaaaauucauugaacaucaauaguaaccaagauaggucauaaacuauggcuucuuccaaaaaaacuaauaaaugacacuucaaacauaauaugauuauuuuauauauuagcagaaaguggaacaacuuacauuaacauucucuuugauguuaaaaaaacagcuugaaauuauucuaaauaaucuauaagaugauuuuggagaaauuggagaaacuaauuuuuuauacuaaaauaguguuuugaucaauuguuuagagccauuauuuuuaaacauucuguccugauguucuuaacucuuuaguacauuuauuauaaccuaacaagauggcauuucacaaaugauaauguguguguauuggcuguauguacuuaugcauuugaaaggaauggagcagagacagaaacacuuaaauuugcugaguucucgcaaaaucuucucuucguuguccuaaauuucuaagcuaaaguuuauuugguucuuaugagaauauuccaaugaaaauaaaaacuguuuucuuuuaaauaugcaugugcacacacauguguaaaucuucccuuuaaaaccucaauaacugcaaauuugaacacauagaaaaaaacguauuuuuugagaauuacuacuagcaacuaaagaaaagagaaaggcaaugcaauuaucagaaguaugugccaggagcuuaaauauaauuuuaaaaguuaucucugaaauuauuggaaacaccuuuauagggaauauugugaaauaacauuguaaagaauaauaugcuguauuucaguuuugaaauaaauaaaaauuuugaaaaauacaauguacaaaugcauauccauggcuaaaauaauucaaguccauuaguuauuuagaacuauauaaacaacuacauaaaacaaauuuacaguuacgguaccuauguaacacaccaaauaguuaaaaaguacauaaccuauucugcaaaaagugacauuuguaguuugaucagaauagguuugaaucuguaaauugcuuugggcaguguggucauuuuaacaauauugauucaauccaugaacauggaauauuuuuccauuuauuugcaucaucucugauuucuuucagcaguguuuuaugguucuccuuguggagauucuucagcucuuugcuuaguuguauuccuagauauuuucuucuuuuuguagcuauuguaaaagguaucgcauucuugauuugguucucagccugaacauuauuuguguacagaaaugcuacuuauuuuuguacagcacuaggagcugaccuaccauucagcucagcaaucccauuacugaguauauuagucuguucucacacugcuauaaagaacugcccaagacuggguaacuuaggaaagagguuuaauugacuuacaguucugcauggcuggggaggccucaggaaacucacaaucauggcagaaggggaagcaaacacauccuucacaugguggcaggagagagaaaugcagggugaagaggggggaaaggccuuuauaaaaccaucagaugucgugagaacucacucacuacgaugagaacagcauggcggaaccaugaucuaaucaccucccaugaagucccuccccuaacacauggggauuauaauuuggauuacaauucaagaugagauuuuagguggggacacagccaaaccuuaucacuggguauauucccaaaagaaaauaaaucauucugccaaaaagauacaugcauucauauguucauuacagcacuauucaccauagcaaagacauggaaucaacccacgugccuaucaaagguggguugaaugaaggaaauaugguuuauauacaccacuaaaauacuauauagccauaagaaagaaaccguguccuuuguagcaacauggauguagcuggaagccauuauccuaagcuaauuaaugcgggaacagaaaaccaaauacugcguaucuucacuuauaagugggagcuaaacauuggguacaaauggacacaaagauggcaacaacagacacuagagaccagcagaggaaggagagaaggaggaggcaagaguugaaaaacuaacuguuggguacuauggucacuaucuagacgacgaauauauuugugcuucaaaccucagcaccaugcaauauaccuuuguagcaaagcugcauauguauccccugacucuaaaauaaaagguagaaaaauaauaaaagaagauaauguguuuuuauauuuuguaaaaaaaaaaaaaaaaaaaauuauagggaucaguucaccaagcacaagugacagagaucauaacucuuggggguaaaacuuguauauauuuuuugcuauuuuuucccuuaguuuuugaaauauccauauuuuccauuuauugugucaaaaaaucauaaauuuuucauguuuucagaaaacauccauuuuuagcaaaacauaaccaauaguagcauuugaaguuucaucccaauccagggucuugacccccaccuccucacccaaaauaaauaaauaaauggaacacacaugaauaauuaaagacugggcuaaaaaucaggcagggccuuaagaugauuuuguaaguaggacuucuuaugaugucuggguuuccauaagauacuguauuugaugaaaauauuugccauauccuaauaaaucccacaauuuuaaagcucuaagaaaaauuagagaucauccaauucuauaaccugcuuuuacaaauaaaacaugaaaaauuugguuuacauauuugagauuauucaguuuauucuugagaaaaccaauacaguuuuauuggcuuuuccuguagguuaaaauaccuaagaucuagaguaacguguguggaauuagaauuguuccaugugauaggguucuauuggauggcagugcaaagaaugcagacuuggcucaaaauucuggaaggauuuuuaaaagacuuuccuggaaucuacucaaugccaauaauuacuuggcugguaacaaaaauaauuccuuauaaacaucucucagauauuaauuuugcucacauuauagcuucaacagauuuaggaaugucauuuaaaugcugcugguuuauuaugcaaacacaaagccacaauucugcaaacacaucucugaagacauuucugaaguuaguaaguccuugugaaucuaaugaggauaauauuucauccccugagauuuuguagacaacagauuaaaagauaauaaaacaaauauucagcccucuguaaguuugaguuuccaaagagaugacaaaauguuuuucuccuucuacuaauauauaaaugggaaaaccaagcacagcacagcagaguuuuguacuugcacaccuaauugucaucaaaguauuagaaaauauacuccuuaaaugguuuaguugggaugauaaagagggaaaacauaaugaaguaauaaaaagcucccaucuguggccucuggguucauauuucaacuccacuguuguguagaauuuucuacucagguaagaucuuuauuuacuuaauuuuaaguuuuauuuaauuguauuuauguuuggcuuaaacaaacauuuauuucucacaguucugaaagcuggaauucuaagacauggugccgacauggugccagcauggucagguuccuagugagggcccuuuuccuggcuuacagguggcuaccuucuugguguucuucgaauggcagaaagagagagcauaaaggagcuuuuaugaauuucuuucuauaagggcucuaaucccaucacgaaggcuccaacuucaggaccuaaucaccauaggcuccuguuuccaaauaccauagcaauagguauuaggcuuucaacaugugaauuuguggaggacauaaacuuuucauuauuaucugugauauauuuggcuguguccccacccaaaucucaucuugaaauuuuagcugccauaauucccauguguugugggagggaccaggugggaaauaauugaaucaugggagugguaucccacauacuguucucaugguagugaauaagucuuacgagaucugaugguuuuaaaagggaaaccccuuucacuuggcucuuguucugucuugucugccaccauguaagaugugccuuuugccuucagccaugauagugaggccuccccagccacguggaacugugagcccauuaaacuucuuuuucuuuauaaauuacccagucuccaguaugucuuuaucagcagugugaaaacagacuaauacaaucuuuauuuucuuuauuauuauaaagaaaaauaacauucacugagcacugaccgugagcucaugagcuaagauguagaaacaagcuguucucauuuugggagaaggcucucagcuccacagucccugccagguucuggacccaggcauuugucagacaaauuacuugugccuuaauucccauaucuuggaagugagaguacugacuucauggaguguuaugagacuuaaaugaacuaauuccuguaaaacacucauaagagugucuguaacauaguaaaugcuaauuuaauauuauauauuuuauuuaaaucuuguagaaaaugaaggauaauuaauagaaaagagaacaauauaaaguuguucaacacugccucuugacagcuuaucaaauguaacauuaaaauaauuuuaaaacauguuuacuaacaugauauauaaaaguugggaauaucuuauauaacuggaugcauuuaauucuaauuuuaaaaaauccagaaugguuuuaaauguagaaagaguggaaaggaaguuuaucaucuaugccaacaucuauugauaauaguaacuagaauuaauagucagaagaguaaaucaaaucaaguaugcagugaugggaaaaugaugccugccacagggcaaugaaauggcagcacagacacugccucagucaaccuaugaaggcaucugcuuuccauuauauuucauuccacacauacuuauggagcaguuacuacaagccuggaguguuucuugguuugaaaaugugauugaaagcaacccagacaguccuuucccucacaacugauauuuuguugaagaaaggcauuaaacaaaugagcaaauaaaguucgcaaaagguaaguguccauuauagcaaaguaaaacaaaauaagggguuagagagauacuaggaguucuugaaaguggucagagcugcuuugaguuggacauuucaauggggaguggagaggguggaagaaagcguaagaagaucggcagguaaggcaaacaguugcaaaggucaggaggcaaggaaaagcucaucuuuuuugagaagcagcgagaaagcugauguacuuagaguggagugagggcaggggagguccacagaaauggggucagagaaacaggcgcugucaauuuaugaagggccuccuggcaauuaaaagaguuagggcuucauucagagagugaaguuaaacuagugaaauaauuuuuucaaaagagaaugacagcgucugcuuuaugauauuaaaaagauaugguuuucuaacuccuaccuuaggucaucuuuucuaacauaaacauagggcugguauaaucuuauuaaaaaaaaaaacucaagaguacuugugggaaagggaaaauguagagucuuacucagcaauucagcuguaaaaaaauauuccuaagugacuagcaaaaugaaguuagcauuauagaaaaaaaaaaaagauaauacaucaucacuuucuuccuuccccucuccucccaggguuugccacuggccaaauggaagaagaagaucaaggacaagaagucaauuaaugucacugacagaagucagcagccugccaaauacuaugguaaaaaauguggagaguggaucuagaagaauaaauagaagauaucuaccacucaaauugaagugguugcauuaacaguauucaagauacagcuaucauaauuaggggacguuggcccaugaauaaacaccaaaauaaaguaaauuguguuuccaggagacauuuuaaaaugaaagaauacaaguucugaauccucuuuuaauguauucuauugaguauuuuauuauguuaaagaacugaaaaugacuuaggacuaucuuaaaacaauaugcugaagaggaaacauuaaugaacuguauuuuaugaaagucgauuacuugauuuagugaaaauaauucauaguuuucacuugucaucauggucggguaaugaacugagaaucuccuauaauagaaaaacuaucauggaaggugacaucaugaaauauaaacaguucucaaauaaucuugcuucauucaaaguaaauauccaaauagcacugaaagccauagagcugcuaaaaaaguuuaaaaguccauauauauguauacauauauguauauguacauauacacauauauacacacauacauacauacacacacauauauaguauacacacauauguauauauguauacauauacacacacauauauaguauacacauauuauuuauauacacauauacacauauuuuauauauauauauauuuuacagacaggcucuuguucuguuacccuggcuggagugcaguggggcaaucauagcucacugcauccucaaauuugugggcucaacccaucuuccagguuuagccacuccagcagauaagacugcaggcacauggcaccacacuaggcuaauuuuaaguuuuguuauagagaugggggggucucacuauguuacccaggcugauuucgaacucuuagccucaaaugaucuucuccucucagccucccaaagugcugagauuacaggcaaaagccaucaugccuggccccuuuccuauguuuuuaauggucgaaaaaauuauguuuuaccuucuuuucauuaacuuguauguucuuguuucugaaugcaaugcuuuuguuauuucuugcuugauauuuauguccuuucuuauacaaagcacauaaugagaaagacacugauaucuauagucaaaauaaccauuaagaucauuucuuacaugcuuaaugucaucaaugaaaaacgcuuaaagcaguaguuaaaaguaaaaaguuacaaauauaccaauaaccuaaauagugaaauaugaaaauaaaaugauuuuugcacuaagucuacuuaauuaucuaaucuagaacaaccaauaugcauggguaugacagaggaaaaaaugugcauuuccuccagucuuuucugagccuuccagacuuuuugagugaaaaacacauauaaugugaauuaggucaacaauuuugacccaauaauguguauuggaucauuguugaccugauaaucaacaauacacauuauuguaucguugauccaaugacccagggugaucuggagggcgauuuugcaacuugagaauacauguuuuaaaucaguaugucuagaagguucuggcacaaauguaaggguuuaauaaaugguuguugaauggauuaauaaugaaagaugaaggaucagaauagcauuuugaggcaaacgaaaguuacaauauuccuggcaguauucugaaguuuuauucaacucaaauauuuuucuaggaaggacauuuauuuuauuauagaguuuuaucuccuuugcugaaaucauaaucacaaugauaugaacaauaugcuuucuuuacggaggagcuauuuuaagagaaaaauuccaaaauaaauaacacaaaaugguauaugaaauccgaccugauucacagaaggaaaaagaacaugcccugggggacuuggcagcaaauacaagccagcagcaagaauaugaccuucagugucugcucucaucuucaaccugggaagauucaggugaugcaagaauagauuuggugacgaucccaugaacucccuaagagucaacaugcaucuagaucucucaguccugacugauuuaauuauuuuauuuggaucugucaaagcaaaaaaccaaaacaaucugccaaacaaaguuaaacaggccaggaguuuaauguaagagaggagggaagccaaaagucaaagugagcuguacugcaacuccugcccccaaaaagauguuuuuguucuucuucucguuuuuuuguuuuuuguuuuuuuuuuuuuuuuuuuuuuuuuuugcuguguaugugugugugugugugugugcguguguguauguguguguguguguuuaagauaaggucucccuauguugucuaggcuggucuugaacuacuggccucaagugacccuucugcuguaaccucccaaagugcugggaucauaggcaugagccaccacaccuggccaagcugaaaaauuuuuauaaagcuagaauuaggucauaaaggaccuggguuuuaggccaccaguauuuccuaacuggcuuugcccccccgccaaaagcaaacugccucuuaggagguaguuuuacaccuuggagcaaagcauccuucaaauguaggcuccugcuaucccacagaagcuggaagacaggggcucugucuucauugauguuuacauuucgaagagcuggcuuccaggucuuuugagaaagacaguuucguguuuuaaaacuggcaaagcacuuucaaaaaagauuuacaucucaaagagucagagaaaggauuuacaauuacuaguuuucuaaagggaaugcucuaagaaaagggaggucagggccuagauuuaagcagcagcuuguguaaaguuuaaucaagcuguggggaacauugaggccauuuuagucagauccuaagauauaaucuuguuuauuccagaggcccuccauauaggagaauuauuuaucugaaucccuucaguuauaaguuuguguagagaaccaaauucagcuucucaugaaaauauguauaacaaaaugccacuuacaaucucagaugccauuaaaucauccuuuucugccuuuuuacacuagagccugucuuugccuuucagccuaugucugucuuucaugucaauauauucuuaguuauucgcuacuuauaaugcaaauaaauguaaauugaauaaugaaauugcaaauuuuacaaaagaaggaggucuuuccaaaguuaaugacguugauguagaacaguucaaaacaugugcaaagcaguuagaccuauucugaucaagagaaauuggcaagaaugauugcacaauaggcuuuuaaaaauaaaaugguuugaauauaaaauaaacaaaagcgcuaauugggaaacugauaagacucugaaauaauucuuugcagaaaugacuuucaggugauaaugccacagaagcagaaugagaagucguguuaucauacaauuuuauugaaagaaucaugucaaaacuugacaaacaauuuaagugaagaacugaaguauagcugcaauuacaauuuuguuacacagucacacaauuacaauuuucuguuauaaaaagaaacaugaggccaggugugguggcucacgccuguaaucccagcacuuugggaggccacggugggcggaucaccugaggucaggaguucaagaaaagccugaccaacauggugaaaccccaucucuacaaaaaugcaaaaauuagccaggcaugauggcaggugccuguaaucccagcuacucgggaagccgaggcaggagaaucacuugaacccuggagacagcgguuacagugagccaagauugcaccauugcacuuccagccuuggugacagagcaagacuccaucucaaaaaaauaaaauaaaauaaaaauaaaaaauaaacaugaauuaauuucuuuuguuuaucuagacaaaguucuaauagauccucauuuuaacuacuaauuauaccauauuguuuucuauccuaggugaauucacuuuaauaaacuuuuccuaaacaucagcuauauucaggaucuuuuauauacaaguuccuauuuccuggcaucagauuuuaacgucagacuugauauuuccuucuuccugaguucacuucucccgagaauuuaagaguaacccucuuuuugaugcaucaaauugauccuucaccaauaaacccaccucuuucugauuuauuucuccugaaaugugugacauuuuagcauuuccgacuuaauuuggugcccccuacaaaucaugaacucuuguagguauaauauaagcuauauuuucuuggaagaaaauauauaauaucuuuguaaauaauauuuuuaaaucaauaucaaaagaagauccuccaccuccacauaauagucacucaaaauuugacgaaaaacaugauguacuaacagaauaugacccaggcucucugaauguaguaaacacuucccccucaaauuguaaucauuauauccuugggccucucccuuuauccucauguaauugugauacagaaauaggaaacaucuuguaguuccccgaaacaagccauauguccuauucuccaugcuuauuauucuucucauacaccccauuccucauucccuugacccacuugcauucauaauucaaauacucuaggagcccacuucuuacccacagagggucacugugcagccucugaaucgcaugcacuuccaguucuacacuuucacccucuaagccuaaaaaagucccuggcacacagcaaguaauuaaugucauuauaucagaaauccauaacaacaacaaugaaguagcuuacguccuuugaaaaaauaagagccagaccaauuuugugaaaauaaaugauuugagaagaaauacaaacugucaguacaaauaacacagcuauuauuuuucuagcagcaacucauguuagcuccuccucuaugugcuucaaaaucugucuugcauaaaauucuuuuuguagacguguggguggagaugggaugggguagaaaggguuacuuccaguaauguuaguuuaaaccagacaucuuguauagcauuaauagacaggcauauaagaaugcaguggucuaaauccacccaaugcauugaaaagacaucaacaauucuccaaugguagaaguuuaaaucaacuguuucuuaaauguuaguaucuuugaacuacccauggauuagggaagagggaucuggcacaauuucucaugcaguaaaauauuggaaacaagcaauaaguauuuauaaguaaaaaugcaggugcuauguugggauaguuaugaauagagaaugcucccauuuggaauaacgauaaacauuggcuaaaaugaauuuucucaacuauacugacccucagauaaacagauaacacugaaccauuugcaugacaauuugcuuaaauuauaaaauacaauauucugaagacaaucauuuaaguguagaaagaacuuccuugaacaauuugugcauacaguauuucuaagauagauguuaagccuucuagcuauuaucuccuaauguguauacaauguguuugacaguuauuuugauauguuugggaugcauugaugccuucaagcuaagcaugcacuauccaauuuggaggccuuaaauaagcucucaguauuuuugagaacuaauuaaaacuucauuauuaguacaacagccguaccacauuauuggcuugauaagaaacucaauaacugacaaugucuuuguaggucuuucagcugacacuuacaauuaaguugcauggaacccaaccacccucuagaaauucuccuuacaagacaacaaaauaguaagcauaaagugcagcauugguuuacguuaaaguacaggcaaagccuggguuuugucacagauuuuguuuccaacuuucuuuuucaaccagaaaaaaauaauucuauuugaaauacauaguuuuauuaaguuuguuuuuugggggguggucuauauauacuuuuuucuugugauaucuguuuucauacagguggaugacguaccuucccaugaagaauucaauuuaccaaaaaaaaaaaaaaaaaaaaaaaauucaauaauuuaacuggcccaaaagggaaagagauaaguaccaauguaauuaacucuuuuucuuucuauugauaaaaccauaauaguuaccuuuuaauauaagcuagcauucucccaucagccaacauugcuugcaggcaauuuucaugcagacauccuguuguguauuaugagaaugucaaugaacuuuaauauuauguagaagaaaacauaauuaggaaggaaaucuuuggagaauagcaauaugugauguaucaaguuguaaaacaaaagaguuauaguucuguguuuuuugaauuuguuaugcucauaaaacauguuaggagacaaauauucugagauuugcauaguuucucaauguaaagacauuacuguuaaugauuaaggauaguuuuuuugaaauaauaaaucauaugauuuauaaccaaaaauacauccaugucacuaucucauugaaaauauauuuuauugcaaauauuauaagaagauggaugucaaaguuuacaauaauuguuaaauauaguaauuuuuguuauuuguaauuuacucuuucuagccuaucauugaugacugagcucauguagcuauaucauuuuuuaauuuauuuauuuaauuuauuuauuuauuuuuuuuuagacggagccuugcucagucacccaggcuggaguacaguggcacaaucuaggcucacugcaaccgccaucucccggguuugagcaauucuccuaucucagccuccugagucgcugggauuacaggcaccugccauuaggaucgccuuauuuuuguauuuuaguagagaugggguuucaucauuuuagccaggcuggucuugaacuccugaccucaggugaccugcccgccucggccucccaaagugcuaggauuacaggcgugagccaccacacccugcucuuauuucuuaagagacaggaaaaaacaaaauugguaagaauuaaaugccccuagaugugccuguuuaauauuucugauauuuucaagcauaaguugccuaauucgucacauauacauaaaaucacuccugaaaugcuuugcugguagaugugucccauugggaaauguuauaauccauuucaauacauuucacacacagaucucuaaaauaaaugaguccaucuauuuguaaguuuuuagcaaaguaauguauaaacagacaauguguaaaaauuauguuuagucuuuuuuccuuccacugaauaaacaauauagcuauuuuuggcauucauuuuuccuaaacauuugagcaccuacuauaagcuuaaaagcucauguuucauuuaaauuguuuagaaaguuauaauucucaggagcauuaauauaguaaaagaagaauauuuaauugcuuauuuuuaauaaaaauuuuuauuaugcuuguuauuaaucaugacucuauugacacaaccucaaaaauacugguucuuuuucaaacucuuagagaaaacaacuuuaaaguuaugauuguagaacauuuaacauaguaucuuuaaguuaguuugaaugagaaaugagcagccucugauuuccacacagcaauuuacaaaacauauauuugauuauaaguaaacucauauuuguuuaaaacuuugaauauauagaaguauucacauugaaaguuaguaucuugucuaaauucauuuucauaauguuugcuacuagcuagacuaauggaaagagagaacaaccaaauaaauaugaugagaaaugacaaagggaauguuacuacugaucucacagaaauaaaaacaaccaucagaaacuacugggaucacuuccgugaacacaaacuagaaaaccuagaagagauggauacauugcugaacacauacagccucccaagacugagccaggaauaaugauuccccaaacagaccaauaaugagcuccaaaauugaaucaguaauaaauagccugccaaccaaaaaaaaaaagcccaggaccugguagauucacagccgaauuccaccagguguacaaagaagagccgguaccauuccacagaaacuauuccaaaauauugaggagggagaacuccuccccaacucauucuaugaggccagcaucuugauaccaaaaccuggcagaaacacacacaaaaaagaaaacuucaggccaauaucauugaugaacuaugaugcaaaaauccucagcaaaaauacuugcaaauuugugauaaacuuaacaugaagugucaacuugaucauugaaggaugcgaaguauuguuucuggguguuucugaguguuaccagaagagauuaauauucgagucaguggacugggagaggaagacguacccacauugugggugggaaccauccaauuggcugacagugcaacuagaaaaagcaggcagaagacgguggaagaagcugacuugcugagucuucuggccuucaucuuucucccaugacggaugcuuccuacccuugaacaucagaccccaaguucuuugguuuugggacucuuggacuuauaccagugguuugcaaggggcucuuggaccuuuggccacagacugaagacugcacuguuggcuucccuacuucugaguuuuugggacuuggacugagccacuacuggcuuccuugcuccucuacuugcagauggccuaucaugggacuucaccuugugaucaugugagucaauuauccuuaauaaacucccuuucaaauauacauacauccuauucaguucugucccucuagagaauccugacuaauacaaaacugagaccagcagcacaucaaaaagcgaaucuaccaugaucaaguagguuucaugcccgggaugcaagguuauuucaacauagauaagucaauacaugugauucaucacauaaacaaaauuaaagacaaaaaacaaaacacaugauuaucuaaauuauugcauaaaaggcuuucaauaaaauuuaacaccacuucauguuaaaaacucucaauaaacuagguauugaaggaacauaccucaaaauaauaagagcuaucuaugacaaaaccacagccaacauuauacugaaugggcaaaagcuggaagcauuccccuugaaaacugacacaagacaaggaugcccucucucaauauuuguauuccacauaggauuggaaguccuagccagagcaaucaggcaagagaaagaaauaaagcacauccaaauaggaagacaagaagucaaacuaucucuguuugcaggugacaugauucuauaucuagaaaagcacauagucucagaccaaaagcacuuccagcagauaaacaacuucagcaaaguuguaagauacauaaucaaugcacaaaaauuauuagcauuucuggguaccaacaacagcuaagcagacaggcaaaucagaagggcaaucccacucacaauugccacaaaaagaagaaaauacugaggaauacagcuaaccaggauggugaaagaucucuacaaugagaauuacaaaacacugcucaaggaaaucagagaagacacaaacaaauuaaaaaaccucccaugcucauggauaggaagaaucaauaucauuaauauggcuauacagcccaaagcaauuuacaaauucaaugcuaugcugucaaauuaccaagauuauuauucacagaaccagaaaaaaguauuuuaaaauucauacggaaccaaaaugagcccgcauagccaaggcaauccuaaacaaaaagaauaaggcuggaggccucacguugcccaacuuuaaacuauacuacaaggcuaaaggaaugaaaacagcaugguaaugguacacaaacaggcacauagaccaauggaacagaauagagauaucagaaguaagcccacacaucuacgaccaucugaucuuucacaaagaugacaaaacaagcaaugaggaaggcucccucuucaauaaauggugcugggauaacuggcuagccauauggaaaagauugaagcuggaccccuuccuuacaccauacacaaaaaucaacucaagauggauuaaagacuuaaauguaaaauccaaaacuauaaacaccuaaacaacaaccuaggcaaugccaucuuggauauaggaaugggcauauauuucacaacaaagacacuaaaagcaauugcaagaaaagaaaaaauugacaagugggaucuaauuaaacuuaagagcguuucugcagcaaaagaaacuaucaacagaguaaacagacaaccuacagaaugggagaaaauauuugcaaacuaugcaucugaugaaggucuaauacccaguaucuauaagaaacuuaaaauuuaugagagaaaaacaaacgacuccauuaaaaagugggcaaaggacaugaacagacacuccucaaaugaagacauucaugcagccaacgagcauaugaaaaaaaaaagucacuaucacugaucauuagagaacugcaaaucaaaaccacaaugagauaccaccucacgccagucagaauggcuacaaugaaaaaguaaauaaaauaacagaugcugaugagguugugaagaaaaggaaacacuuauacacuguugguggguguaaacuaguucaaccauuguggaaagcagcaugaugauuccucaaagagcuaaaaaacagaacugccauucgacccagcaaucccauuaccagguauauacccagagguauauaaaucauucuaccauaaagacacaugcacgugauguucauuguagcacuauucaugauagcaaagauaugaaaucaaccuaaauucccaucaaugacaaauuggauaaagaaaaugugcuaaauauacaccaugaaauauaaugcagccauugaaaaagaacaagaucaugucuuuugcaggaacauggacuagguggaggucaucauccuuagcaaacuaacacaagaacagaaaaccaaauaccacauguuccuacuuagaaaugggagccuaaugauaagaacuuaugaacacaaggaaggaaacaacagacacuggguucuucucgaggacagaaguuuggaagagggagaagaauagaaaagauaacuauugggcacuggguuuaauaccugggugaugaaaucaaauauuuacagcaaaccccugugacacguguuuaccuauguaacaagccuccacauguacccaccaaaccuaaaguaaaagauuaaaaaagagauuuccauauauccuucuagguuguuauaugcaucuacauauaaaaauaaucuauguuuauaaaaugauauguaauauauaugauauuacaauguuuuagaagaaagacccuaucgaaguuauguuucuaccgugguauauuauacaucuaucuuguuuacuuuuaucagguacauuguuuuccaucaugugaguauacuguaauugauugcagaaauauuguacugauagacaaauguuuccaacucugcucuauuacaaauaauguucccugaauauucaagacauauuuaagaaaguacauggauuucuuccaauuaaauugucaaaaguuaaauuugacauagugaaacauggugaaaaaaaggauuucagcucccacuugccgugccagccaaauguguuaugcagguacaaucauaugugaagucauggacauaccuuuccaucacaaauuagaaauaaagcacaacuuuuuauuuuuaaccaugagaaaacagugggaauguuaauauuauugcuaauuguuuucuuauuuggcacaucauauuuagugucagugguuaaauaaauuauuaauaugcaggagcuaaagacuguuuacccuuucucaaauaucaaaucuucuaaacuuuaccauguacugaaauguaaaaaauaauguaaauaaaaauuauuuuggaaaacaaugagauaaauauuuuauuauaaaggcuuauauggaauuaccuaauauuaaagguuuggaauuuucauuuccuauugauaauauuucuuuuaucuuggacuuuccgugcauguguauauguacuuuagauacaucaaccugaagccuggaucccaauguuucaaaaaguaaaacaggcagaugagaaacugucggggggaacauuggaaugauacagcaaauagcacugaauucaguagguaaaacauuuuguuauuauguuuggauggcaccucugaauaauaacagaaauggguggaucuucugagaauaauauaugugauaagaaauagaagaagaauguauucauuuagaucuucugagaagcagacgcaaagacaauaguaugacuaguacaaggauuccuuuucaaggaaaacgggucauuguguuucuguauacaaggcuuuuacuguauuuguguauugugaaugaauuuucccagcaugugguuugauuuucauuuucuuagugugucauuugaagaauagaagauuuugauuucucuguguuaugcuuuuaucauuuuuauggcuaauacuuuuuuguccuaauaaauggcugauuaucccaaggcugaauauuuucuccuuuauauucuucuagagguuuaaaacuaguggugccuacauuuagguacaugauccauuuuuguguagaaugugaagcagcaguguucauuuucuccauauggauaucauuuucuaacaccauuuguugaaaagacuauucucuucugcauuuaaucauauugguggcuuuauuaaaauuuaauucuccauauauaugugagucuauuuguggacucaauuuuggacucuucaucuauauauuuauauuuacagcuauacaagacuaucuuuauuauaaguuuauaguaauuuuugaaauucuuguauuuccuccaauuuuuuucaaacccaguuuggauuauuuuaggccuuuugcaguacaaguaaacuuugaaucaccuuguaaauuuaaaaaccuacucaauuugaagauagugaacaaguuaacauauuuuacaauuaauaagccuuauguaucucuccauuguguuagcuauuauuuaguuucuuacagaguauuuuuaauuacaguaaagaaugucaguauaauuuuuauuauaauuaacuguuaguauuucaagucuuugguccuauuuuaaaugguauuccuuuuacaaauuacauuuuccgaauauuugaugcuagcauauagaauuuuuuguauuaaucuuauaaccuguugccuuguuaaauuuauacuuuuuuuuuuuuuuuuuuuuuuagauagacucugucacucagacuggaguguggugguaagaucauaccucacugcaaccuugaacuccugggagcaaaugagcuuccuaccucagccucuugagcugggaccacuugagcugggaccacaggagccugccacccugcagguucuguuuuguuuuguuuugcuuuguuugguagaggaaaggucuuauuauguugccaaggcuggucucaagugaucuucccacuucagccucccaaagcacugagauuacaggcuugagccaccgcgcccagccugacuacuuucaguaguuuuguuuuuaagauugauuaggauuuccuaaauaaauuauuaugucaucuaugaacacagacaggccuacuucuucuauuccaaucuuuaugcuucuguuuauucuuuucuuacugcauuggcuagaaucuccaauguaauauuaaauaaaauguaaaaacauaucuuuuucucauucaaaaaucaauaauauucuauuguuuaacauuaagugcugcauccaucagcugugaguuuuuauaguugaccauuaugaauuugagguaguugccuuccaguccauuuuuguuaagaacacuuugucauuuuaugaaugucagauuuagucaaaugauuuuuuuauaucuguugccauaaucaugaugauuugcauuacugauuuuuuaaaauauugaaccaaacuuacuuuccugggauaaauaccacuuauucauaagguauugucuuuauauaaaaauuauuggauuuacuuuucuaauuaauuuuugugucuauauucauuauaaauauagaucucuaauuuuauucuuuuguaauuuuuaugucuugguaaauaugcuaaugcucuacauuauuaaagagaagaauaaaacacugaaugauauuauacauauagaaagguacauauuuuaaaaugucaaauaauggccaccaaaaaagguuacuuagagcauuuuaauucuaaaaauaaaacugaagaagaaaacaacuauaccuuuaacaacaaccucuaucaauagcaaagagggcagaaaaggaggaagaaaaaauauugaaaagcacuugauaaauacagcuaagcauuuagacauuuugcuuaagguggauuuacuccuuauauuuguguuuucauuauauaauagcaacuaacacuuuuuguccauaauuccauuucaaggacaugcuagcaaguauuuuaucuucaaucuuuagaaaucuuaaauagccuagcuucuauuugggaacuaguaugagcucagaaaagcuucuuugauucuuucaagguuaaauacuugguugguaaaugucuaguaauggaaggggaagcaaauagcauaguacuaauuaggauuacaaguauuauauauuuucauucaagucuucuaauucuucucuuaauuacccaaucagugacuuuuauugaaucacauucuguauuuaauuaguuauuuugaaucaaggcuauucucauuuuacaaguuaacuguggaaauaccauguggacauuugacuaauguuauaauuaaagcauagagucauaugaaagacauaccucuuaucuuggauaauuaucagcuauugauaacucuucaucucaauugaauaaaguucuugguagcaugauuauguugaagcagauaaggcuuauaaacaaacaauuaguuaauacuauaauaaagcuccuuuuuaaaacuauuuucuuaugcuauuuacuucuuugagaaaacauuaaacuuuucaguacagucauaaaugccuacuauugggagauacauuuaaagacuuaaauaugaaaaauuuuuugucacuucuuuaaauacagguucacucuucauucuauacuuugacauaauuacugaucuaaaggaguuuuuaaguuaucaaaucauuauuuuucaaaacccacauuagacaggucccaaauuaauaagaucacucauuauuucuguaucugaggucacuguaagaacauauaaauccaauacaauugccauuaaguggaaaucuauaugcaugaagguugacucaagcacaaaagugacuauaacacugguuuauuacugaaucuguucaaaacacuuuuaauaacugggggaaccagaaugaccacauuacacccuggaguggcugcuauaacacuguaccauaaagaaccauacagacagggcgauguuuaugugucuggcugcacacaagugcaaaaauaugagugcauauguauguuucacagaauuuugaauuccuagccaaguuuaguuuaagaaaacucagauaaaaaaugaaaacagcaucugauuaaaagcaucugcucuaaccuuugagaguugucugugauaucuuugauagacagccaaguaacauuaugccuuucccccaggguacacauucaaauaguaugcauaaagauuaguucucauucagaaggaggcugaauauuuugcauugagugucauuagcguuuuuuuuguuuguuuuuuguuuuuuugugcccagaugucauaggauggacauuugagucucuuucuuuuucuuuuuuuaacaaggaaguguaagaagugauuuaucacuauuuauucaggaaauagcauguuaugauccaaaaguugccaaaacuacacuuuuuucguuuuuguugucauuaagaaagguccaaaugcuacagcucuuuuuauguuacaaaauugaacguauuuggaaugcaacaugagauuuaaguaaagaauuaauucaauauaucaaacgcuaaguacuuuaacccucaaaauacagaauuaauuaagauagaauaaaugauucuaaucagaaugaauaacgaacuggcagguggaaaaaguccugcauucuaaagucuuaacauugccaucgaccgcgccugcaucuaucauuuucccuucauuuuccccaauccacuaacugguaaaaugggcauguuagccuuuauacaagaggaugaaccacaggauuaauaauuaaaagguuggcaagugcuuuuuaauuacagugguuauacaauugccaaugaauaauaaucccuccauuccaaauccaaugcccagagguuaauugaguugccaaggucucaagcauuaucaguauacaucucuguucagauugcuaaauacgauaucuuuuaaauauuuauaaggcgccauggcuccaaaauccagcaaauuacauauaauuauuuuuucuuuagccauucauguagucagaugaagcgauguaacacaacccugacaaggcugaugaagaaaaucaggccuguaggauacugagaagcaguuuauguuuguagaccuaucucacugaaugcugauuuuuuauaaugauaguuuuuaaauuaggaggggaauuuuaugguuacccccugcuaagagauggauucacaaucuccaagugucagcaauguacacuuggauugugaauuggauucacaaucucuaagugucagauuaauagaaauuaugaugcauuaguauaauacuuuauucuucacuaaaaguuuucuaucgauuuuauuaaauaagacaacuguacaaaauuguugagcaccuaaacaucaguucauuguaauuguaaauuuuuaaaaauuuuaaaauguguucaagaaaaugaaaggguaaggaaaaacacucaugccuauagucccagcacuuugggaggccgaggcagguggaucuccugaggucaggaauucaagaccagccuggacaacauggugaaacucugucucuacuaaaaauacaaaaauuagcugggcaugagccuguaaucucagccacucaggaggcugaggcaggagaaucgcuugaacccgggaggcggagguugcagugaaacgagaucacaccacugcacuccagccugggaaauaggaugaggcuuggucucaaaaaacaaaaaaccaaacaaacaaagaaaaaagaaaauaaauuaaaacggaaauccauauaaugugaaaagaagcaaacaacaagaaaaaaauucuagccuauaauuuuaccauuuguguucuaucagugauaaauaugagagcuggcauccaguaggaagaagggguacaaaagcagacaaacaaauagacaucaugguuauuaauuaucuuaauccaaaggagguuauuauuauucuagggcucauucuauccuuaagacccugguauacauauuuuaacagcuuggacccauaaaaccagaaugucaauaaugcguuuuuuuuuucuguuccaagaaauuuuuuuucaaucauuugauaaauacuuuaaaugaauguagaugcuuucuuuagguuaagacaauacauuuuaaacuaacauuaauuuuuaaaauaauuuuuccacaauagacuauccucuuuucagucuucauagggaugaguagaucaauaugauccauuuuucuuucagauaaauaugucccuaucuaguuuguguacuuauugaacugcaggggcuguucuagaacuuucauaaaaccaaaugguauuuggcacacugccugccacauagcaggaucucugucaauggaaaugccuuuguccucucagcuccaggccacacacccugccacccucagagacuuugcauucacuguuccucuuaccuacagacauguuccacuuuugccuggccuauaaaagauaaaaaagaaagcaaccucccuggugugcaagcuucuugucuaccacugccuuaguucucucccucugucucaccacccucaaccacuuuuuaaaaacauacugcauaaucacaccuuuauauucuaucuagcucuaaucuccaugagggucaugaugguggagucuauauauauccauuacucauuguaacaucugaacaauaaaaauaaacuugauaaauauuuguuaaauaaaagucuuaccacauuuuuguauuuaugucauucuguuuuuaccacucuauuuaaaaucuuguuucacauuuugagcugaacccaccucuaaagguaaucucaagucucuuguucuuaaagcaauugauccucuuccucccccacucuagguuuccucuuacugcugaccacauugguuuucuuuaaauuuuucucuuucauauuuuccuagcccggcagcugaauuuagacauuuccuuuuacucuaucuuugguucucuuuccuucuauuuacucacugagauaccacgugcaauauuuuucucuucuucaaucacuuaugauuugugguuccuguauuuuuguuuucaauugaguuggguuggagguggaauuaagcuuagagucaggguaggucucagacucagaguuaggauuauauauauuuuuuuuuuuugagacggaauuucacuccucuuucccaggcuggagugcaacggugugcgaucuuggcccacugcaacuucugccuccugcguucaagcgauucuccaggcucagccucccaaguagcugggauuacaggcaugcaccaccacagccuggcuaauuuuguauuuuuaggagagacaggguuucuccagguugaucaggcuggucuugaacucccggccucaggugauccaaccgccuuggccucccaaagugcugggacuacaggugugagccacugcacccaacaaggauuauaauuugacuuuaauagcuggaauuuuaaaaaauaugcagcuccuucaauaacuauaggggcuaaugcauaauacuguuacugguguucugucaacagacacauuuaagugccauuaaucaguuuagugaugcucuuuaaaauaaaaguugacucugcucuucuuuuaagauuugacuuguucucuguugaggaaauugaaacacauuuucuaaucucugcugaaguaacccugaaauucuaauguuauugccuauauugccucaaaauuuuaccuuuauucucaaucucaauugcuuuauuaagauuucauuuauaggaccugagucaacauauagugucagcacuugggccuuucuuaugaaaguuugggaauuuccugaugugucauguaaaacccuuacauuaucauuucuccaaugccagauucucccugguauucugaauguauuaaggaugaaagaaaggcauuuaugcugacauguacaacauuacuucaaauaaaugauguaggacaaauuauaucuaaaggagaagaauauuaaauaauaagcuuacauuauaauaaaaaugcaaaaaaaugaaaugugauuuauaaauaugacuaccuuucagcaacugauauuacauaugggguagcuaaauuuuauaguucauuaauugauuaauuuuuugagacaggaucucacucuguugccccaggcuggagugcaauggugugaucauggcugacugcagccucgaccuccuggacucaggugauccucccaucucagccucaugaggagcuggaacuacaggcauaugccaccaugucuggcuaauuuuugcauuauuuguagaaacacgguuuugccauguugccuagacuggucucaaacuccugggcucaagugauccucucgccuuggccucccaaaguacugggauuacaggcaugagccacgaagccuggugcaaacuuuuuaaaacaguuuaccuuaggaugaaugcaagaaugucaguguuggcagggaaacuagacaacauuuagugcaagcccauuccacuagauaaaaaucucuuucucauuuaggcagguucuuuuugauaucuucacagaacaaaugagugcagagaaucuguauaucauauuugccugacaacucucuccaaggaacacuaaguacuccucuggcaagagaaaaccuucauguccuccucagacuugaguugccaccguagaucuuagcagauuuuuccagaacaagaucuaauugugauuuauuuccuucugucaaggcccuuagcaccuuuuccuacauauguuuugaaauauccaauuguccuaagcuaaugucacgucuucuuucuuuccacuuucaaacuuauucugauaagugugacuuguuggugcuuuugaguucuccaugccugaaagcauauucacaguuuuauugacuuucaggaaauucuuaucacccccuucaccuuacaaauccugugaaacaaauaugauuccacaguuuaguguucuauguguacaucuuugguaguaucuuugaacauaugauauagaaccaaacacaaaacagcagcugacuacucaucacuuacaucaggaauaguccuagauaacacugucuauugauagauuggugugucuuuuuucuuauauuccacgugcuccugucaauucagacacccacacgggauggaggcucucucgucccucauugccccucccauuguuucucagucguucucuuggucuaacuucuuuuuccucugccuuaucaagucaaaucucuauuuucuggagaacaccacuuauuagcuaguuaauggaaagauccaauuaaauauacuaauacagauuucaauuagugguuuaagauuaguauguuuauuuauauacucacauaaggcaaucugguuuugaaagaauacccuguuaaaacaaacaaacgaauacaagcugugguaauguguuucuaaugcuggauuuucagggaaauauuaaaucuguuuaacuuuucuuuugaaauaauuucaaaauuauggaaaagcugcaauaauaguauaaggaacacuuguccuuuuacucuuuauucuuauucuucuauuuuacucugugcuaugugguuuaucauucucucucucucucucucucccucuccuucucucuccuuuuuccaccaccccaacacacacauuauuuuuucugaaccaugugagaauaaguugcauaucauguucacuuacuuccaaauaguguacauuucauacaaauaaggacauauguagguaaguauauaguuaucaauuucaggaaauuuaacauugcuacaucgaauaaaccuuccauaucccaauauuauccauugacccaauuaugucuuuagggcaucuuuucuuauccaagacaggauccaggcuaggaucacguauuacagguagguaucaugucccuuuaauuuucuuuuaccuagaauaacuccuuagccuuuuagugucucuuaucacacugauacauagacaauguauucuccuuuaucuuuuuaguagaacauuccucauagaauauucuucaauuuugguuugacuuuuguuuucucauaauguuuacauccacuuacauucuucaugggacacuacaugcacgguguuggguccuucucaguccacugccucuggaggcgcacagugucugcuucucaucuguaauuuuuauuuugauuacccacucaagauguuuaauuucucuuguguaaauauuauucauuucccuugcaacuaauaagugauuuguaagagacacuuuaagacuauacaaauuuacuucuccccaucaaaacucuccguauccucuacuuuuauuaccauuaaugucuuaugccagaacuaguauuuacuaugaugguugcaaaugaugacuugaguucccaccuccagcacccuuccacguuuccuagucagaaguucguauucuacuauaagcaagaggccucucuucugccucauuuuaucuaucuauugccugccuauguauguauguauguauguauguauguauguauguauguauguaucuaucuaucuaucuaucuaucuaucuaucuaucuauaucuaucaucuaucuaucugucugucuaccuaccuaccuaucaucucuauagacuuaagcauuucuauuuuucucuaaaggugugcaaugcauuacuguccuuaacuauuuugguguucaaauuguccagguuugaccaauaugaauuauuucaaguuggcucuuauguaauuuuguauuaaccaucauuuuuccuuucuuucugguauaacaagguguguuuaauuuaacaaguuucuuucucgaccacaaccugguaaaauuuuucuaacuagaucugauuucuuuuagaugauaauuguauuaauaauuaaagucuaucuuaggugugcuuaguguuacugcaauauuuuuguuucuagauccauccagcugucagagcuacuuagcauguaguauguaaguguguauauauauauauauauauauauauauauauauauauauauauauacucauuaacacacacauauauuuuuaaguaggcuucauucuugucuucucucauuccacguauguuucuuauuuccuucauggugagaaccuuggcccccaacacaauugacauaucacucauuugcucaauuuacaguacauuuaaauauguucagaaaugcuucaaccauauauacguuuccucauuucuucuuucuuaaacaaaaguuaacauacaauaaacgcucuuuguacuuuucuuuuuuucacuaaacaauauauccagcaaauccaccccaugucaacuuauauuuuaucgguuuucuucacagcugcuguguaucuauuucaaauauguagccuaguuuauucaaccaaucuauauuugaucauaaagauaguuuccaauauuuuguaauuacaaauacaauggcaagaaauaacuuugugcguaugacuuuuuauguuauuggagcuguauaauuagacuaaauuccuaguauugagauaguuggguugaagaauaaaugcauuuuuaguucugcuggguauugccaaucccccucuauagcuauuguucuauuggacaugcucaucaggaguauaugagaaugcuguuuccccagauucuucccaaaagaguguauaaacaaccuuuucggucuuugccaaccugauuggugagauauaguauccccauagaggauuaauuuguauuucucuuuucauuuuacauuuguaugcauguaaacacaauuuuauauauuuuguuugaguuuccuuuucauguuuuugccuguuucuauauuuucucaauuuuaauugguagauauuauagacauggaaauuuucucuguuagcaucaauuauacauagauggcaauuauaauacaaaaauaagauuaauaaauuuaggcauucauccugcaaauagaacaacaacaacaaaaauaauacuaacaaacacaaaaucaaaagcaaguaggaguagccacagcuugguuuaccugucauucccugugcaugccaacugcacacaaugaugccuguuucauauacauucauuucuuuucaaaccagaggcaaugacauccaaacauauuucuuuagaaauacccucuucaucagcaaauaauacuaugugcuauacuaaguaucuauguacuaagugugaguagaucccguguacuuauaucaugcugaauuuacauaaagaguaacauaaugucccuauauguugcaaguaggcucuuaaagacccuuugcuaagcucucugguuaccauuucaccuggcccacugguuuucucccacaauuaucuuugguacuagagagcuauuccaauaacaguuccugguuucuuucauuccucuuccaucagagguguaccuugauuccaagucugauuaauuuguuuuuacaacuugucacugaauuuuaauacacauaggaaaaaagcacacauaaacauacagcuugaugcauuugcacaaguguaagaagcacuuaagucaagaaacaaagaauuaucaacacuucuaaaauuucuuuguauccucuucuagccaugacccuucaacagaggaaaccaccaucuagauuacuaaccacauggacccugguccagcuuggauuggagauugccacacauccaugccuuuggcaccaguuccuugccauuacacucagcagcaucaagcugccuccaggucugaagggaggauaagcuuugcugcuacagucaguauucccagccuccuucucaucucccuguugcugcaaacucuguuguuuucucuccuauagaaauccuaggcuuuucauguguucccacacaugccauuuuggacaguuugacuucuaauagauguagguacaugcaguauuucucaauauuauuaaguauaaauuaagauaauaaacauuauuguuuauaaauuguaaaccuaauuauagcugcauauuccaauguucacuaaauuccacaauuugguggaucuguuaacaaguacuuacuaaauacauucaauagucaaggcacuuuccuagcugaugagacccagcauuuaacaggacaaaauaaaccccucagacaacucaccuauaaucaaaaacuaugauaucuucuuaaauaugguauaauagagaaagcaaagacuagugggacauaaagccaaggaaaaagccuggucucuuaccucucaggaucuuguuacaguaauugacacaaaaagugcuuaccagguaaguacucagugcauggugauuacuauuggcaaugauauuugauuuuaguaaaaaugccaaacaucucugcacuucaauugaauaagcuaagaaauagguuaaauuccauuaaauauccauagguuugauauuauuuggggggagauuaauaguuaguguguaguaagaguugagagaguguguguguacaugugccugugucuuauuucacaaucaguuaucccaaauccuaacauaaaauauaccugaauaaucauauuuugguuuugauuuuaaaauuugaaaccaacaucauuggcauuccugcuuacauuaaguaaagcuaaagugcaauacuucuauuaauauuucaagaaaaugcugucauauuaaagauauguaaucauaccuuuuuauuuaacauaucaugugaaaaacucauuggauauuccugcuaugucauaaucacaaaaucuuuccaaagggacuggacguuucuuuuguauuggucugguuucuuuuaucaaauacuuguuuguuccaggcugaauguaaagagccugaaugacuuuaugauaaauucacagucuuuuucucuugcucuaggcugucauacacagcucuguuuuccaauuuguauacuguaacaaagcugaaaaauacacaaacgagacagucacugugcguauagaaugaacaauugugcuugcuaagugcauaagauaaacaacgacuucacccugggcaacucaguuuucauaucugaaguggagggaauguguuucuuaaccuucucugaagaauacugggagaacuaaugaaaccugccauuuucaagcagauacuaguauaauccaaaugaaauuagcaauucaaccucaacuuuuaauuggggaaagcuguuuuggcucugggcgagcucuuuucuuugcugauagaaaaauuauccaucauuguuuagaaugcauguuugcuggaauccaguuuuuaauaaauaauuacuauaucucaaagaauuacaugauguugauaguguuaaauggugccuagugcagaauaaacuacuguauggaguuugaaaguaggacaugauuuuuaaggccaaacauuucuuuggggacggggugggagauugauucuuaaagugucuuugguucauuugcuaucuaggauagaauaauucugaaaauguuuccuuggaguuuugaauguaaauaaaugauugcagagagucauauauaaguagucguuugauucaagcauauuuucugaguuaaugaagguugaugcacaacucuuccuagaagauauugucuuucuuacaagaucauccuuauucuuacuuaccagacacaccccuaucaacacccuagcaauagcaaauaacuuuuaaugucauaacuuuauaaaguacuugccuacuaguuguuaugaauuuaauuuuguccccccaaaauucauauguucauguuccaacccccaaugucucagaauguuaccauauuuggaaacagggucuuuacauguauaguuaauaugaggucauaccagaguaaaguggauucuaaacaaauaaauuuuuuguaaaaugaaugccauauaaaaugaaaaacaaggccagccacagugacucaugccuacaauccuaacacuuugggaggccgaggugggaggacugcuugagcucaggaguucaagacccaccuggacaacaaagugagacccaucacuacaaaaaauaaauaaauuaaaauuaucugggcauggugacaugcaccuguagucccagcuacucagaaggcugagacagaggauccauggguucaggaguuggaccuugcaguaagcuaugaucacaucacugcacucuagccugggugacagagcaauaccaucaaaacacacacacacacacacacacacacacacacacacacacacacacacacagaagaaagaugauauaaagcaacacagggagaagauaaccaccugcgagccaaggagagaguccuggagcaggcuguucccucaccucccucagaggaggagucaacccugccaaccccucaauauuggacuucuggccuccagaacugugagagaguaaauuucuguuguuugagccacccaguuuaugguacuuuaugauggcagcccuagcaaacuaauacaguagguaaauaguacuuucuuuaaaaauugaaaacagcaacaccaacaauagcauuaaagaccaagaucuucuaacuuuuaagcucugugaccuuagguaagauccugaaccucaauuuuuguauugaaaauuagaaaaaagcccaggugccguggcucaugccuguaauuccagcacucugggaggccgaggcuagugaaucaccagaggucaggaguucgagaccagccuagccaauauggcaaaacccgaccucuauuaaacauacaaaaauuagccgggugugguggcaggugccuguaauccaagcuacucaggaggcugaagcaggagaaucgcuugaacuugggaggcggagguugcagugagcagagauugggaaacugcacuccagccugggugacagagcgagacucuguuucaaaaaaauaaaaauaaaaaauaaauaaaauaccaacaucuuauauacaagcgcuauauuacaguuuaaaugcagagaucacuaaguuucacauugccugugaaaggaauggcugaccagggccauaguggcaaggaacacaggcugguuaguuagguagcuuugguuuccuauccuagcuccacuguuugauuaguuuaguuuaguuuuuuuuauuuuuauuuguauuuuauuuugcggguauguuccuuaaaacaggaaaugugauauuuauucaaccauuacaauuuuuuuuugcuuucauacagagauauauugugaaaugauuaccauaauaaguuaguuaacacauccauuacccagucccaccguguaccccagggaaaguuguacuuucucuaauccucaauuucugcagccaaaaauagggcuuaaucauaaaaauaauaaucuauauccucacauauuaguuguuuuuaagauuaaaugauauaaagcacauuaaacacuuaaggaacccccaauaaguguugguuggcuguuauuauuuauuaauuugugcagcugaaguuuucugaauuucucugcuaaaucacaggaguuuucacagacaucuuccaagcugcauauuaauaucauuauaaagcauuuaaauugcaauuacaauaggcccauucacugucucaucaaaauauauuggugaaguucaucggagaaaugcagauacuuaucucaaacauuauuuucauuuggaaauggacagaauuuuuucuagaagccaaagucuauucucuacucuugcucuagacuucugaaaaggcauagauggugaaugaaccuuucagacagccugucagcacuauaucuuuuugccagaaugaucauuucacugcagccuauaauuaagcuauuuaacucaagcaaaccaaauuuauuugccaagacauuuuaacauucuaguaguucucucccaaagucaacacugacuaaauuagcuaccuggaaaacaguaugcauaagugaaacacauagaauggguaucuucacgguguccaggggcauaagcauccugaaagcugugcaagaugacccgggcuuuuguuuaaaguuauuguagugauuuuugcuguccuuccaauuaaaauauauuauucucaaggcuagaccuacuauuaacuacuuacuugcauucuuuauaucacuuugaauauaguauuugagaaacauuaaugauagcauucguaauaauacugauaaauaggagaaagugaaacaagaggacgauaagaagagacuauauuuauggggcauuguucuaaacaauuuauuuuugauuaauuuauuucucacaaaaaucgcauaagguaaauacaauuauaucgcuuuuacaccuaaggcaacuaagacccauaguagguugauuaacauaguuaaauacacaccacgagaaaguguuggagcagaguucagauauuugagguccgguccagagcccaugcuaucuuguucuauaaauaucguguauguauucaauaguauuuucaauuacucaaaaugagcagggguucauuauaguaauggaacuucuugcugaaccaaaauaaguauuuggcuccauauucaguagugaggucaguauaccuggauucaagguuccaguuuaagggacaucaugguucucagccucagcuuauucaucuacagaaugagauacuucaguucaguuguaaacucauaaacaucuguuuugugcucugcagugagcucuauaugaugaauggcacagagauaaaaaugugcccuaggcgacugcauaaacuccaagguucuuccaaaauuagauauuuacauuauauaaauuaagcauuacugauucacaggauauaauuucagaguuuuuuuuauuuuaaaaagucagcuuuuugcugggugcaguggcucaccccuauaaucccagcacuuugggaggccuagguggguguaucacuugaggccaggaguucaaggccagccuggccaacauggcgaaaccccgucucuacgucucuacuaaaaauacaaucauuagcaugggaugguggugcaugccuguuaucccagcuacucgagaggcugaagcaggagaaucccuugaacuugggaggcagagguugcaaugagcugaaaucgcucuacugcacucaagccugggcaacagagcgagauucugucucuaaauaaauagauaaaggucagcuuuuuauuuuguugcaugucagaaagucaggaaaaacgcaguuauuuauagaaucccacucuccauuccuaccuauuucagcagaagauucaucugcuuggaaugacuuccugccccucuucucugagugaccaacuccuuaccuauuuagccaauaguagguagcuccaaagaagccuuugcuggacccaaccacucugaauaagaccacuuuccuaguguucccaaaacaaccuaggcaagcaccucucuauuugaacagucauacaauauacuuauaauuguauauguuuagccuuaucaccaguuuauugaccccuagaagacagcaauuaugcuuguguuuuggucuguuuaucccuagccucaauaaguaguaggugcucagugagugccuauuuaucaaagcucacucuuuuuucacgauaaaucugucugcaauuugcacuguaaauuccaguuauucuaauucuaccuucugguuuggaaacacaaaugcugaugcuuauuccucuuucucgugagaguucuucaaauaucaaaagcaacacacucuaucuuggagguauauaugaaucacuugugagucuuccuaaacuguagauucugaucaguagaucuggguuaagccucugagauucuacaucucugacaagcuccuggauguuccuggugcagcugauuuguccuuucauggcuaaccagcauaaacuguuuuaguuaauacuuauaagccuauuuucaagucuucuuauccuacccuuuucaguuggccuaagaagacacagagaaguacuguagacaaaaauggguuauuucuuuccgaaguuaacgcacuuuaucaagugaauuuauuaaacuaagucuaaugaaaacauccuagucauauuuucacugaaguuucauuaaaaaauauauaucugaaaaaacuuuccaggcacaauucauaugacaaggcauaggacucgaugugauaauaaguaggcccaagauuugaauggcauaaauuagcauucucaauuauacuuccaaaugagucauuugucauuccaggcugggaaacacagauguauguaauacaguacacacaccaauacacuaauagaaaaacguuauuauaaaguggaaguaacaggcuauuuuaaauuuucaagaaaagagccaauauacuauguuaaugcaccuagaaaucacaaauguauaaaauaauugagugauuaauauguuccagacauugcucuaaacccuuuguuugacuuuuucucuuaauaccuacaaccuccauugagguaaauacuauucagguaagugacuagacccauuuuacagguugggaacuuuaggcacagaaagcuuaaagaaucugcgugaagauacacagaucuauguuaccaaaauuguauaaucugccuagguggucugauuccagaguguaacauagaauuacucauuccacggccucucaggcgucuccaggcacauaagaagcaugauuuacugugcccuaaauuucccaaaauaagcauacuaguauuccucuaaguuaccacuugagcagaguagaaacauacaucuuaaaagaaggaacugauaucuuauucaaauuauuuguagguacccauuuaucaacacauuauauaacuauguauuuacuuggaguuauuuagccucagguaaccuaaauccaaccuugacacgauaaaaaaaauuagcauugaguucaauguaaaaaaaauuagcauugaguucaacguaaaaaaaauuagcauugaguucaauguaaaauaaaacaccugaaaauauuaguauaauugauaacaaaucuuguuucauggauacuuuaaacauuagaagaauaauuacauauauccuauuuuaucucauagaugaaaaauacauuauacugugaagaacuauauacuguuauuuuacagccuguaagaaaucuuaugagauuauaacauuuuccuuuaucucauaauauaugccaauaauauauucaauauuaucaacagcaucuuauuuuuaucuuccaaauuuuagaaaaauauuaaacacauaaccauauuuguuagaacaguucuauuuauguacaauauugagucucagaaauugucccaagaaaccucaugaccuuugaaaaugagaaucucaccauacaaauguguauuuagaaaggugaucaaaauucacuaguagaugcauuacaguauaugcaaaaggaucuggaauauccacucaacuuauuaaaauucaugagacuuuaaaaauauuauccagccuaagaggaguauaaacagaaaaaucuauuucacagaaauaaggagcuuauucugaaaucgccuuggaaauuguuuuuuuuucuauacaaguucugaagauuuuuaccccauuuauaucaaagauaauuuuagaaaguguuuguuugaugcagauuauucugauguguuuuauuucucaauaagcuaucuauaaaauuauuaugaauaugucugccugauccuuuacccaaauaacugauggcagcaggaauguagauguuuacauaaagaagcaaggguaauacucaucuuuuggggaaaagaaucacauucauguccuaagugaaguagaaguuauuauccgauggaagauguaggggcaggcgacaggaugguugucauccugacuuucgcaugcagacaaaauucuagauauuuugaaagaaucuaaguacaccauugaacuguaacagaauggcauuuauauuuuauauuuauacugggaacagauuuuuaagugauuuggaaaauuagugcaaccacuauaacaaauggcugaaaagaaaggacagaacaauccauucauuucuaaacaguguccccuuaaauggcucauuggacacaaggccaucaugaugguaacagauaauuuguuacaagcacugcaauggcaccuggcacagagcuaggucuaccugucaugccucacugacccagccugcacugcacuaucuaaacauguauuuaccauguguuaaucgaaaauuaugacagagauuugcauacauucuaccuccaacuuuaaguaacauuuccuuaaucuaaaauauugucagauauuuucaaucaugaauaagaguaaaaagagguaaagggaaucugaaaaacauagagggugacuaaaaauucugaaaauugucauuacugacuauugucacugaaaaaacauacuacacuagauuuggagaaugcuucuaaaauugggaauugaugacacacauguuucuaaucuuaauagcuugaaaaauuucuuuacuuacauaaucucacuuaaauaucccaauaggaauuauaucuacuucucagauuaggauuucaggaacagagaaauaaagucagaucuccaaguuuauaaaacaaacaaaugaaacaagauacaugaauucagaccuuucgacuccauaucuuggcuuucacuugccugauggcuaauuacaggcuaacucaaaaggauguuuuugagaacuuuuauuuuauaaauacugguugauggaauauguaauuaaaaagaaaguagggaauacgugguccagcuuaugccuugcuauucagaaaauccaaauguuucauaaaugaaacugccaacuauuguauuugucuucuagauuuuugaaauguuuuaaauuuauugaaacaauuauguguaugcauuuguacaugggaaaagcguauaugugacaaggagaucuagguuuugaaaauaaguaaucuauuuaauacuucuuagauaauaugaauuuguuuaucccuauauucuugauaaguaucuaaccauauaauuuaaauaugauaaaacagcuguguucuguagaauucuccauuuaauagaugcagugguaacaaauuucagucuaacaccuacuuaaaauuaacaaaauggaucaaaacuguuuuuaaaaauaacugagaauauacaagcauguuuucaugauuaggaaguguuuuuuaaagaaaaacaaaaacugcgcucauaugacugguaaauuuguaguauguuccuauccuacaaaauaauagugguguguaaagaaggcauccacugcuuuuacuccaguuuccuauuuuggcuccgaauaucugcauucaaaauccaguaauugaauuucccaagcaaaacaggccucuuagcaaaagccugcuggaauucuuauuuaauauaauguuuaauggacuucugauacaaaaugcuuauacagaauacuuccucucucucucucuaacagauuauacuuaggaaacuugaaaacaucucaagauaaucaugcaaauuagaguugguggaguauguagauguaaugauuuuuugggcaauuuuauuuaccuauuacauuggaaaagagguucuaaauagaaggaaauuauauuguaaaauauaaagaauucuauuaugcucaguaucaucaaagaggaauggaagguuugacuaguuaagcccauuuagaaacucagaucuuugaauauuaaauauucagauaaaccauucuuuaggaaucuuuucaggagccauucucacucccuaaugcaagauucaugacucuaaaaccuugugaaacugucauaauuugcuuauauaugacuuguucuuugcuuauuuuaauauauuauccaacagugauaaaauaacucggaauguccauaugaacauuuaauaagaauacuauaaaaaauuacuuauguuguccauuuccccaacaaucagaaaaacauaaccauggacauuuguuuaaaauuauauucaugugauucaauauacauuaucuucuauauuucucagguaaacaaucauuauaaaauggauaguaaaaacaauuucaaaaauacauaaauuuuuacaucuuguaagguguuuuccaucaaaaagccauccaaucuucucuauaucagaauucucuucaaguccaguauacauaauguuaagcaguaguggauuaaaaaacucuaguauuuaauaucauuuuuaauaaacuuaauccccaagaguacuuuuuuuugaaauuuguaaaugcuaaauuuuaaucacuuaaugaaugauaagacguagcccuaaaauauucaagaauuuuuagaagucaacgaacuuuaacucuuuuagaauacgucaaaggauuggacucuuuuuuuuuuuuuuuuguauuaguaaggauuaaaacauuucugucacagauuauuaaauaauguaaucauuauguggcaggcuuacugguacuuaaauauauuuugcaauauuuagauugugucucugauaugguuugggucuguguccccaccaaaaucucaugucaaauuguaauccccaguguuggaagaggggccugauaguaggugauuggaucacggggguggacuucccgcuuguugaucuccugacagugagugaaaucccaggagaucugguuguuuaaaagugugggacagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagcugggcgcgguggcgggcgccuguagucccagcuacuggggaggcugaggcaggagaauggcgugaaccugggaagcggagcuugcagugagccgagauugcgccacugcaguccgcaguccggccugggcgacagagcgagacuccgucucaaaaaaaaaaaaaaaaaaaaaaaaaaaaagugugggacaggccgggcgugguggcucgugccuguaaucccagcacuuugggaggccgaggcaggcagaucacaaggucaggagauggagaccauccuggcuaacucggugaaaccccgucucuacuaaaaauacaaaaaauuagccgggcgugguggcgggcgccuguggucccagcuacuugggaggcugaggcaggagaauggcgugaaaccgggaggcggagcuugcagugagccgagaucgcgucacugcacuccagccugggcgaaagagcgagacuccgucucagaaaaaauaaaaaaguaugugacacccccgucucuuucuuccuccugcucccggcauguaagacaugccugccuccccuuugccuucugccaugauaguaaguuucuugaggccuccaaagccaugcuuccuauacagccuguggaaacgugagucaaucaaaacucuuuucuucguaaauuacccagucucagguauuucuuaacagcagugcaagaacagacuaacauagucuccaacuuguuuugauuuuuaaaauuuuauaaugagcucacuacuaauaaucacucaucacguagcauacugauuuuuaauaagaaacacaauauuugaaaggaagaaacaaagugaacaccagaaagggagaagacaauagaaaugcaccuuuaucaccuuaagauggagagcccuauaaguagacccagcauaucuucauaauuugugauguuuucacuacaugacauccuugucuccccgacucaaccauuauuauucuauguaauaucaagaguccaaggccaggugcaguggcucacgccuggaaucccagcacuuugagaggccaaggcaaguagaucaccugaggucaggaauucaagagcagacugaccaaccuggugaaacccugucucuacuaaaaauacaaaaaaaaauuagccaggcauggugguggaugccugcaaucccagcuacucgggaggcugaggcaggagaauggcuugaauccaggaggcggagguugcagugagccaagaucacaccacugcauuccagccugggcaacaagagcaaaauuccgucucaaaaaaaaaaaagacuccaagacaagcugaacaauuuuauccuccuuagccuuuuuuccuuaugucucugcauuuagccguccuuaacuguucaguauuugacagauacauuaaaguucaaguauuuuagcagcuaucuuuauuacuaucuuggcacauuaugagaggagaggagauuugaacacucuuaauuuugagaugaagacuuuacaaauacaaaaaugugaacaguauuucuguucugauauagagaacaguauuucagagucugacuuguaaccccucaaguaauuuuaccaacaugcuaauuugaucuuaguuuagaaaucacagaaaguaaaccccucaagcaauuuuaccaacaugcucauuugaucuuaguuuagaaaccauagaaaguuagaaaauaaugagugcucuggguguuagaagggucugugauccaagccuucacuguuuacucucaguuguuuggucugcuguuugguugguuggccacuugauuucucccuccccuuccccccacccaacccccuuacuccuccgucuuccccucucucucucugccaaauuuuaagggcaacucuuucaaauuuucuguucuccucuucauuuucagcauauacuuccucuauccccuucuuaacuguagacugaaaaccaaucuaaacuauguauucgguguucacuguacauuagcaucaccaucggagcuuuaaaaucccaaagcccaggcugcaccuuagaccaacuaaauucaagucucugggguugggacacaagggucuauauguuuuaaaguucucuagcuaauucuacuguguauucaggcuugauaagcacuuuucuauaaauuaugccugaggauuugaauuaucucaauugcgagaugaagacauuuuagaaagaggcauuuuucccacuacuugcuuuccguaacuuauacauccuaauacacaaauauucuuuccauauaauuaugacuugaaaggaguuauuucuaaaguucuacuuaaguagacacauuuuuuauuaucaggacauuauauccuuauuucacauacugcuguagaaaugaacauccacuuuagcuagaaauuauaaacucuuguuacuuagaaaaaauaauuggggacuuuuaaaauacaaagucuacaagagugauucaugauaaaguuaaaaauauccagcacuccaacuaauacugugaaggacaugauuuuaaaagugaacccuuuccucuuccuucuuuucccccuucccuuucauccucucccuuuccuccuccucaucuucuuuuucuucuucuucuucugguuuaauauugaugacagcacuugauuuuggucaugccugcuuuuuaaaauaauuaaacaaaguagaacacuuaaauuuuacuguuaaauaauuuauucaaauuauuauguggugaauauuugauugaauauauacaacuuuuuaaguuaauagagacauuuuaagaacaaauggguuaagcuuuauucucuucuuucauaauaaaggaauaaagugaacauagaucuguaauaaguguuuaagacacuauuauaaaauggacaaguucuuuucuuaacaucuaucacugcucuuacuucucuaaauuauauucuucauaauuucaauauuuuccuucaauugaagaucgcugucuucagaaaaguuaucaguaucauuaaucacuauuucaacuuacgugauucuggucuuauugauccggguuugccuuucaucuacgugcuuuaaaacuuccucaggugauucaaauucauaguccagaucuagaaucauugcuuuaaccauuggauagaaauuacagccugaagaaacuuucuuccaucaacaaugaugaauaaauaguuucccaaugauuugaauacauaaauauugauaacuauauaugcuuaguaaauccuguaccauuuucuaauauuuccaauccaauucugugucuuugcuuuccugccaaugacuuacccagauauucccaucuugaugauaggguuuccaguuucucccugugucgcuguagagcauccgguauugggucacccaaucugagcugcuauaccuuccuuggguugcaauggcacugaucugcuuccgauugccaaagucaaccugaagccauugauaauggucgcugucugauggagaccaucccccagcaccugaagaugggcagagguaagaugggaaaaugaauauuuaaauuugaacuuguacaacugacaauggaauauucuacauaucuuaauuggucuuggcagugcucuauuucacagauauauuaugaaauauccuuuauagaugccauugggacuucaacuaauauucuuccagcugguaacauugauucuuuaaccucuuuaugguguaauuaugugcucauuuucuccugagcaaaugucuucauaauuccucaauuagaucuuauuaguacaugucaaagucuaauuggcugaggguugaccaauuuaccauaaacucuucagcuaaaaucaugagaaaaauguauguaacuauccaauuuuuucugucauguaaacuuuaucauuuaauaaauuauaaauuaaaaacaagcaauuauacacaauucuaaaauauauuuuucuugugaaguaaaguagaaaaauauuugcaauucuuaaaaugaaccuaaucuuacauuaauuuccuguaccacugagagguacagggaaguauauaggaaaucaggaagaauguuuauuuaacacuuagaagauauacagucaauaccucuuguaagucauauuucuagaaaaauuagauacuaaacaaaguuaaaucucuuuuggcaaaauauaagaauugcucagcaaauaguaagaauguaaaaacauuuguuagaaaaauggcacucauauagaucaauauucuuaauuuacaguaauauuuaaaauaacuaggguuguacacaaaauaaguuacagaaaauauggcauaauguuagugcuaagaggcacuauaauuuuuacagugaguucagcuacuaaagagaaugauauaaaaauauucaauagauuauccaauguacaguauaucaaaacguguguacuauuuuuuaaauaaggaauuuaaaggcuggcaaaauaauuuauucuaugaggacguucauaauaaucauuucauaaaucaucacagauauucaaauaauaaugguuacauggccuauuuuugcuuaaaacuaugauagaauagcuuuuuuuaaaauuacaaaacuaaaaaauauauaaaauaacugacugggcucaguggcucacgccuguaaucccagcacuuugggagaccaaggcagguggaucaccugaggucaguaguuggagaucagccuggccaacaugcugaaaccccauuuccucuaaaaauacaaaaauuagccaggcgugguggcaggugccuguaaucccagcuacugggaaggcugaggcaggagaauugcuugaaccugggaggcagagguugcagugagccaagauggugccauugcacuccaguuugagugacagagugggacuccaucucaaaaaauaaaauaaaauaaaauuuuaaaaaaucacuguuuuagggacuggacaaugggcagugcaguacgugauccauaaaauaagauaaacaaauaaggugagcccugccaacuuccuggcuuucugcuagcuucacuuucuggaucauggcauauggaagaugaucccaaacagaguucagcagugcaguagugucauugaaacggaaacauauuacaauucaaagcuacuaaagaagcuggaauuaacaggacagagucccagagagggcacagcuguguaaagugcuuuagaaaucuacaagggagucaugaaugugucucugcaaucuggacucagaagaaacaccaugcugugcacuuuuagaucaagacugcacaagaccagguaaagggaguucugaagucaacaauaaccagagguugcacagagcugggaaaaauuugauuucagacuagacaaaauugagagaccuuguugaaucccuccaggcauucaguagacaucccauaaaagucaugcauuauauguagggauauuuuaguccuaauaugagggcuagucuggacacaccugagcaaagguuacugaaaaagauaaaucugaccaaaaauuaauuuuuugauggaacaaaacuugacacuccauuaaggaaagucauaaacauuuagaaacugaacaacauugcauccauaaugucaaguauaucaacugaaaaauauacuagacauuuggacaagcaggaaaauaugucuuagaaccagagagaaaaaaaucaauggaaauguauccccaaaauaacagaaaugaugaaauuagcagaccaggacuuuaaaaacaguaauuauuaauucuauuaucuaaaauaaaacauauaaacauuuuuuaaaaaugcaaaauguugaaggagaaaagcaacaaacgagaacaaaauggaaauuuuaggaguaagaauuacaucugaaauagaaaauuuaauggaugggcuuaacagcagaugagacacagaagaaaacaucauuguacuagaauguagggccauauaaggcaucuaaauuaagcucagagaggaaaaacaaggcuuaaaaaauaaacaguuauuccaguaaguugugagacauugauaacugcccuaacaaucaugcaaguggaguacuacaagcagagaugacagagauugggucagaauaaaauauguuugaagaaauaaugguugaaauauauaaacucagauaugugagaaguuuauugaauuccaggcaggagauauacaagggaaaauacaauaaggcacauuauaauuauuugcugaaagacgaugcuaaagagaaaaucuuaaagguauucagaggguuacaacuucucagcagaaauaaugcaagccaaaugacaaugaaacaaccuaacagacaugaugaaaaggaaagauaaaaaaaaagcuggcaaccugaaauucuauguccagcaaaaauauauuuuaaauauaaaaauaacguaauauucaagacaaaagcugggagaauucaucacuuuuauguguauacuauaaaaauauaaguuuuucaccuuaagggaaguuuaccauuuugaaacucauauuuacaugacgaaaugagugcuuaaaaugcuaaacauguuaaguacauauaaaauauuuguucauguuuuuaaauuucauuaaaagauaauuuagugcuuacaaacaguaaugaugaauaacaggguuuauaauaaauguggaagucagauaugcaacuacaauaguacaaaggauaggagucuggacaggaaauauguuaugcuguggucuuaacuuuacauaugaggugguauuacuugaaaauagcaaacccuagaucaagggucagcaaacauuuucuguaaaagguuaaauacuauguauuuuuggcuuuguagaccauacuaccucuguuaaaacugccaaauucuauuauaguaugaagagcaguacauacacaaaagaguauggccauguuauaaugaaguguuauuaacaaaagcuuguagcuggacagaggguugaaguuuguugaucccugcccaagauuaaucucuuaaaaaaaaauacaaauuuaaaaucuguaccuuucacuauaucgaaaucauaucucacaaaacauuuggaaaaauuuaaguaucuaguguauguguuugcauagguuauaugggugcuaucuauggaauauaugugcaaacgauguaacuacuucucaguuucuauuaucauauaauucacacuuuuacaagaauauuuuuucuaugauacaguacuuagcuguaauuccucuucaggaauuuccuggguuaaaaagaggcacauguagaugguauaccuucaugggguugugcaacugcaacgacuggucaaccuggggcuauaaaaagccaguacccugccccaaccuguagaaacucugaggugucuucacagucucagagcucccugcagggauuggucaaagacuucauugaaacugcauuucaccuaaacuccucccuguaacuaauuucuguuucauuccuuucucuuccacagguuuucauccccaaaacacuccuaauuaacuuccuagaugcuauuuuucaucucaggauguguauccuggagauucuagucugcaguaccucuugggaccacuuccugauaaucuguuuacuaacaaugaguuacuuauaccugcuuuguaguguguuuuuuauauguuauuuuuuuccuauuguaguguuaauauauaauauuccuuauugucauauaucauucaucuuccuauuuuaccuagaauuccauaaaauuuugaaagagcuguagguuaauuuuggggacaacaauauacucaguuauugugggguaacaaauauauuuucuuaccuguuagauauacaguucgaaaccuugaagaaauuuuauagccaauuucauacagaguucuauguauuaccaaaagcaacagagugauugagugaacucaagucaacgagcaauuaauacaaugagguaacaggugagaaaaugucugauugauuggugaaacuuagacuauuuccucuguuuugcuaaugaaugcuccagaauaaauuuucuucaguuacuuauuguuugcugcauuccagucuuucagcaagcaagcaacuaacauacagcugcuuaaucccauuuaucucauuacuuuuagcaaaauagaauuuauuguuaacuuuaaggaaagcaaaaaucuaaaaucagaagaaauauaagucaaaauguauuucuuagcagaaauauauguggagagaauacuguagugauuaaccucaaggggagggcaaaagucagucuuucaugaggaacaugguggaaagaucgaugaaaaguucccuuuuucucuuuggucuaucaagcaaugcaauucggggaaguuuauuacuuuguuuacuuggcuugugaaauguguaaccucuauugauccgaggauuaauaaugauaccucuuucaucacaaccaccucuggaaugugguauauaagagggcaaaaaaguucccaauguauuguagcagcucaaagaaagugguuggacgucaaagaggaguuagaagaaguggagaugcugaacagucauaaacucuuaguuccuaagaagaacacuugccuagagauaauagugccuaaaacaucuagcaaauaacuaguguauuguugaaguaacuugaaagauguauacuuguuauggaacucuugcuagucucgaaacaauaagaaugcuguuucuucauuccccuucucucucuucuucugugcucucucuucccuuucccaccccucccauccuccaucugucuuuccuuccucacucuucucuuuauucucacacauacacagauauuccucccccuguguauuugcguguguguaguauauggugugagcacacguaugcuguaaagauauacaguguuuguauucuacguguccauucuaugugggcuccuagagugauccauuacaauagagaaucugaauaauugaagaaacuaguacucuggacuaauaugaguuauuuuugcuuuguaauuuguaauucaguaagucagacaaaagaggaauuuagugggugguuuagagaggccauggaguuucuguuguagugauaaauggcuccugaagaaacgcggcacucaaguuggugguuuuaacaccaccagagacuauaugccuggauucuaauuuagcaaaaauacaaggugaaaaaaaaauucaauuaggguuagaacuaccuuuaauaacuggcugagaaauaaguaucagcugaaaaaaauaaauugaaaaggagacuccaggcaaaauugcauuaugaguucaggcuuugagacccccuucugcuucaaauacacuguauuuuuagauaagauagauaagaagaaaauugaaaagacauagccaggaucaaaaaauaagauaaacaucucuaugcacaagaaaugcaacaaacaugcaaagcaaugaguggggcugaagccgaggccagacagaguccggaucuggggacauacaaaggcauuugggcauuugacuacuacggaauauugguaauguaaguucccuguguguaucagcuacagaaagcuugcuuuaagguugcaaaccgagacuggcccucggcuaaccugguugugaaaagagacugaagaaagcugauuacucacuuaaacauauggauuauaugaggcuguaugcccaaagagguuagcaaauaggcauaucugagcugaguaaaggcauucacuggcuuggugacuagacacaugauucccuaaaaacacugccaggcacaggcaucgggcgaguaauguaagguacacuuucagacuggacauucugggacuugaguagagaaagucccaaaaugauaaagcacaaaaaacaggggagaugagaggagauaggaagagagaagaaagagaaagagagaccagaaagagagagacuggcugucaagaagaacaugcaaaugaaaauuucaaaugacaggaaugaaauccaaugccacgaagucaacaaagucaaaaguucaacaccaauuaguuccauaaguaauagcaauugagggcuaguggagauaaauaggcuuuauccucucaaaaauauaaaauagguaaugcuauucauuaaaaauagcaguaauuaucaguuacaacagggaaaaauaaaacauuuauagauggauacuaaaagaaacuaugaaguaguuuuagaaaugcaaaaguugguugauaggaaaauaaacucaucugaggaaaggcuaccaauuauauauaaucuaagaaauaauuagugagcuaagcugggcaugguagcucacaccuguaaucccagcaguuugggaggccgaggcggguggaucacuugaggucaagaguucgagaucagccuaacauggugcaaccccaucucuacuaaaaaaauauacaaaaauuugccaggcgugguggcgggugcccguaaucccagcuaguagggaggcugaggcaggagaaucgcuugaacccaggaggcagagguugcagugagcugagauugcaccacuguacuccagccugaaaagaaauaauuagugagcuaaaagguaauauuuccauguugacauauauauauauacacacacacguacauauuuauaaauuauacaguguauauauucauauaaauuuauaauauauaaaauauaauauauaauaaauauauugaaguuaauauuaauauauuagauuaaauaucuaaacauaguauaauguauauugauauauauuaauauguacauauauaaaauuuaccacuauauauaaauuauacuuuauauaaauauauauguuaauguauaucaauuauacaucaguaaaccuguuaaaauuugcaguaguuaaaagauauuggggauaaauuggaaguuucuaggguaagucuaagagaaguucuagacuaagaccaaugcacagaauauaaacauuugaaaaacuaauuuuuauucaaaacuaaaaaagacaugacaccaugaauuuuaagaccuucugaacauugaaaauaauauguaacaugaguuuaagccuauaauggagaauuaucuaauugauacaaaaacaguaacaggcaucuuaauaagugcuaaaaugaacucguuaaugagcucagauuuuauuugcagugggggauaaacaucugcaaggaggucaugugaucuaugagaaguggauaaacaggcuucaaccaagugcagauauuuguugauuagaguagccagggaagagggcuauauccauuaaucaacaucuguuauaaacuagaguaggaaaauuggcaguggcccaaucauuccuaaaauaucgauaaauuaauacuuauauaaauaagguucaaacaaaagagcuugaaagcuauuuuuuaagcaaaacagaagaaagaagauauaauacuaucagauauuauuuaaugacaggaaaauaguacuguuugucacccauuucuaccaacaaagacaacaguuucaaauaauucuagaaguagcaaaacuacuaacugaguauagacaaauaccuccucagacaagcuaagacauaauaagacagacaaaguggcuuuaacuuuuuuuuuuuuuuuuuuuuuuuuuuuuuggcgucuugcucugucgccaggcuggagugcaguggcgagauccuggcucacugcaaccuccgccuccuggguucaagcgauucuccugccucagccucccaaguagcugggauuacaggcacaugccaccaugcccaguuaauuuuuguauuuuuaguagagacacgguuucaccauguugacuaagcuggucucgaucucucgaccucaugauccgcccaccucggcuucccaaagugcagagauuacaggcugagccaccacgccuggccuguuccuuuaacuuuuugaagcauucgaauucagauuauaaccccaaggacuggcauuauccauaaauguaaucuuagcuuucuugaauauuuauuaaaggagcugccaaaaaaagaaagauagucaaaaacuaaaaaccauaaaaaccauaaauuuuaaaaacagugaaguugguacaucugggaaaaauaacaagagagauccucuuuaaagucuagcaugugaguuguaaauauuuaggaaaaagaugaauggggucuggugauagaggaggcaauagugguagguuauaaggauuuccuuuuauaaaauugaguccuuguuuaauagaacagcauaaauuccauagauguaucuucaauuuuaauuauugcaaagcauuugacaaaauaucuggcaaauguaaacuaguaaaaugugggcugggagauaacaguuuuagguagauuaaaaaauggcuaguuaucgugccccaaauacguugauuaauggugaugucagcuugaagagcgcucucuaaugauguuccacaggcuuucauccuguauacugucauuuuuaauauuuuuauucucuaaggcaugaaagacaugcuuaugaaauuugccaauuauauaaaccuggaaaagaaaccuaauaggauaacaaacugaauaaugauguaaauguuuuucacuggcuggaaaccugaaccuauaccaguacaguuuguuuuaacaucaacaauaaacaaagcuacucauuuugaagaaacgcauuaucaauuucaugauuaaagguaucuaaugcuuagaaagaauuauguaaccuuacuuuaugaaauaauauacaggguuaaaauuaugacaucuaaguagaauauuauauuuacaauguauuauuagauauguuuuucaugcauuuuuauaaagucuuuacauauauauauauaaaugaacaaauuacaaacauauaaauagcuaguaucaggaauuaucacacaaugaacauaacaguguaacagccacccagaucuauaaagaaaucauugccagcaauccacaagcucuucuuguuuccuuuuucaaaaaucaccguccuuuucccccacaauaaauuguucuagaagugauucugccccacaccauacucaaaaaucaaggucaaaacguguagaucaaauuguaaaaguuucuggaagagaacauacagcaucuuuuugugguugggaaagauuuuuuaaacaggacucaaaauguacuagcuaaacaggaaaauauaaauucgauuauaguaaaauuagacaucgauuaucaaaaggcaggaaucagagaguuaaacggcuaacuauagauugggagaagauauuucuaaaccuauaacaaaaauauucauuuuuguuaauguauaaacaagccccacaaaucaauaagaaacaaucaguaaaccuaauaaaaaauggguaaaagacuuuaacagguaguccacaaaagaaaaauuauaagcuauaaaacauaggacaagguauucaaucuuaugagaucaaucuuuuaagaaagauaauuuuaaaacuaaggguguucaagaagaauaaccagaaugauguggaaacucaaucucguaacauugcucugaagagacuaaagacgguuaagcuuuauaacagaaaguuaaagaguaaauuaaauuccaucuuccacucuucaaaagaauaaacacguaagguuuuccagugaugcaacaauaacaucacacauucuaaaaguauacgugcuuuuaugucuacagauuauucagcucuaacucauauuuuuaaaauuaauauuuugcuucaauuaaguaaaaaaaaaauacuuuucgacuuaacauugucaguugcauuugucuguucauagccuaaucauuuuacuacaaguucuuuccauucuggaauuuaaccaaauaauaauacugaauauugagcugauuuuaacauauuugaaacacuuugcugagaaaacaaaaaguuuccuuauacaauauguuuguuccuucaaugguucugcagacuacacuaacaaaaguuauuagaacuuuuuuuuuuacagugcugauaauauccagacauaaauggcauuaugaaaaucauuaaccuucuggcaauuaggcaaacaaaagaaaaucugucuagcugaggcuucuguuuauguauuucuucacaggaaaagcagagugucaguugugagaaacagacuuacagcaagucauuuaguuucauguauuuaaaaaauauguaaauuauuuucagggaauuucacaacaauuauauuuuaagaucuuugauuuaaggauguuaauuuguuuuuaaaaugucaaauauuacccuaagauuauaagagacaagaaaaaugaaagccagacccaaaagcuaaacaguugcuuacaacuacguaaagccuagauaguggugaaacuaaugugaaugcaaauccaaauuugauuaaguucuugcuccacacagaagccacagugauauacacagaggcuagccugagccagaguguaaaaacaaacauacccuuauuuuacauuauuuuaaacacauuguuuuacauuagacauguauacaaguuuaauguaaaauagugacaauuaggucugauuagaacaucuugaacacuuacaugaccuguaauuugaaagcucacuuacuaaacaguauaaaugauguauaaucuuauuuuuuuaauguccugaaaauacuguggccaagagaaaauacaccuuuguguguuaucucagguaguaguauuuuucuuuuucuaaauuaaacuuuuucuaaaaggaacaugcagguagucagaugucaauguaauauuuuuaaagcauuaggauaacuauuaccaacaauagaauggauucccauaaaaguaaugagcucuucacuacuggagauauucaaaugaaagcuaguuaucagaauuauuuuagaagaaaaacuuccauaauuugagagauuggacugcguucuuuauuuaaaauguaaguuaaaaugcaagcuauuauguuacaaucauuagcaaaacuaucaaguggauuuuauuucuuauuggcuuauuuucaguuuugcuucaucuguuuuauuaauauagggggcauauuauuuacaccauuuauuuacaccauguuauuucagcuaaguaacacuugacuguauauaauuuuuauuguuaaugagucuggucauuuccuuauuuacuauaaauaccucuccugguucauucauucagcaaauauuuguagagcacgucuauaugccagcuacucaggguuucuuuuagaauauuuuauaagcaauuuuuaugauguuuuuauacuugagaauccaauuuauucauuuagagaauguacaaaaaaucuuuaaagauuuuaccauauggaaaaccagauaugucauauauuuuauucacagaaaugaagucuuaugugugaaaaauaaaggcaauaaaaauaauauaaucuagucaaagucacugaagucauguucgucuuugcaacuauuuggaagcugcuguguaguucuccccuguaaggaagacugaggagcuucauguuguauguauucccuagaaucucuuuguucacugcauuucuaauugaaaucaagaucgaagccuucaucaguugaaggcaaauaucaauguugcaaagaaaggaaaaguuaugucaguuuucugggugcaaaucuacugcuuuacuuuguauuuuuucaucccuggcaugcauucuuaguaaaagucugcagaauuuuggaaauagcauaguuaauuaggcauaauuucuuggcuucccuagcuaagugcccauucacuggaauuguccagaaaaugucaucauucucaagauguuauucucucugauauaaaaaaaaaaaaaaguaaaaacauucuuguccacgcagaucacaaggaauauuacucggugaagaugcagaaaguaaguauauagacuacaaaaugcuucaaagcucaaacauacaauagugauauagguuaccaaauugccccucuauuagagggaagaucaaagaauggauaucaauaagaaaaucaguuaaaucauggaauuuguagcaaacccugaacaaguacuaaguaaacucuuaggauugcccauuguuuuuaagucaagaaauuauuuguauucauuauuuaauaaccacugccuagcaugguucucuggacauaauaggcacucaauaucuacaaaaugaauauaagaauaaaguaaaaaaugaauauauuaauuaauuauauccuggaaauaacaucccugaaacaggagggaaaauucuuggguccagcugcauacauauaagaacgacagagauuauguaaggcaaauugaauuguaauugaaaaaaaucuccuuaaucauguuagugguucucauuguaucuccaguagagcagaauuagacuucuccagagcaguuacuguauuuauucuagauuuuauucuuggcuuaauuuauuuuaugcagauauucuuacucaagucucucucucucucucucucucuauauauauauauauauauauacauauauucauucauucuuaaaaauuauuugauuguuuacauaaauaaaauccucauaaaauuaagucauuaacaauuaucuuggagaaauccuuggauuguauuaaaacucuagcacucagaguggaccacacuaggaaaggaguguggaauucugcuuagaauucugucucaguaaguuuuaccgggcuccaguuaucacucaugcauuagcacauccccuccugugaacauuaucacaaucacuucuccacacaucagggagcaaucagcuuaugugggucagcagagugaguggacaggguauucugaugagcugggaauaagaauggacuugcuuaguuccccaugagagguggggaaucuuggcacaggccugcuucaaagggacccgggaagcuggcugagaggauccacaauucaaaguagaaauguuaagaauuuaaauggaacuguuuacagcaggauauuccuuuaacucacauaguggcuuuuagcuaaguggguaacaauaagugaauuuaaaaauagauucucaaauccuagucucuaucuagcauuuugugcaaaaaacagcuuuaguuauuuauuacuguuucauucacuuaagaaagaaaagggucagagguacauuuacaaaaugaaaaucuucuaacuaguaacuaaauauaguuuauuguuuauuaaccaaauaauuagggaugcaaauaacaucuccaugccaucugccucagggacucuuacugaagcuucauuauuuucuggggcagaggcucagcucuaaaagacaucacuggaaaaaaaugcagaauagcaaaaaagaaauguacuuauuaucugugcauuaacaaaaucuauuauuaaacaggcaauaaugucaaugguauauacaaauagaugcaaaacaauguguacaaauuugucugcccugugugcagugauauaauuuauauaugccaauuuuugauauacaauguugcauucaaugaugcaaaauugccagugaucugugcaacaauauaaggaaaauguacugucuauacaaugauuuugaagcuaggucgaccacacaugaaaggacaaaaagaugaggucauguucaaguaaaaucucaugacaauugagacagauauugcucugacuugcaguaaguggaaaauugcuuuguaucuccacuuuucauauuuguacacuuggucucagacuaugauauaguaauuucauauacuugaaaacauagguuauaaagacuuuaucugcuuuaguucauuuuugaggaagaaauacaaaggaauuguucucaagaucaauaugguuaaauauaguaaacaaauucuuuaagaucuaacucaaaugccuuuuaugagugcucugaucuuccccaggacucaugcauagugagugauucccuucucuuuggcuggcacuugcuacacacauuacuuauuccaauccuaacccuaguuccuggauggcaagaaugcaguucucaaguucauucuuacaaucccucugauuccuaugaaggugaauggcacacauauccagcuacuucaaugacuaacuacuguaacuaucguaucuguuuugauaaagaggggagauuuuuggcauauguauacuuggcaacaugaaacaauuucaccaaaagcauuguggguguguuuugauauuaacuuaaaauguguguagcagucccacuucacaaggcucugaaugagaaacaacauuaacaacauuaggauaaguacacacacacacacaggacagauaagccuuguaaauauaguugcuuucagugcaaucuucugaaaguguuacauucauaaacacagagauaucaauucuucauguaaagaauuucuuuaauaggcuuuuuucccccauagggcaagcugaaacugguugacauagcaaugggcuaaaaugacaauguagagaaaauaauugaaaaucaaauaaaaaaaaaaaaaacagguccaaaauucuuuguacaccuuaauaaggacaauagcuucuacuauccuaaaaguuuucccacaucuuuaugaccaccacaucacuaauuuuaauuccccaaaauagaauugcauuuccugucugagcuuuaaguaacauauuauaacaaaaagcauacuggacuagaaucaaaccuaguuauaagauauuuuugucauaugaaaaaaagcucaugaucgcuggucauuagagaaaugaaaaucaaaaccacagugagaucucaucucacaccaguuagaauggcaaucauuaaaaagucaggaaacaacagauacugaaggggauguggagaaauaggaauguuuucacacuguugguaggagugaaaauuaguucaaccauuguggaacacaguguggcgauuccucaaggaugcagaaccagaaauaccauuugacccaacaaucccauuacuagguauaaacccaaaggauuauaaaucauucuacuguaaagacacaugcacacauauguuuguuacaacacuauuuaugauagcaaagacuuggauccaacccaaaugcccaucaaugauagacugaauaaagaaaaugugucacauauacauuuuuggaauacuaugcagccauaaaaaagaaugaguucauguccuuugcagggacauggauaaagccagaaaccaucacucucagcaaacuaacacaggaacagaaaaccaaacaccacauguucucacucauaagugggagcugaaaaaugagaacagauggacacaggaaggggaacaucacacaccagggccugucagggguuggagggcugggggagggagagcauuaggagaaauaccuaaugcauguggggcuuaaaacccagaugacauauuaauuggugcagcaaaccaccauggcacauguaccuauguaauaaaccugcauguucugcacauguaucccagaacuuaagguaaaauuuaaaaaaauauaugucugugugacauuauagaauacgggguccaaguuauaaaucucaacauuuugauucagccauaaaaaaaugggaagaaaacaugucauaguuuuugaaauuauuauuagaaaccuaauuagaagauauaauacugacucaacuauuuaaauauacugaagaaugaguauacucauauuuaaauauacugaagaaugaguauacucauauuuaaauauacugaagaaugaguauauuuccauguaaauauacugaagaaugaguauauuuccauguaaauauacugaagaaugguauauuuccauguaaauauacugaagaaugaguauauuuccauguaaauauacugaagaaugaguauauuuccauguaaauauacugaagaaugaguauauuuccauguaaauauacugaagaaugaguauauuuccauggaaauauacugaagaaugaguauauuuacauggaaauauacugaagaaugaguauauuuacauggaaauauacugaagaaugaguauauuuacauggaaauauacugaagaaugaguauauuuacauguaauuauacugaagaaugaguauauuuacauguaauuauacugaagaaugaguauauuuacauuuaaauauacugaagaaugaguauacucauauuuaaauauacugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuccauguaaauaugcugaagaaugaguauauuuacauuuaaauaugcugaagaacgaguauauuuauauuuaaauaugcugaagaaugaguauauuuauauuuaaauaugcugaagaaugaguauauuuauaaauauucuuaaguauacacuuaaauauauauacuuaaguauauauauuuaaguguauacuuaagaauauuuauauauaaauaugcuuaagaauaaguauauuuauauuuaaauauuuauuaguauuuugauaaguaauguuuucacucuuucguuaaccaucuaauucacaaaaggucucauuagaaaauacuuaauacucagacacuguaggaacaaaacaacgagcauuauuaaaaacaggggaaggugggacaaaugucugaguuuuuuuuuuuuaaauuuuuguauuauuauuacacuuuaaguuugaagguacaugugaacaaugugcagguuuguuacauauguauacaugugccauguuggugugcugcacccauuaacucgucauuuagcauuagguauaucuccuaaugcuaucacuccccccugcccccacgccacaacaggccccagagugugauguuccccuuccuguguccaugugaucucauuguucaauucccacauaugagugagaacaugugguguuggguuuuuuguccuugcgauaguuugcugagaaugaugguuuccaguuucauccaugucccuacaaaggacaugaacucaucauuuuuauggcugcauaguauuccauaguguauaugugccacauuuucuuaauccagucuaucguugcuggacauuuggguugguuccaagucuuugcuacugugaauagugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuuuuuccugacuuuuuaaugauugccauucuaacuggugugagaugguaucucauugugguuuugauuugcauuucucugauggccagugaugaugagcauuuuuucauguguuuuuuggcugccuaaaugucuucuuuugagaagugucuguucacauccuucgcccacuuuuugaugggguuguuuguuuuuuucuuguaaauuuguuggaguucauuguagauucuggauauuagcccuuugucagaugaguagguugcgaacauuuucucccauuucguagguugccuguucacucugaugguaguuucuuuugcugugcagaagcuccaacauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaagcauagaaaggaacaacugguaccagccacugcaaaaacaugccaaaauguaaagaccaucaaggcuaggaagaaacugcaucaacuaacgagcaaaauaaccagcuaacaucauaaugacaggaccaaauucacacauaacaauauuaacuuuaaauguaaaugggguaaaugcuccaauuaaaagacacagacuggcaaauuggauaaagagucaagacccaucagugugcuguauucaggaaacccaucucacgugcagacacacacauaggcucaaaauaaagggauggaggaagaucuaccaagcaaauggaaaacaagaaaaggcagggguugcaauccuagucucugauaaaacagacuuuaaaccaacaaagaucaaaagagacaaagaaggccauuacauaaugguaaagggaucaauucaacaagaagagcuaacuauucuaaauauauaugcacccaauacaggagcacccagauucauaaaggaaguccuuagugaccuacagagacugagacucccacacaauaauaaugggagacuuuaacaccccacugucaacauuagacagaucagcgagacacaaaguuaacaaggauacccaggaauugaacucagcucugcaccaagcagaccuaauagacaucuacagaacucuccaccccaaaucaacagaauauacauucuuuucagcaccacaccacaccuacuccaaaauugaccacauaguuggaaguaaagcacuccucagcaaauguaaaagaacagaaauuauaacaaacugucucucagaccacagugcaaucaaacuagaacucaggacuaagaaacucacucaaaaccgcucaacuacauggaaacugacaaaugucugagguuuuaaaagucuguauguuuugucuauuuuuuccauuuuccuuuauauuuacuuauauauacuacaggaacaagagauuaaauauucaauugcuaacuauauaauuuuuuuauuaauuccucaaaacauaauauuaacuuugugauagcuacagugcuuauaaaauuuauuuuuauaggacagugaauuuuccuacuugaagcuauaaaugaacaccugcuuugcauuaacuaauuuaccacucugaaaaaacauaaaacucaccagucuuagggucccugaccaaauauuauguacacuguacauguucuuuuaauucagaaagcaugagaugcucuacauaccucaaugagcacugcucgaaauaucuauuuagcaucuucugaucaaauuacaauguaaacauuguuuuauuuggugaagaaaauaccacuauaacugcuacaucaagaauaaguuguauggauauuccaacaauaacagggaaaaguaaaaauagugagugaguuggccugagguggauguaucaagaaguggauauaugagaguauucucagaacauccugacagccuguauuucagggugagagcuccuggcgacuauggcaagugaaaagaaggaaucaaggcugacuucuagacauucugaguugagaaacuugaagugaguuaguagcaauuccugaaacggaaaaaaacgauuagagaaagagauuuggggaugaaaauuaggagcuguguuuuagucuuaacuugaggugucaaguucccauaucgguuuuaaagaugaguuugggucucaggaagaugaaauuaagacauaaauuuaggagucaucaguagcugaaugguauugaaagaugagauuagaugggaugaucuagugaaagaagugcuguccaagacuugaugggacgugccaaugucuaauaacuauuuagaggaaaaagaaaaggaaugccaagugagagagaaagaaaacugugagaguguguggcauugugguagccaaggagaaaaguuuucuagauggaggaaguggucacuguaucauuuugugagauaauguggcaacacacucuuuucaaguaaaaauagaauaaugucuuugauucacaaacuccaauuucccagucauggaaucugcauuacuauagaaauaacuaccauugucaucacuucccuuaaaugaggaaauaaugugcaccaauauguucauugcuuccaucuaccacuauucauaaucaacuacaacuggaaacuuuuaaauuuucaucaguaagggaaaguuggguaacuugagauagaaugaucauauagaauacuuuauagcugauauaaauaauauguauuauuuucaaauuauuuuuaaaaagcagaauaugaaucugaauauacauugauuaaaaguagguaaaauuauaaauaauaugauucaggauugguauagaauaaaacuccacauuuuuuguauuauauuuaucauuauuuaaaaauuuaccuaccuuaaugaauaucacugugguuuuuacuuuuuaaauguuaaguagugauguuaaauauuuuacauacauacacuaauaauaaaauuauuaacugaauaaucucuuuuuagcuuuugugauaucguuuuucuuauccaauuugugagcuuuuuaaauaucaagaaugcuaauccuuagucauuauucccauaaaauacuuguaacaaaaguuuucauuuaguggucacaugucauaauacacuuaaauguuacauuuaucaaauuuccuauuuuacacaugcuaaaaacaaaaucuuccagaguuuaggugacuugcccaggccacagagagcuaguaacagaaaucaguuugaguucugaugaguccgauuccgcaucgugugcuuucuuuuuccauggagguauuuaaaacaaaagaccccuaaagguugcaaacacuugacaauaccaaucuuaaguuauugucaaaugugguuuuauuucauggagagacauggaaaaaauaugcuaaacagaaaggaguaugcaaaauacuuuggccuucuuaggaaaccaaaaguaagaugauucuauaaacuacuuaacaggcaaauugaaucccguuaaaaauuaaugaagugccacuaguuuaauacugaaacaaaggcuaaaaucgucaugcaccauuuuaacagucucuugauauuauuugaauuugggguuaaagaugaaucauucucaccauccauuaguagagaacuugccaauucauaaaccuauuaaaacucucuauugguacaagaaucaauagaaucuuuaaaguuaauagaaaagaaagaaaauuugagaaaaaacacuauaaacaaaugaggaaaaauauaaaguacagaaacccuuaaccacacuacuaguauuuauuuaacucuaaauauucaugccaauuaaaaaauguuuuauauggaagugacacagaauaauaacuuacuuuucaaucaauaucuuauauucuuuuuuuaacaaauuucuaguuggcuuauuuuuucugauuucaguuuuuaaucuuuaaauuuuaguauuugauaugguuuuaaucuuugucccaccaaaucucaugucgacuuguaauccgcaauguuggaggugaagccuggugagaggugauuggaucaugggggugguuuuucauuaaugguuuagcaccauccucuuggugcuguucucaucaugaugagggaguucucacgagaucugguuguuuaaaagugaguagcaucucccugcccuuccucuugcucuuguuccugccaaauaagacgugucagcucccucuuugucuucuuccaugauuguaaguguccugaagccucuuuggaagcugagcagaugccagcaucaugcuuucuguacagccuacagaaccauggccaauaaaaccucuuuuuauuuuauauaaauuacccaguuucagauuuuuuuuuuuuuugauggaguuucgcucauguugcccaagcuggagugcaguggcacgaucucggcucacugcaacuuccgccucccggguucaagcaauucuccugccucagccuccugaguagcugggauuacaggcaugugccaccaaccuggcuaauuuuuuguuuuuuuaguagaagcaggguuucuccauguuagccaggcuggucuugaacuccuggccucacgugaucugccugccucagucucccaaagugcugggauuacaggggugagucaccgcaccuggcccagguauuucuuuauagcagugugagaacagucuaauacaguauuugacacuguuuauguaacaggguuuuccuuucuauucuauacuaucuggggaucagagacacuguguuauccuggucguccaucaacucuaaccauuuauuuucugugagauuuucauccugccuuuccccucucaauuuugguauuuuccaaguuuguuuuucuccagaccugaauuaaaugauuuuaaaguaacagcuuuuauugggaacuuauuaucuaugauauuuuccucagguaaacucagcuaauccuugaaacagcuguaggagacaagugcuauugcacauguuuuauacaauuaaagaaacuuaagcauagacagguuggguaaguugccacagaucacauggauaguaagaaaagcagcuaguauguugacccagggcaugacuuuuaaccaccgugcuuuacugccugccaguuagcaacuacaaagcuucuaacauguguauagcaagcagucuauccuacuguuuaaaagcaaaccaaccaaacaagaaacaaacugacauguuauuacugauaacucuauacuuuccuuagguuaacaucuuuagugguauacgcccaaguuccaaagucuagauacccauuuacauuaaacuccuauuacauuuuacagugugugcccauuaguuucucuuagacugugggauggccaacuguucccggcaugggcagucaguuggugagguccucgauugggaauacuuucaggcugaguuccuucuacucuuuuucucuuguucuugaaaugaaaaguucucuccaccgaauccucuuccaaucuggacccucagggcauuucuucucugccuccucucuaccuuucccuucaucccaggcacacuauccucauaaugaugcaucugugacuaucagacucacauugaagugcuauaacuucucugaaucuuugagcacauaccaugaguaccagacauauaaaaaguacuuggaaccaacccaaaugucuaucaaugauagacuggauuaagaaaacguggcacauauacaccauggaauacuaugcagccauaaaaaaggaugaguuaaaguccuuuguagagacauggaugaagcuggcaacuaucauucugagcaaacuaucacaaggacagaaaaccaaacaccacauguucucacucauaggugggaauugaacaaugagaacacuuggacacagggcggggaucaucaugcacaucagggcccguugugggguugggggagcagagagggauaucauuaagagaaauaccuaauguaaaugacgaguugaugggugcagcacaccaacauggcacauguauacauauguaacaaaccugcacguugugcacaucuacccuagaacuuaaaguauaauaaaaaaaaagugcucuauauccuuuacuacauuuaaucuucaaaacgugcacagggaagcacagggaacuugcuaauauauaucauaaaguaaaauuauuuaauaaaucuaugaaauauuuacuaaguacucaauuugugaauacaauaaguuuccucacuccauauucuacccaauuaaaaaauauauauggaugugaauauauguuuguguauguguacauauguguaugugucuaugaauauauucacauguauucauguauauauauagacacacacacaauuucuaaaguuucaccuuuaccagauuuagagaauaauguaaucauagagaucauuaagucaaauuacuauauuuuacaaagaaauaaaauauaaucauuacgaauuucaguaaauuuccaauaucacacaguuauuuagagucuaaaguaagauuaaacaucauacauauaagcuaauauuugucuucauuacaaauauauuagauuuaugauuauauauaucugucauauaacuuaugucuucuacugaauuauugaaauuguugcuauucaacaaauaagcaaugugguauuguuauuugcuacuaucuucuaacagauuaacaagguaagauuuuuaaaacugcauucagcacuaauucauggugaaaagcauuugccaucuucuagacaugcucucagaggauaucaaaguuaguuaucauaaauaaacucuaaauugaagaauugaagguacauguucgauaacugaaaaauaagaguuaauuuuucaaaacauaaaggaaaauuauuucuauuauucauaaauuuucuuuuccuuuucucaauaacuauuauaaaucucaggaaauguuacauucgugucuuacugauaagugggugugucauaauuuuuccuauaacaaggacuuaggggaaucaauuugaucauaccagaaaugacuguaaguuuugucuugaagcggauauugcauaccuaauacacuguauuuguauuucuuuggggugacuuugggguaucaaaguuaaugaguauggcuaaagcucaugccccguagcauccagacagccagucaugucaucaacuuaacuuacuggguuuucagaauucuuggugguucuacuguaauucgaacuguuuaacaaauguuauagauuauuagcaaagaauauuaauugucuaguucuauagccaguuuccaaaugcuaaacuaauaugagauccaaacauuuggucuauaguuugcacuucuuuuuuuaucuauucucuuauuuagacaaccaugccaaaagguucucuauauuauuguuaucaauuuuauuuuuagcauuuuuuccauuaacuuaauauuuacagugugauuggcauugagcuaaacagguuauuuccuuaauacuaaaacacagcccuaaaaaaguagauauuaugcuuacuuuagagacaaagagauuaaugauuggaaaggucuagucauacuuccaaaggggcuaccuccaagaaauggcuagggaagaagccuagauucaauuccagaucuguuagaaacuaaacucugggcucaagagaccaucagucucauucaaacucaguacagcugacuuugauuuauuaucuauuucauuuauaucuggguauauucugggaagaaguuguguuagucaguucuuaugcugcuauaaagaacugccugagacuggguaauuaauaaaagaaagagguuuaauugacucacaguucugcagggcugagaggacccaggaaacuuacaauuaugauggaaggggaaguaaacacauccuucuucacaagguggaaggagagagaagugccaagcaaaggggaaaaugcccuucauaaaaccaucagaucucaugagaacucacucacuaccauaagaacagcagugugcagguaaccauccccaugauucaauuacuucccaccgggucucucccaugacacauggggauuaugggaauuacaauucaagaugacauuuggguggagacagagccaaaccauaucauuccacucuccuuaccccuccaaaaucucaaguccucacauuucgaaacacaaucauccauuuccaacagucucccaaagucuuaacucauuccagcauuaacccaaaaguccaagucuaacaucucaucugagacaaggcaagucccuuccaccuauaagccuguaaaaucaaaaacaaguuaguuacuuucuaguuacaauggagguacaggcauuggguaaauacacccauuccaagugggagagaaauuggccaaaacaaaggggcuauaggcccuaugcaacucugaaauccaauagggcagucauuaaaccuuaaaauuccaaaguuaucuccuuugacuccaugucucacaucuaggucacauugaugcaagaguugggcucccacaaccuucaggagcuccgccccugugacuuugcaggguauagcccuucuguuggcugcuuucauaggcuggcauugagugacuguggcuguugcaggugcccaaagcaagcugucaguggauccaccauucucuggucuagaggacagugguccucuucucacaacuccacuaggcagugccccaguggggacucugugugggggcucugacccuacauuuuccuuccacacugaucuggcagugguucuucaugacugcuccaccccugcagcaaacuucugccuagacauccaggcauuuccacacauccucugaaaucuaggcagagguucucaaaccucaguucuugccuucugugcaccaacauuaccuggaagccaccaaggauugggauuugcacugucugaagcuauggccuaagguguacuuuggcccuuuuuagccauagcuggugcugaagcagcugagacauagggcaccaucucccgaggcugcacagagcagggggacccuggguccaguccaggaaacaauauuucccuucuaggccucugggucugugaugggaggcacugccaugaaggucucugacauguucuagauauauuuuccccauugucuuagugauuaacauuuggcuccauguuacuuaugcaaauuucuguagugagccugaauuucucccuggaaaacggguuuuucuuuucuaucacacuguggggcugcaaguuuuccaaacuuuuaugcucugcuuccuugagagcuuugccacuuagaaauuucuucagcaguuaaugggugcagcacaccaacauggcacauguauacauauguaacaaacuggcauguugugcacauguacccuagaacuuaaaguauaaauauauauauauauauauuuuuuauauauauauacauauaaaagaaauuucuucugccagauacccuaacucaucucuuuuaaguucaaaguuccagaaaucucuagggcaggggcaaaaugcguccagucucuuugcuaaagcauaacaagugucaccuuuguucuaguucccagcgaguuccucaucuccaucugagaccaacucaaccuggacuuuauuguccauauaaccgucagcauuuuggucaaagccauucaacaagccucuaggaaguucugagcuuucccacauuuuccugucuucuucugagcccucuaaacuguuccaagcucugucuguuacccaguuccaaagucgcuuccacauuuucagguaucuauacagcaacaccccauucucccaguaccaauuuacuguauuaguccauuuucaugcugccaauaaagacauaccugagacugggugauuuauaaaggaaagagguuuaauugccucacaguuccacaaggcugaggaggccucaagaaacuuacaaucauggcagaaggggaaacaacacauccuucuucacagggcagcaagagagagaagaccagcaaagagaaaaaagccucuuguaaaaccaucagaucucaugagaacucagucacuaucaugagaacagcagcaugggaguaaccacccccaaaauugaauuaccucccacuggcuuccucccacaacacaugaggauuauggaaacuacaauuuaagauaggauuugggugcagacacagcuaaaccuuaucagaaguuuuccuugauaaaggggaaaaagauuggauaauaagauaaaaacuagaaauaaagaaaagccuauagaaaagaucaaugaaacugaguuuuuuugaaaacauaaacaaaauuuauauaccuuuagcuagacuaacaaagaaaaaaagacuaacaaaguaaauaaaauuauaaaugaaaaagaaaacauuacaaccgauaccacggaaauacaaaguaucauaagaaaucacuaugaacucuuauaugccaacaaauuagauaaguucaaagaaacagauaaauuccuagacaugaacaauauaccaagauugaaucauaaagaaauaggcuauuugagaucaauaacaaguaaagagauuaaaucaguaauuaaaacuucccauuaaaaacaaagaaagccuaaaacacauggcaucacuggugaauuuuaugaaguauuuaagaacaaacaauuaacaccaauucuucucaaaaucucccccccaaaaauugagaugggaacacuuccaauguaauuuuucaaggccaguaacguucauaucaaagccagauaaggaugcuacaagaaaagaaaaucacuggccaauacuucuaauaaacacagauguaaaacuccucaacaaaacacugaaaaagugaacuaaacaguucauuuaaaaggucuacacugugaucaacuggaauuuauccuugagaugcaaggaugguucaacauaugcaaaacagaaagugugauauacuauauuaauagaaugaaggcuaaaaaucauaugaucaucucaauagaugcaacaaagcauuuaacaaaauuaaaaguucuuuuaucauaaaaauucucaacaaaauaguuguagaaugaauauacuucaacauaacaaaggcuauacauggcaaaccugcagcuaacauuacucuuaauggugaacagcuuaauucguuuucucuaagauuaagaacaagacaaaggugcacacucuugucacuucuauucaaccuaguauggaaguccaaguuagagcaguuggguuuaaaaaaaaaacagauagaaagcauccuaauuggaaaauaaguuaaauaaucucuguggaggacauaauaccauauacagaaaacccuaaagacuuuaccuuuuauaacuagaaaacuaaaucaguaaaguugcagauacgaaaucuacauauaaaaucuacauaaacuaagaaaauguucccaugauaauagcaucuaaacaauaaaaugcucaggaauaaauuuaaccuaggaggugaaagguccauacacuaaaaacuauaagguacagauuaaauauugaagaagccccaaauaaaugaaaauaccaaagcaaucuugaaaaaaaaaaaaaaaagaaagcuagaggaaccacacuuccgaauuucaaacuauguuauaaaacuguaguaaucaaaagagcaugguacuggcauagaauagacacauaaaccaaugaaacaaaauacagagcacagaaaaacacccacccaugcauuucugaucaacuacucuuugauaaugccauuaauaauacacaaugaggaaaaagaugucuccacaauaaauggguuugaaaaacuggauauccacaugcaaaagagugaaauuggcccucgucuuauaccauauacaaaaauuaacuccaaauguaugaaagacuuaaauguaagagcugaaauuguaacacaacuaggaaacaacuuaggggaaaagcuucuugccauuggucuuggcaaugauuuuuuggauaagacaccaaaaucacaggaaauaaaagcaaaaauaaacaagugggacuguaucaaacuaaaaacuucuguacagcaaaggaaacaaucaacaaaaugaaaaggcaaccuacggaauggaagaaaauauuuuuaaaccugauaaaggguuaaugucuagaauauauaaggaacucaauuacaaaacaauuucuaaaaagugaagacacauuuucaaagaagacuuacaaauggccagcagagaccaagugcaguggcucaagccuauaauccuaguaccaugggaggcugaggcgggcaaaucacuugaggucaggaguucgagaccagccuggccaacaugguaaaaccccgucucuacuaaaaauacaaaaaaaucagccagaugugguggugggugccuguaaucccagcuacccuggaggcugaggaaagagaaucgcuugaaccugagagguugaguuugcagugagccgacaccgcaccacugcacuccagccugggugacagagugaggcuccaucucaaaaacaaaacaaaacaaacaaaugaaaaaccaaauggccagcagauacaugaacaaguguucaauauugcuaauuaucagagaaaugcaaaucaagacaaucacauuacaccuguuagaauggcuauuaucaaaagacaagaaacaacaacguuugggaggcuguagagaaaagggaaugcuuauacuccucuguugguaggaauuuaaacugauacaauuauuauggaaaccaguuuggagauuccucaaaaaauuaaaaauagaacuacuguaugauccagcagucacacuucuggguacaaaucuaaaaaaacugaaaucaguauguugaagggauaucugcauuuuuaugcuuuuugcaacauuauucccaauagccaagauauggaaacaacauaaguguccaucaacagguguauagauaacaaaaaugugacauguaugcacacaagcacaaacacauucacacgcacuguaauauuagccauaaaaagaaggaaauucugucauucgugacaacgugaaugaacuggagggacauuuuaugaauauaagcuugauaaacaaagaaaaauacuguacaaucaaucucacuuauaaguggaaucuaaaacugucaaagucauagaugcagaaaguagaaugauaguuucaaggggcuaggaaaguggggagauguuggucaaaucauguauacuuccaauuagauuaacaagucugaaucuaauguacagcaugagugguaaugaauguauuaacuugauuuugauaauccuugcaaacguacauacaaauaucaaaucauuacauuguacuccuugaguauauucaauuuuuguuaauuacauauuuaaaaauuuuuaaaaaugugauuccuucagaaaaaguuacaaagucagaagugagcaaaaucagcacaauagaugcagaauccugguauugcaggauuuuugaaacacauuuuaaguuuagacugauaaaaccaucuuaguugaaauauauucuggacacauuuuacaguuuaguuuacauucucuacagugcucucaaucaaugcacagcaucuuguuauauugcaugaaauauaaauuacaaauaucuauugaagaauuauuugaaacauauaaugcuauugucuuugggguuuaauuuuguauauugugaggagaugaaaauaaagcccuaaggcagaaacacaguuguaugcuucaaugaauaaauuauauuagagaaugugcuugagagauggcaagaaacuuaagacaggccgcucauguaauaaacucagucuccagugaaaaguaacuaacuuuguaggcugcagcagaaacauccuaucaauaauuuugcuauuuucgaagacaucucuuaucauuucuccacaguuaaaaacacaauuaaaacuuacuuuucuaguggcccacuauuauuaagaccacuagcaaauguacuaugccagagugaaaaaaugugauucuucaagucacagauucuuacuuacaaaggaaggagugggcagacagccauuacucugaaguuagaauaaagucuaugaguguugggaagaacauaccucaugagacauauauauuuuuuuagcagcaacuagaaucagauaaaaaggacugaaaagaagaaaauacagagauggagagacaaaggagagaagacuaaagacaaguagagggagggaaaagaggucaugggaagagaccuggaggagagaaggcucagcugguuccaaagcguggguuagguaaggaaaauugaccuugguaaaauucgguuacauugucaccaugagagguaauaaugauacugcaaauguaaauuggcauaauauuuauagauuuacugaucaaauaauuuacauguuccucucuuuuucucaguuucauuuccaggugcucucaucaccccaaaagugggcaaagacuuucauaaagaauguuuauuacagcaucauaaaaagugacaaaauuggaaccuaucuaaauauguaacaaagcucauaaucuagcaacaaggaauuaguuaaaaaauauauuauuaaaauauguaagacuauggaauaaugcuuauagaauuccacauaagacaauaccauuacaaaugagaauauacaguuaaacuguaagauucuaauuugauguacaaaaauuuuaaaaauacgcuaaaauacuaucaauaccagauuguaagauuaugaguaauuuauuucaguuauucaacuugaauguuuuauaauaaauguguaccauuuguauaauuuuaauagcuauaaaauauuagcucacaaaagcuuuuuacauguacuuaaaacuugaggaacuuuguuuauuuauucauuuuuucauuuaaggggcagucuuauguugcuuucguuugccaagcauuguuccaaacauuuuuaaaaauauuauccaaauuaauccucauaagaacuauaugagguagguccuaguauuauaccacuuuuacagauaaaacagaaacacacacagagagacuaagucauucagguuacacuccaucaugugguggaguugggccuuuaaaucagaaagucuaacugagaaucugugucucuagcacuguuuucuccuacucuguucugauuggaccagaugaagggcauuuuaaggacauuaauuugaaagacuuacuuuucauggcagaauaccaacucucuauagauuagauaaaaucaaacuugagaacuggauccugcucccagagaagugguuccucauuccugcucuacagguauuugauaaauaggcaaauuaaggugaaaacagagaguaaauccugagguucuacacauuuguguucaucaagauaggaugguacccgauuuucuuucuuucuuuuuuuuuuuugauggaauuuugcucuuguugccuaagcuggagugcaauggugcaaucuuggcucacugcaacccccgccuccuggguucaagugauucuccugccucagccucccaaguagcugggauuacaggcacaugccaccaugcccagcuauuuuuuuuuuuuuguauuuaguagagacaggguuucacaauguugaucagguuggucuugaacuccugaccuuggugauccacccaccucagcugcccaaagugcugggauuacaggcaugagccacuguaacuguccucaguuuucauugcaaauauauaacugaaacauuuaccuacccuagagacacaaagaauuaccuuacuguaacaacuauugugggauacauaauuaguguuuuaccuaugaccauuaaagcuuuugacaagcauuuguacuaucauggagcagcaaggagugaugagaaaucaccuaauuuacaauggcaugcuacuaaaugagauugaccuaucuugugucgacaaugacuuaauuccugacuuaacagaaccucaaacugugaaaacaugcagcuuuaauuauucuggccagcuaugguuucuuuaaaaaaaauugacuucuggucuuuauuauucacauaguuaaauauugcugccuggcuagucucuguuaauaauaggaagacuaauacaacaguucaaauaaauauaaacuuuuuucauugugcaaacuuucuacaacugcucuccuuuuuucagaaggagcaaacuaacuugcuuuggacaacucuuccaacuaguuacgguguggcugccagucacagaaccuucccuuaugacacagagauuaauauuauagacauggaguagagagugguagacuugacccaaguggggcaaauuaacauccaucccucccucuugcuguuccuuccuucuuuccucuuucauucugcuacuuuacuucucuauaauaaacaauuacuucuucuugagaauuggauccugcucccaggcuagugguuccucaucccugcucucuacauauuuaauaaauaagcaaauuaaggugaaaacagagagcaaauccugaggcuuuacacauuuguaacccaccaaucccaagugaugagucacaauucaacuaucaauuuuauagaggccuacccuaugccuaaugauuuauguauuuauaaguuuacaucagcuauuucuccauguuucaucaucuugaggguucagaauucaaggaaugcgggccauguaagcacugucaguaugcuaugauccaguuugagauuucaguggccauauggucucucugaugcugauaccuggcucauaucuuccuuguccucuccuuaagaccccaaacacuaugauuccuuucuuuacugagaugggccagaaaaaucugccacaaacccaauggccacuaugcccaaagucuccacuuuugccucuuguucgccuccugugcuuucagagcaacuaaaauaaauguuugagccaguaggugguacaaguacuaucaaagauccaagagagaauucugaaaugaaaagguaugagaauuaagaggaggacaaugaggacuugcaguauugaaagaaagccucccugaacuuacuggaguaccacagaaaguggauuaugaugauugaggugggaagaggaauacaucauugagacuggggcuuugugugacuuucacgcuacacagcugcuuuagaccaguugaguguagcuauuucauguuaauuaaaccucuuucuaaaauuaugcaguaaguguagugagaagugguguuuauagggcucuucaauaagauuuauuuuuccaagagcugaaggagaauuaauaccaagugauaucugccauguauauaaguguuuuuauauuuacuuauauuuauccucauacaacaaaggaugugauaggacuaacaucucauacuuugaauauuuauagcauuuuuguuucuuuugcuauguuaguuuuccauucaaaaagaaaauguauuuaucucuccuuccuaggugaugaaaaucccuggagaucaaguguuggauuuuacacauccucccaaaaccaaccacagaguuuagcaagaaacauucaauaaauauuuguagguuuuaaaugauuuggaauccugaugacagaauaaauuuacauuuauaaaugagcaugaucaauaagcuuaaagcaaaaauguauuucuaucaaauaaaucauuagcaucuaaagguaauaucagucgguuuuugcuuucgguggcuaaaaacacaaucauaugauuacaguaucucuuuuacagaggaggggagcaucuuaucuucuguucccucuugcuuccuuugccagcccauuucuaaaacugugccugcauauauauaaucugaagauguagucacaagguguaggcagguguaggcuacuucuacggauuuaucucggggaaaacugaacaaugcugaaguccaaagguagaauuuuuaucuguaaaugaaaaacuguuucaaacuuuagccucaaagaauuaaacuuuccuaccaccuauuucucauucuagcaaugaagcaccuuugaaaucaaagggagcucuacaaggagacaggaaaacgggaugaagaaauucaaaagcuuuaaacugcuuuccagcauuauuugaaaauaugcagcgcacauaaaacuauaccaagacuuuccuuggagcauacauuuuaacacacaucugaauauuguaucaugcaugcagggacacuguuucuaaauaauucacugccacuuuuacaauucuuuuaauauuucaugauuauaucuuuaaaauuauaugcaucuauauuuccaggaaguauaaucuaccaagcuccugcuagacuaauuccuggcacacacagcuccucuuguaggcacagaucgcuucugguuaccugcuuuucauuuguuuaaugcaaauuuauugagggccaacaaugugucauggauucaaagaugaaaaugcaccauugcugucaugauuggcccgugauccaaggcaaagagaugaaaacaagagauuaugugcacuaggggauuguucuuuaccuccuaagcccuuuuugucucuaguccacccuguguucuugcaacuaugcuuucuacauaauuugcauuuuuaucuuauucacauuccaucuucucauuuuacugcaaugaacguuuccucagaugauguguuccuuacaagucccucagcugguguauucuauugcuucccuuuugcuagauaucugggaaguuauucuuuucuuucuucauuucuuuuauuuucccguuacuuuuagguguuuuagacgugcacguucauuccacuucaagaaucaugaccuccucaagucuaacaauacauauuuuaccucccgcucucaauuccuggcauuuacucccauaaaugaaauugagaucuuuucacuaagacuuauuuauuuauuuauuuuuuaccugcaagaucucagauuuuucacuuuugcuucucaauauaaucuucauugauuaugucagucacuucucuucauagcacuacuggaauaauucacucuucagaguauaucucuuacuucaauccucuuccaaguuccagagagcacuuccagcugcacacuauuugucuaagucuaguaaucaauugaccuuaugauagagaaaguauucugaagagccuauuuauauuagucuguucucaaucuccuguaaacaaacuaccuaugacuggguaauuuaugaagaaaagagguuuaauugacucacaguuccccaggcuauacaggaaccagggcugggaggccucaggaaacuuacaaucauggcggauggugaaggugaggcaugcguguuuuaccaugguggagcaggagacaggaaacaaagaaggaugugcuacacacuucuaaacaaccugaucuccugagaacucacucacuaucguaaaagcagcaagguggaaaucuugccccccaugaucaucuccuaccaggucccucccccaacguugggaauuacaauuuaacaugagauuugggugcgaacacauagccaaaucauaucccuaaucuaauaaaauaagcagugauuuucuaaacugccagcaaaagcagaaaucagaaagacugaaaucaagacagggauuugauguaagggggguuuuccauugcugaagaaaacugagaccucauuucuacagcugcaagaaacugaucugucaacaaucugaaugcgcuaaaaggagacuguuuccagagcuuccaaguaccuuaguccggccaacacauccacuuccaccucaugauacccauaucagagaaugcaguccgguccacauggacuucugaccuauagaacugugaguugauaaguggguguuguuuuaagcugcugaauuuaugguaauuuuuuauccagcaacagaaaacaaauauaauucauucaacacaacaauucuaucuaaauuuuuuucuaaauuccagaauguguuuuccaucauguuucuauagauguaaauaacaccacaguccuuccagcauggucacugagauucauaucugucuugcuccacacauucauuaaaauuaauaauuuuauucuagaaccauagaaucuaugucaucugcaucucacuuuccacucuauucucuuuaccaugaagcauuuaaaauucaccguaucugcuauuugguauaauaaaagagcuuucucacuuuuauuugaucuguaccacauugacaauggaaaucuccuaacaacacacuuuaaccaugucagccucuucucuggaaaaacaauuaaaaauaauaaaaugagugucaugccucaguucuuuauuauggcauucacaaagaacccaccauauuucuggaucuaaccaacuuuuuagucaaauuaaaaagcauauuuuucccugaaaauucucuauauauuuccacuuacguaccuuucuuggaaauagaaacuuuuuaugccugaauaaaucuuucaacauguggagaaaguuuaauaauuccauggaacauauauuacuuaauuuguaccuucauugguaauaugaaauucaauaaauguuuggucaaugauaugguuuggaugugugaccccugcaaaucucaucuggaaauguggccacaaauguuggagauggucucagacgucuagugagagauguuuggaucauggggguggaucccucaugaauggcuuggugcuguccucuugguacugagugaguucucacucuauuaguucaugucagagcuaguuguuuaaaagagccugaaacuuccuccuuuuuccugcuccuucugucaucaugugauguaccugcaccccuucauccuccaugaaggguaaagacuuccuaaggcuccaccagaagcugagaagaugcuggugccaugcuuguauagauaaaucucuuuucuuuauaaauuacccagccucagguauuucuuuauaacaaugcaaaacagaccaauacacuuaaccagcaaaucaauucagacucuccuuauucuuccuaaagagaggaguuuccuucaaugcaucuguaggguacuuuauacuuuucccacauugcaugugggaaaaaauucucuacuccugacaccuucuuugcucacuguaagaaucagagcaggguguuuuacucuucucuguauuccucaguaaauccuaugggagauuauaucuaguauaauucguuucauguuuuugaaauaauugaauauaguuaagcaauuuaaacucuaugugagaauucuccuuacauuuacaacugauauuccagguacuguucaccccugucaacuaaauaaggccccauaaguucuuauuuguggcgcucaaggaauccucuucuaguuaaugucucugugccugaggacaccuugguggccagggagcagcuuugaacaaccugcauauuuuggggaauuucagaaguucauuuucucagcuucccuugcagcuagaguagagguauuugacuuaaaugcccaacagaaagaaaaacacaagacuuugguucuagagagauaaagcaauuucugugccaaacugauuuucugacaaggcuagggucagagccagcuggucuucccaggccaccccgggcagcuuggcacgcagugccagaaucaucaggcaucuacagcaguggguauagcagugcuggcuucacugaggagcucuggggagauguagguguuguucuuggugguggcauuucaaaucugauuguagcugucuagaaacuucaguaaaaaagucccuuuaauaaaucucuuucuguuugaauagcuaguguugcugcuaucauucacaacuagaauccugagugaucaguaccuaagcauggaaaaauauaguuauuacaaaagaauauaucauauuaguuacuaauaauuccaaaugcauucccuacuauucagaauuagaacugaguccauauucauaauuguaguauguuacuauguuauuauauauuuucauauuuucauacuuuuuuuauuuaacagauuuuguugagucccauaaccaaucuuucauagcaauuaugauguaccaggaauuuuacuaaauuuuauacacuauuaaacuccuucgaucuugaaaaugucucugugagauaggugcaauuaucaaagugauccccauuuuaaaagugaagagauagagguccagaaauguagguaauuugcacaaaaaucacacaaugaguuagcagcagagaaagguucagacuuagguauuaggcuaaaaucucacucuuaaccacuaugguaauuuuguguggaggagucagcugcauuuagucauacgcuugcagaguaauaaaguauagcuacaguauuuucacucauugucuuuugauaugcuugaaaaugaccaaucuuagcgcuacucaagcucuuuggaaaauuucuuacuuuaaugugcauguaagucauauauaaaacaaaacaauaauucagaagauacuaaacucgaaugugcauaaagaaacugcagaugaaaauuaucuuucaaccaaccaacauuuauuagacacauauucuaugcuggacaugauguuagaugcuguguauacaaauaaaaaugggauacaauaaugucuuuaaggagacgucaccuagggaaugacaucaacagguaagcaaucaagaaucuuucaguaugaaauggguuaccauagauuuuaugguaauacuauggaaacucauuuuuagucaagggaagguccccagauucuacagacuucauuuucuauuucacuuaaaaaagaaaaaagaaagcaacucaaagaaauugaucuaaaacaaauacuuaauuucauacaaggagagguaaguucuaauaaauagcaaauacagucuggacacaauguuuaucacauuuccaauacaucaauucaagugaugugguugugguucauaugaaccucaaaaauaaugcaucaaaaugaaaggauuaguuuguaugaaagaggauauuuaucuauagucucuaccaccugaaauacaauuuagcucacauaauguacucaaaaauauuuuuuuugcagcuguacaaauaugagaaaauggcuagaacagguuggaggcuuucuaggacucuuagcuggguaugaaaauguggguaauuauaauuugcuuuuugcuagaaucuccaugaggauaaugaccauuuaauuuguucaugacuacagaaugcaccaaaaaaaaucugcccauaaaauguaaauaaaacuuauuguauuaguuacauugucaguuguuaaccagaaauauuucaugucauaauugcauuugauagaagugcuaaauuaugggccaggcacaguggcucaugccuggaaucacaacauuuuggaggcugagggaggaggauugcuugagcccaggaguucaaaaccauucugggcaacauggcaaaaccccaucucuacuaaaaguaccaaaaaauauagcuagguacugauggugcacaccuguaaucccagcuacccaggaggcugaggcaugaggauuguuugagccaagaaggcagaggcuauagugagccaagaucacaccacugcacuccagcuugggcaacagagccagacccugugucaaaaauaaagaaaacaugcuaaauuaugucagauugugucuguuugagacacugccacaaaaaaagucuuuuuuuuuuuuuggagacagggucuggcucuaucaccuaggcuggaaugcaguggcacgaucaccacucacugcagccucugccuccccauccccggcucaagugauccuugugccucugccuccugaguaacugggaccgcaggcgugugcuaggauaccuggcuaacuuuuguauuuuuagagagacaguuuuugccauguugucccagcuggucucaaacuccuaggcucaagugauccucccaccucagccucccaaagugcugggauuacagcuguaagccaccacacucggccaaaaauaucaacuuaauugucauaugaauagcuucuguguggcaaaaaugguuaagacaauagaaauaaaagauuuaagguugugauaauucauguaacaaauguauacauaguuacaccugaaauauuuuugaacaacuuuguaucucuaucuugucaacagugacagagaaagagaugauaaaugguaaugaacaaacaaauacauuuugaaugcugcagcugccaggacguaucuuagugagaacuaaaccuuccuuuuuguaaaucagugagauuuuggugguagcuuguucugcagcauaauuuagcaucuuucuaucucugaagucagucaguuauggaguauaguuaauucuacagaaauaucuguuuaaucugcuuucuuuuucuucuacccugcuuuacuuaaauccaucaacauuuuucacuugaaacagcuauuaguggucuuuugcuaacaacuuuguccuaauucaguucauccuccacaaggcauacuugguuauuagugaaauagucuguaugcuauuuccauguuuaaaaucuccuaagaauuacagauagcucuaagacaaaaugcaaauuuaucagacagccccacaugauaucaaggugucuccugccaccucccauacaaucuucuccaucacuuucccuugaacaccuuuucccuuguuauuuuguaauucaaugcuuugcacacaugccaauuugucuguucagagugcuuuuccauccugugucccucaguagucccaacagaaaacuaauaagauuuuucuuacaggugcaacuggcccacccuuuuucagugcaaucaaaaucauguauaauuaaaaagaauuuuuuuuucuagauggagucucgcucuguugcccaggcuggagugcaguagcgcgaucuuggcucacugcaagcuccaccucccggguucacaccauucuccugccucagccaccagaguagcugggacuacaggcgcccgccaccaugccuggcuaaguuuuuguauuuuuaguagagacaggguuucacggucuuagacagaauggucucgaucuccugaccucgugaucugccugccucagcuucccaaagugcugagauuacaggugugagccaccgcgcccggccaagaauguuuucuuaaugagugcuucacuugccucugagcucugcuugaaaugcauuacauguauuaacuuauguaauccccacaaagugaauaagguagucagcauuauuaccuccaugguauagauaaggaaguugauuuucagugaaaucaaugagguucuacugagguuauucaguuuuuaaguggccaagcuauguuucuaaccuaggaagucauagucggcccucuaagucccuauaccguuauaucacuucuuuaauuauagaacugcguuucagaagcuagaucuucuuuaucuucauaucuugaucuacaauagcuccuacauauggguggaauuacugacaccagcugguccaaaguaccccaggagaagcugacaaaaaauucaguuuccgcaucaagaugauuucaucacucuuacccuaaccaaucaaaaccccaauuuuacagccgcucacccuccacaauccccuuaaaaacuccagcccagaacuccucagggagauggaugugacggucguucucauguccuugcuuagcugcccuauaaucauuaaagucuuucucuguugcaaacccugcugucucaguguguuugucuguuacugcacagcaagcauacaaaucuggugguccugugacaccaucucccucccugcaacuuagaaguaaccgauagccuucacuuucaauaaagcaugccuuucuguuucuuucugguuuuaucauauaugcauauauuccuaaaguauauacuguuaaccuguuuuuggauuuuauguaagugaaaugacauuguauguauucuucuaugacuuauuuuaaucaacauuaugauuuuucuuucauguguauuuacuugaaguguauucccuuugaauuucaaauuguauuucuuuauauaaaauguagcauaugcuuugaacagugaugauguuuauggacauuuaaguuguuuucauuuucggguuauuauacaauacacacugcuucucugcauauuuuuaauacacaucuucccauaaacaugagcaggcauuuuucugggaugucuuccuaucauugaaauugcuggggcauaaggugugaacaugucaauuuuaucaaauaauagcuagaauccauaagauuuugucugcggacaacccucaggcugccagaacccaucuugccugaacauaaggguaguugggaaauugggaaaaguaaccaacgucugauagauguaggcauauaaagucuccagcuucuagccccugcuucagacagcugugacaugugacuuaucucaagagcuucccugugggaucugagccaagguuacauuccaugacauuuggcacacugacuuuacuucuccaucccacuuuccacucccuugcuaguuuuccccaggaacacuuucauugucaucuuuacaugugaauccucuucuuaacaauaauauauucuguacuuuuaauguuuuguaccaugaauguugauuugcgaggucagaguauacuguggagaauacuaaguaaacucagggccaaaaagagagccauagaauuagcauaguguuggcaaaaugucgauauacagaacugaaugguuuaaaauaccaucaacauaguugaucuuuauuuucaacauuuacuaauuauauucuaauucuccacuaagcuauauaagguagagauugcucuuuaucaugagauuuauguugcauuaucuauguucagauuuaggggaaaauaguuauauucauauacuuacauuaugucugugauuagcguuuuuucuuuaaauuuuucacugaaaacucuucaaaggcaaugggugccccugcuuucuacuuucucugacuacucugucuauagcauaugaagcugcaggucauauucagagaugcugcauuuuagagcagaacuugaugaauguuuaaggcaguacauaauugauauaaaagcacaauauacuaaauucuuuaaaauagauauuuucaaagaucaaauccuauuuuugcuuuauaccugugaaaaugguguuuagaguagauucuugcuacuuugaaguacuuguauuguuuuucugaaugaauaaucgguauaauacauuauuccucucgugguuugacagcuuuggagcauucguaucauaguuaguaccucauuaugaaaaaacacaguuagauaggccuuaguuuuuuaauccuggcuucacuacauacaacagacaccaugggaaaguuauuuaucuguauuucaguuucuaccucugcaaaaucauaccuacccccaugacuauuaauacuuuaauccccacuuuggggcuuuuauucacaacugauauccuuuagggucauguuauuucugacacugauauguuucaguagagaaauaauucaaugauuuuuauuuuuaaugagguauauuauccuuguuaaagaaugcauucucuuguaauuauuaaauaaugucuuccuaucaacuucuaaucaucaaucccucuaaacauaauagaaauuaugcauauacaaugauuuggacagacuuuuuuacugugauaauaaacagaagguugcauauaauguucagacauagagauaugauaggagauaauacuauuucuacauaguuacagaguuuacacaaugccagaguaauuaauccagguccauauugcuaaggcuaagcccaugaaacagacuauccaagggcauuuagccuagucugcacagagagaaaaugucuaaugcuuugagucaaucugauugcaucaaaagggauuugcuuucagcuguucagaucaaugaauacuagauuuuuacccucaaaaucagcagcagcugucucuagaacccggugagagagacuggcugagcauaccccaacauaaucucaagaaacaucaguuuguaacauguucuggaaaaguaagacacauccuagaguccugucuucuuuaacaguaaacaaaaugccuuaacugaaagaaguuuuauuugauggucccuagaguugugauccacauacugccuacucuucauuaacucuaacauauacuucuugacaccacuuaugcugucuaaucccacccugggccagggaccacacuuggucucuggcccccacagcugcccaaaggcuggagcuagugcugaaugcuacauuucagacacccagggggaacccccaaacccuggguuuugcugaagguuuuccaaugucaaggaacagcuaucgcauucuugccucugccauucuugcuuuuccugauaaaaugagacugcccugcaaauugauguuaaguacuuagccuccucaguuauuauaauucugccaucucuuagccaccaccaggcuauaaaugaauucugacucuccccaaagauuaaugccacugcauaugauuacacccugcacauccccagggucaccauucccacaggugcaggugucaauaccuguggcuacucagacuuggcauguugcuagaaggacuaacacaugccugagagacugcagaucuaaauuugcuauuuuauuuuaaauaauuuaaauguauauuuuaaaacugauaauucauuuauaggagaacauuuuagauauuuugggagcaauuuggcuaugugaguccaguguuuaaaccauaaauguugugaaauuuaaauauagaugaaguauuucugauggaaauuuaguuucugaaucaagauaaguguaacauacacaccagauuuuaaaaauuuaguaugaaaaauguaaaguagcaaauugauaauuuuuauauugauuacauaacaaaaugacaauauuucaauauuuuaguuuaacuaaaacauauaaaauguauuucaccuguuucuuuuuaguuuuuuuccaugcagguauuagauaauugaaaauuacauauauggcucaccauguauuuuaccagacagugcugacauagacuacaacauguucugaacacaaaguaaaccacaaauauuuguuaaauuauugaugccccuucaaaaaaaauaauuauuauuuucaucgaguaagacaaguaucuauuuucuuuugauuaauacucagaugccaccugaacuaucuccaaauuuaugguuggggacacucaccagugugcuucagaccaacagugccuugugucauaaugaugucaccaucucagagucucuaaaacguucccuugucaacuuuucagauguuuuaaucccacaugcaaaugaaucuuuaguggugguaugugcuuagcucaaugcaugcuuauuaaaugccuggauaccucauuuucuguaguuugagcagccuuucaacacugauuuugacacuuagucuuaucauuuaggccuuuccagguccugaccuguauuauuguacauuggaacuauaugcaagggccauggcugaagggaucaauguugguaucuugguccguauuucaccucuaauagaauugaucuuagccuauuuguucagauugcuucuuugacaagacaaagccaaauguagaucagcuuuguuuuauucaugccauuuugccuaaaauaaauaguucagauuuacauguagcagaguguuuuuuuuuuagcuuuuucuuuuuuuuugauauaagaugucauauaauaaagaaaaggaaaaagaaagauugcaauguucucucccagccugaauaacucagaguuacauaaguguuuaugaauaaugaaugucuaauugaggugccugaaauaugaaucacuguaccauuccaaacggcagugagauguagaauucucauucggcaacaggauuuuuauuucccgauuucugccuuucuguuauucccgcaguugaguaugaggucacacagauaacacuucugaagaaaucaaccacacuuuuuucuauuccaacuaagccauccaaacaaagaaaaaaauaguaggggggauucccaagaguugaggacaaaggaaccuaaaaucuacauuaauccaauaaacagaaacagcaucacaggguuuuagaucucaggcucagugagaaaucuauuugaauuuaaauuguuggcauuccagaagcugauuaacguauuucaggcuguugacaaaacauccugccuguuuaucacuccuuagugaauccuugccauuucauugauaaauugcugaggagaacugauaauuuccaaauguaugucauaucaguggaaggaaaaguuagaaagagcucacaaauacaugaaagugaagcuguaacaaagcaucagcauucuuuaucucugucauaaccacugacugugugcuuccuccacccugcguuuucuuucccagugcugcaaggagcauguugaguucugauuggcaucucugggucugucuaccuaaacuucucacuuggaaccacaagaugcuaaauuaagacugauacccaaaggauuauaaaucauucuacuauaaagacacaugcacauguauguuuauugcggcacuguucacaauagcaaggacuuggaaucaacccaaaugcccaucacugauagacuggauaaagaaaauguggcacauauacaccaugcaauacuauguagccauaaaaaaagaugaauucauguccuuugcagggacauggaugaagcuggaaaccgccauucucagcaaacuaaggcaggaacagaaaaccaaacaccacguguugucacccauaagugggaguugaacaaugagaacacauggacacagggaggggaacaucggacacagggagggggacaucacacacuggggccugucaggggguaggggcugggggauggauagcauuaggagaaacaucuauuguagauaacggguugaugggugcagcaaaccaccguggcacauguauaccuguguaacaaaccugcacauuccacacguguaccccagaacuuaaaguuaaaaaaaaaaaagacugagguacucaaagccugucuccaggccccugcauagaaaucacugaccaaaucggccaggcgugguggcucacgccuguaaucccagcacuuugggaggccgaggugggcggaucacaaggucaggagauugagaccauccuggcuaacacggugaaacccugccucuacuaaaaauacaaaaaauuagccaggcgugguggcgggagccuguagucccagcuacuccggaggcugaggcaggagaauggcgugaacccgggaggcggagcuugcagugagcugagaucgcgccacugcacuccagccugggcgacagagcgagacuccgucuuacaaaaaaaaaaaaaaaaaucacugaccaaaucacgaagauaagauaguuuugcugaaguugcaucauuuggacguauccaauaaacaucccuaaaacuggggcaccugcauauuuccucucaaguccugauggccacgauuugaaagccuaaaacucauacuucucuuccuaguuagugcuauuucuuugggaaugaaaccaacaaacacaguuugguguacaaaauaccaauauuugguuuccaauuucuuguuugaauuguugaaauucaaauacaggauuuugaauuaaaaaccaaaaguauuuugugcuucuuggaaacagucuuuagaaaauuauuuuccaucaucaaugauugucuuaaauaaucuauagagaagguagauaaugguaacuuugaaagauuuggucaaaugagucuuugcuuuacuuuauuuaauacuugauagaaagaaguuugggagaaaagaaugaaucaauucccuugggaguuucuaguuuuccaggaaguauggucauucuacuaaacaacaacaaaaugaaaggcaaaaugucacaaugcugaauccuuuauuugaaagggaagaaagcauuuagugauugauaaugaucauacaaugggauauuguuauuauugaugccagauuguucucaucucacacuaaauguagauccacuuacggcauaucuaguaggccucacauacuuuauauuuugugguugagguuuacuccuguuauucauuuucuuucacuuuguacugacuuacugcuuuuucccagguguguuuugaauauuaagaguguuagugacuuuaaaaauacagcuucugucagauucuagcguauuggugcugcauaucaguaguuuuuucuuauuuaaauucuuuucugguagagagaauguuggucucauuguucuguucaaaucuuuacugguucccacauauauaauauuuagaguacagguuugucuuuuuuuuuuuugccugccaccccacauaauacaaguucaaaaauuagacuaaauugauuucaauuuuggcuaggcuuuuaguauagugaaaaaaagauaugcuuuuaacaaauacaucauuauaugcaaauauuuaaaauaacuucuuuuacuuucagauuauuuaaaacagauuaaaaaacaugcaaagaaaucacaaaggcauucugaaugaaaaucuacucaauauacgcuucucagaaaugaaagagaaaugucucuuuuuguguucuaaaacaccagugggaaaacuuuaguuaugcuuuauaaccaacucaaauauuauucaaauuuuuccaaaagaaaaguucucacaaagucagggaagacaaguggaggacagaauagugaauuauuuugaagucagaagacuuaauuucaaauacucagauccaguuucuguuagcugugaccuuaggcaagaaucuaaacuuggugaaucucaguuuucuuauucaucaaacugaguuuuguaacuucugaauuucuuccuaggguuuuguaaggaucagauaaaauaauauguacauacaagcauuuauuucuacauuugugaauaucagcucuguucuuggcaucauccuguaugucaaguauucauggauacuugauacacaggacaugucuucaggugacacccacccagucucuuggggucagaaaaauaagucuacaauacaauacuucauuauaaguucugagauagagauagacgaaaaaacaaaacaaaacaaaacaaaacaaaaaaacacguggaugucuugaaaugaccaaaaagaaauacuuugccgucaguaaugacuuuuaaggaaguugacaacuuaagucacuaccaaaggacaggaagcuuaaacauguuaaugcuguuuaagaagacugaucuaucuaauuaaaaaaaaaccugaagaccaaugagaagugcuuauacuuuaauacuauuugaaugugaauguagguguguggaagguuugggaauauaaauguggugggggcagugguaacauccuuugcuauuuuggccuucuuggcacuuguuuuuguggacugccagcccuucaacaguaaagaagucaucauuucugcuuuauuagccucuuguuggaauaaauuuaaucauccuccucugggaauucuauaugauccuaugagaacauaugaccuuaccauaauacgagaagagucucuagcaaucccuaugacucuaguacugagaaaugacaaugugcuagcagcccuuccuggcucuuggugccuccucggccucggcguccacucuggccgcacuccaggagcccuucagcccgcugcugugcugugggggucccccucuggggcuggcagaggcaagaguccgcucccucugcucucaggccacacggguuccaggugggcgccggcuugguggccagcccgcgccugcugggcuuguuugggggacaagcucccucugggcugcuggagugccugggcuaggugccacaaagucccguggccagugccauugagaggugaagccagcugggcuucucgguaggguggggaccuggagaacuuuuccgucuaguuaaagguuuguaaaagcaccaaucagcccucugugucuagcuaaucugguggggacuuggagaacuuuugugucuagcuaaaggacugugaacgcaccaaucagcacucugugucuagcuaaagguuuguaaaugcaccaaucagugcucuaugucuagcuaaucugguggggacuuggagaacuuuuguuucuagcuaaaggacuguaaaugcaccaaucagcacucugucaaaacggaccaaucggcucucuguaaaauggaccaaucagcaggauguggguggggccagauaagggaagaaaagcaggccaccccagccagcagugacaaccugcucggguacccucaugcgcgggggaagguuuguucuuucgcuuuucacaauaaaucuugcugcugcucacucuuuguguccgugcggcauuuaugagcuguaacacucaccgugaaggucugcaccuucacuccugaggccagggagaccacgaacccaccagaaggaaggaacaacuccagacgugcagccuuuaagagcuguaacaccgcaaaggucugcagcuucauuccugaagucagcgagaccacgaacccgccagaaggaagaaacuccagacacaucuggacgucugaaggaacaaacuccggauauacccucuuuaagaacuguaacccucaccgcaaggguccguagcuucauucuugaagucagcgagaccaaaaacccaccaauuccgcacacaguaccauagaagccuguacaccucagaagcacgugauuuuaacuuccacccucuagaacacucagggaggaagaguaaggaagucaacaauacuuuucaucaucuuaagaguagauccuuauaagacuuauuugguggucuaagcagaggguugaaaacaaaacaaaacccaauucguuauccauccaaauauguaugugccagacacuggcuagagaaaauuauagaacacgcuuaauuaugcauuauucauacauaugcucaggcacaaaccuuguaaugcaaaauaauucauccuggaggcagaagagucuuuccgguuguggaugucuggugagguggugguuacagacauauugcagacaaggacccgcaguucaaacagauaccauugucuaucaauuuuaaagcagaagacagaugcaaaggaaauacauugcaaaaguugcugagaaugaaaaccaagcaaaauaaaagcaacaugaauuccuuaccuugcuaagaaaaucauaauagcuaagggaaauaaaauaaaaugaccuuugggugaaaaccuggggaagaaaucuuucuacauuuuguguuuacauuuugauguuaaagaggcaagaacaauaaaaauagacugucuuaaaugucauguuuuauugucagcaauauucgcgucaagcauauaucugaguuuuaaagcaagaggaugaguaaacaauguugauugcucauucuugguguauagaaaaggcagcuaacaaaggcuacacugcuuugaauucuuauuagugacaauuuuuuuagaauuacuuuugcaaggcaugcauauaaaagaacaauucuauauuucuuaauucugaaagaaaaaaaugugaaaaagucacuaauuugcuaaggguauuaagagaagggucuguucauuuuaauaaguaugaccugagccgguugcuaacagagucauuauuagauuaaguccucccaauugucuuggaaauaauuuggucugccucuuaauaaguaaaauaaagaaaaagggauaaauagucacaaaagcauggaauuuaaucacaggagaguagauauugaaaaauacagucacucauuugguauagaggaauuguaauuuucagguuugaacuauaguuuuuacaggugcaguuuuuuuauggccuaaacuugucuauugaaugaacucuguucaaugccacucaccaaccagcugaugugagcuucccaaacggcuacuuguggacuugcccuauucuuuccuggccuucauuucuucuuguaggcuacacugcuucuacuggguuacagaauguauuucuuaugagccagauacaguguuaaggaccgauacaauguauucuguuacccaaaagccagcacaagucgaaagccauguaugugaaauaauaucuugagauaagaaaggcaugcuuuaucagcucaacauuauccucauggucucuguucuacaauauuggaaguguugaaagaauguugauaugagagggccauucucuaaugacucugaauauucauuuuuaaaaaugagauuuaaauuucuaguuuauuuaugaugauaauugcguugguuguuguuacucaucugcuauuauagucuagauuccaauuggcuacgacagugaccaaacaauuugugagauaguuuuuuggaacaagaaaaguaccagcaaauauuaacucuugauuuaacaaaugauuccuacauauaagcaaugaguauuugaaauuuacaauuaguagaauaauauaugcaguaaauaauauuuuauguacuuguucacacauuuagaaaauauucucugagagucaaaccugcauaaguacagcaugaaagugcuuucaggcugugaagaauuuuauuuuuaaaaugaauauuucugaugguagaaaucauucacaaaaauucuccaccuccuuauuugagaugugaaaaauacuaaagacucucuaugaauaaaguuagcauauaggcugcgcucuguggcucaugccuguaauccuagcacuuugggaggccaagguggguagaucacuugagugcaggaguucgagaccagccugacacacauggcaaaacccugucuguacaaacauuaaaaaaaaaauuagcagggcaugguggugcgagucuauagucuuagcuacucaggaggcugagaugggaggaucaccugagcacaaggauguggaggcuguagcgagcccugaucaugccacugcacucuagccugggugacaaaccuugucuuaaaagaaaaaaaaaaaaaaagcaaagggauaaaggaauauuaaaugauuauucucguaaacacauuuugccuauauucuugaaugguuuagaaagaaaaauucaguguguaaauauuugauaaagcuuuuugccuagauauccugaccauucuccagaaauuucauagaaacgauaucuacgcacagagggaggugugguccagaccacuaagaaucuguaagagcccaguaagaucaagaccaaggaauuaugaucuuucuuggcuacacaacgggcguucagugacgacaggguccuagagaguguccacucaaaauuucucauuauagaagugagugaggaauuuuggcaauugaacacaaguaggaaguggcccaagaugucuccuauggguaacgaaaaaucuagauccauaucaacaaucuuacaaagguauauguauucuucacaucuucuuaaauuuuuguuuguuuguuuaaauacauugauuugcuaauucagaugugguuaucccaucccauauguccuaaacuuuauagggccaguaccaaauaggauaguuuucaguauuguguuuaaacuaaaauuaccaaacauauuauaauaaugaauuauucgcaaacuucccccucuuuuagacagucagcuauuaauguugugaucuaaagagaguguuagaaaauuaauauuccagagccauuucaaaggcggcagcagggaucaaugugauagcauugauguuaagccaguacaugauuuucucaauagcaaauauuaagauauauagaauuugguacacaaaggggaaaauaguaacuuccuaaaaauaauuaacuaaaaaauucuucaucucaaaaguccaaaauugaaaaacucuuuuaucuuuauuccccuuucucuaauuaagucuaguucauucuguuaaacuaaaaaucacuagacuuauuaucaaagaacuuuuauaaucaguauuuucagaaacacaguagugaaaccaugggagauacgacuauauuucuaaguacauuaaagaaaccccauugaaagcccgugauccgcacaauguuuagcuaaauuuuauaaaagcaaaucccaaaguggaaauguauucugcuggccuuaaagauguucugugauaaagacgaucugugauucuccaaaagaagaucccagagcacaagaucuguccagucugauuugauuauggaaacuuguauguauauacguguguucaccacacauauuaacaucaugcacuuugggacgcauugcucuauggaaauugcaacaaaaccuagcacagauuucuaugaagaaaacaaaaacaagguguugaaauaccaacauuuuaaaauugaguguaaugguugaaaaauaacaauacuauuuuaaaauuuaaaaagguaugcccaaacaaaauguaugagucauugccuggugaguuugcuuucaacauucuaucauuuauaacaagugucaaugauacacauauuccuguauuacacauuuaauuuuauaaaacucccagucaagccaaaauuuugguuuaucuuugagaauuaaguaaaaaagaauacauuaaaauucacaauaccaguuagauggaaacucucauucauuuggggagguggauaugaaaucugugaggucuucagaagaaaucuuugaaaaguuguauuuaaaagauagaauauauugggcuaaggaaaacaaaggugauacuuuuuauucgcccuaauguccagaacaauuuuuuauaugaggcuuauaacuacauguuaguuucuauaagauauauagauucuaagagaucaaauucaaacaacauuaagauaauaagaacaaaacaacacuuaaaaaucacuggcauaaucucuuucacuuaaauugaaaggaguuugaggugaaaaguccugcagaauauuuaagucacuguaagucuuaacaccccaaaaauacugaaaguuuuaaaaauguuauuuuacuaauuuuuaaauuauuaugauaauauuuugucuuagaugauaaugggggaaaacacacauacauuggcaaauacacaaauuuaaacaauaaauuuuuaaggaggcaucgucuuuguaaugacaaagguauuuaauucaauccucguuuuaaaauguugguaucuauaguguuguuuuuagaagcugggaguaacuuaugggaaagagacuaauauuucaaugcaacauaguuuguguaaauuguuucuuuuaaccuucacgguagcucugcuaaacaguauaacugauuuuauuuuaaacuacaaguagagggaccauacuuucaggauuauccuuguguaacuauuaaugauacucucuuucacugucaaaaguuccugacucagaugacaaauuauuccauauuauauccuuuaucauuauuauauccugguucagauauaguaaucauagaaaucaggaaaccaagauauaauacauuuaaauaauuugcuaaucccaugcuuguccuuggucagcucaguacuggaacuuaguuaggcaugaagacaagccacucuccuuuuacugcucagcacugccucagagccgacaaaaucagcagguguuuccaggagagccaauugaagaugaagaaguaugaccagccaaaauaggaaugucaaauauccugaaaugccccauuaggaaaccaguucuuugaauuuuucugcucccaaggaugugcuuuuauaaggcaaaucguccugagagguaucacuucaccgauuacuucauacuuaaguaauaaugaauuaccugugagugagaaaaggagaaaauuuuaaaaaguacuacaugguagaggcuggcaaagggaaagaggaaaaauauuggaauggaagcugcaaaaauagggcagaaucucaucaauugggaacuugagucuacuucauaauuuaagccuugauguuauauucuaagaauaaagcuuccuaauuaagguuaagaauaccgccuacuguggcugauucgggcggucaugagugggccauguguaacaaaggaguacaucacggacuagagacagcagaagaguaccagcaggaggagcuaggccacacagacagacaaugcccucauggacgcgcugugguuccguucccaguuuauaguauaucagcugcaguucuagauuuaauuaguugugacagauccuucuaauauuuaaaggcaaaaagaggagagcaaagaaaaagcagagggaaagaagguguuuuauaaaugcaacucagagacaagagaauugagagugggaaaaagggaaaaauuuucuuucuaggaguagcaggaauaauagauuucucaagaguagaauaagguuuuacuguuugcugaacugccugggagccuguaagaggcagcccagcgcguuuccggagggggacauguguauguaagugugagcuagggaagagguuggcgucaugcuuaucacuagaacuuccuccuggccaacaggaaguggaaaaugacaccagccuacagugauuaucugagcaagcugugguauaaaggcaucguggcaauuaugaacuucaguggugucuuuugugucuuuuuauguuaauuuuuaaaaauuaaacuggaaacuauggcuuuagugauuuuuuuuuuuuaaguucuggaauacaugggcagaauguguagguuuguuacauagguacacaugugccacgguggcuuacugcaccuaucaaccugucaccuaggguguuuuuuuuuuguuuuuuuuuuuuugagauggagucucgcucugucacccaggcuggaguguaguggcgcgaucugggcucagugcaagcuccgccucccggguucaggccauucuccugucucagccucccgaguagcugggacuacaggcgccagccaccacgcccggcuaauucucuguauuuuuaguagagacgggauuucaccacguuagccaggauggucuggaucuccugaccucgugauccaccugccucggccucccaaagugcugggauuacaggcgugagccaccgcgcccggcccugucaucuagguuuuaagccccacaugcacuagguauuucuccuaaugcucuccuucuccuugcccuucacccuaugaaaggccacgguguguuauguucccgucccuguguccauguguucucauuguucagcucccauuuauaagugagaacaugcaguguugguuuucuguuucuguguuaguuugcugagaaugauggcuuccagcuucauccaugucccugcaaaggacaugaacuuauucuuuucuauagcugcauaguguuccgugguguauaugucccacauuuucuuuauccaguccaucauugguggccauuuggguuggauugcggccaacaaacauguuaaaaaaaagcucaucaucacuggucauuagagaaaugcaaaucaaaccacaaugagauucuauuucacaccaguuagaauggugaucauuaaaaagucaggaaaccggccgggcacaguggcucacgccuguaaucccaggacuuugggaggccgaggcggguggaucacaaggucaggagauugagacgauccuggcuaacauggugaaacccugucuccacuaaaaauacaaaaaaaaaauuagccaggcaugguggcgggcgccugcagucccagcuacucaggaggcugaagggggagaauggcaugaaccucggaggcagagcuugcagugagccgagaucgcaccacugcacuccagccugggcaacagagagagacuccgucucaaaaaaaaaacagucaggaaacaacagaugcuggcgaggauguggagaaauaggaacacuuuuacacuguugguaggaguguaaauucguugaaccauuguggaagacagugugguaauuccucaaggaucuagaaccagaaauaccauuugacccagcaaucccauuacuggguacacacccaaaggauuauaaaucauucuaguauaaaguggugucuuuuaaggaaagguaaggacugugguucucuuugagauacacguagaaacuucaagagaucuauucuagcagucucuccaaacaucuguuauucacauacuccuuugauaagugauuauuaauuaugugaccgcaagugcaauguguuuucccugcugaaggaaauagaggaaaacuaaugugaaaacaacaucaccaccacaaccuucugcccucuggugugauagagaagaugacgcauucuuaaaaugggagaaauuacucagggaaaauacauaggaggaaacaucuuugaggaggcaacaaacaagauucuuagacauaucuacuaaguaaaaaucaguggcaggaaggugaaaagaaagaaaauuauucaggaucuacauuaguugggaaauacugagauugcaugacuggguuucucuggcuauaacagcauaaauaaauugaacuugacucaaaucuucaaacucauuuuaggcaccaucauugggcuaauucaaaaaggcagcacugauauuaccucaucugguguaauuacauauaaagaguguuggguuccagcagaagauauggauuugugucccucucccugugccacuguucccuagcuaugcuacuuuagaaccuaaugauguauuuugggguuucuauauguauuauuugaauuuguaaaacggggauaauaacuaguuuuuguuuguguuuuucuuuaaaaccaaaaguccuuuaguaacuaggaagaaaaacuuacuuuaaugagcucagacagggggaggugaccauuagaacuggaaugauacaucugagagacucaagcugaaguucagucagagguuaagcaaguuggaaacaggggucugaaagagccugugagugaaaccagagcuugauucauccuucucugugcagguacccuggccucaugucuucacuucuuccccagcaccugcucuccucuucucucuaguuuacacauagccuguuaucguuuccccaguaguccccuggguucccaaaacgaugucagguaacaaagcagagggauucuaauagcaaccguugagaucagguguucucacuaagccucugugguaguggagagagaccuggaccacgugguggauggcugucucucuggcagaagaaaaggacugauuucuacaaaaggcauaugaaguacaagguugaaaguuuggcagaagaauugauuggcaucucuaacugaccauucuuucuaaccagguuguuaugaagauugagaaacaauuagagcacagaugaaagcaguuuauaaucuguaaaauucuauauuaaaaguaagguaagggauaugcuguuugaaacuuucaaagguuuuguaucugugcuaaccuuggaaagaguaacacaucuaagugcuacuaacucagaaugacacaagacugggaagccuucgauggauuaaaaauguggggauaaaucagaacacagaucacaggaauaagguguugauaagaaaacaacagcaccaauaaacuaaaaacaaugagcuccaaaagacaugucagaauuacgcauggauuuuucauuuaaacaucucauuuccuccauacuuuugccauguacuggucccugacaucaagauuauagcagauggauuuguauuguggagaaccauaaacuaaauucaauuucauaaauaugugacaaucugucauuugaauauaugcauuuauauggugcuuuccuauguauuuauaaacuuucucuccaaaauguacuuuaggaauaucauuuaaguaaauaauaaaacuugaagccaauguuuaucaacauaaugcucaacugaauuuguucuuuucugcauuuguauaauuaguagguuacauucugauauuuuucuguuaguauaugaucuucucacuuucagauacuuauauagugucuguaucagaugacucuugccacuuguaaauuaagaaaauguaucuccaacauuccuggauucuauaauguucauauauuuuuucugcuuggaauugucugucuucuuuauaucuuccagauauauaacaucaugcuauacuuaaaaaaaaaaaucucuuuucucucaaugcuggcuauuagccacauauauguuuucaagaauuucacccuacauggcucuucucccaagggcauuugcauauaaauuuuagaguggaagaaaauauuuuguuguccaaccuggccaacauggcaaaaccccauuucuauuaaaaaaugcaaaaaucagccaggcauggugggcacucuccuguaaucccagcuacuuguguggcugaggcagaagaaucacuugaacccaggagguggagcuuguagugagcugagaucaugccacugcacuccagcccaggcaacagagcaagacccugucuuaaaaaaaaaaaaaaaguuuuguauuguaacaacuauguaugacuuucuuuuuguuuuuccuuggagaggauauaaccuuucuuucucaugcuaguucccuugacccacauuuacguggccaacaagggugaagcccuacauguauguuucuugcuguaccugcaggggcagagcagcauaaagggugaagauauagcuuaguuaccucaccauccguaaaaauuagggagcaaaaaugagagcguuggggagggcgaguuauaugucauuauggacagcauaacgcugauaagcaaagcagucuuuagaagccaaaaaguacguagcugcacauccccacauaacaaaugauaaaaugggcuacaaugaaguguagaucuauaucuauaggacagacaacacuuucuuucccaacgugauaauuucacccuaauguaugacaauccaguauaucaauggucaaaaagagaugaacugugggucacacaguuaagaaacuguaacuuuuguuuuauaguuuuuuugcuuuugaaacaucugucuuucuggaaaugcauucuauuucucucuaucuaccuaccuaccuaccugucaaucaucuagguagauauaaauauauauucuacaaacuacagacaaaacuacuauaaggaaaguaaagauacuccucaaauccaaguguccaaguuaagaaauauauuaacacuuuggaagcuuaauaucagauaccugacucucucuguaugaguagauaaauacauaagcagcucuaaaugguguaaagugguaucuuguauuauguuaaaacaaagaaaaaauaauuuaacuuuucuagaauuaaaugagagcaaaaaaccuauauauuuuuucuuguaaaagauguuaauucccauuaaaaaaccaaaggcagaauaaauuuguaccuaaaguuucagcaucugguaaccugcugcucugaaagguuaggaagaaaaaacacccacaucucucuaauucccauaauugacacuuuuacauuucugugccuauaacauuuauacucucuccuacaacuauagcuccuacaucguuuagucgaggucuuauauggaaauggguuccuugcucaacaccagucauguggccacaauuucuuuauugugcacuuucaauuuucucauuggugacuagauugucucauuuguauuccugaagugcuguuugcaugacagaaccugacuugcccaaauuuacugagcaaaucaucuucuucagucguauuuucacucaaaacuuuugaaaguaacauuuucugacucugcuuccauuccucacaggugcuuuaugucucucggcauuauggcacuucuuuuagggaacaguacacucucuugggaccuagaauuauaugguauuucuuuuucauauuuuguccuagauuuccuaguaaugggaaggucuguaucauaauuaccauuuggguauggccagucccuuguuucauguuuuucugucuauauucauuguuuuaguuguuuucaaugacuuuuaugagagagaaauauauuaaaauuuauauuacuucaacaucuuuaugcagaauuuuugauaacuuauaguaacucaacaacucucucauguccauagccugaugaauaucagguuauaaaaaugagcuaauuuauacuaauauuacauuaaaacugcauuuuuguuauguuccucuaccuuugcuuguguaucacucuuucaccaagucuuuuuacugacugagaccucuucauagaucugugaauaccuuauauauuauucuguauacacuaggcuagcuuuuuccuaucuauuuucuucucuuuuuuggucuuucuaaaucugauaugccuuucuuuucugauacaauauuuuuucucccucucuuuauuuucuucuucuuguucuucuuuuggguuuccuccugcuuucuuuuuucaucuuuguuuccuuccuuccuuccuuccuuucuuccuuccucucucccucccucccuuucuccuucccucccuucuucccuuucuuacuuccuccuauauucauucccuuucauuuuuuuauuuauagaauugguugauucuagauuguuuuaugauuucacauuucuuauuuuccuuuagcuguauuaaggugcagucacaaaaaauuuauauauuuauaguauacaacaugguguuuugacauauguauugugaaauaauuaacucaagauaauuaacauauccaucacaacacaguuauuuuucauaaauggugaggccacuuaaaagcuguuacuuuagcaauuuucaaggaugcaacauauuauuaacuauagucaccaugcuacacaauagauauccaaaacuuauucaucuugucuaacuaaaacuuuguaccuuuuaacagauaucucaauuuuuucucccucuccaccgaagccccugucaaccaccaccauuccuguuuuacugaauuaaacaucauggucucuguuuguugauucauauuuaucugagauaauauuguuucuuuccuuuuuaaguugccauucacugauguuuguaccaguguuccuuugaagcaaaagaguuuuuugccucuguccuuaauuauguucuuuuacucucagugaauugcuagaaaauuugaaacugccaguuacuaacaaauaccaugauuuaaggucaagaacucacauuguaguugcacacaucuaacgauuuuuuacacagauuuuauaauagagcuacauucuggguaccggaggaaaaauuacaaggggcauuugcauuuucaauaggaacuaacuuuuuacauuaauauacaguaaauacaaagugcuuuuuuuaauacaccguacgcauuuugggagucaauucuuuuuuacaucuuucuaaaugauuuucugauuaauaggaauuuuaacucuaaacguuuaugccauuuugacuuuauuaucccaggcaacuucaaaaugucuuccuuuuugacguacuaucucuaacuuccagccuaaguuuuccuauguuauuucaauguggagauuacaugagagguuaauggcaucuauggaucuuuuaauagaaguggcaggagugauuucuggugucugccaacaucuguugugugauuauauauauauauggcuauaaauauaacauguucuuauuuaacauguuuauugauaaaagaaucaaaauuuggcuuaccuccucucuuguuuaucuuggcauagccgggagaauagcuaccagagauggaggaggagcugcugaaagccacaugggggaguccagagacaaguggcucaucacauuuuucugaaaacaaaagacagagagggagagagacacucaacaacgauuucgaaauaacgauugguauguguugguuaaaaaaucauugaaucugauaugucuuuuauguaucuuugaaacaauauuuagcaaaggaauuuaggcaauucuguuauccuaaauauaauauaacacaggagcuguuuauauaacccugauauucaaauggaaaaccauagcaaagcacauuacuccaaaggacuucaccucagucuugcuaucugagaaucaugaguaaaauugagcuuguuccuguaauaagcuuugguaucuggcaucuccuggaaaucuucagguauuuauacauuauaggaacagggaacuagaauuacuaauguuggaggaggaaagacaaagaggacuccuaccaaagccaaaagaccaagaaauggggaguugcuaaccaacacguauaaaauuucaguuaugugagaugacuaaguucuggagaucuggugugaaauauuauaccucuagaugauauugcacacuuaucaaggcagaucucauguuacauguucucacuagaauagaaaaaagaggcugggaguggugacucaugccuguaaucccagcacuuugggaggccaaggcggguugaucaccugaggucgggaguucaagaccagccugaccaacaggagaaaccccaucucuacuaaaaaugauaaauuaaccggucaugguggugcaugccugugaucccagguauucgggaggcugaggcaggagaauugcuugaaccuggcaggcagagguugcggugagccaagaucgugccacugcacuccagccugggcaacaacagcaaaacuccgucucaaaaaucaaagaaagaaagaacuagacaucagcaaguaaagacagaauaaccaucaacuugaaaauuauuacugacagaaaaauuaaucaguucccaucaugcucaaccaaucaacugcacugaaaccaggcaauaccucaauucuauuuguaacacuuucugcacuuggcuuuuauaaugucauuaagauuuuuuuuucucuuuuuucucauuagcugcuugcucucugauuccuuugauggaucuuucucauuuugccaacgccuaagugcuucuaauguuaacguggccaggacuguucugagucuaccgucccucucugggucucugggaaauggcauggagggcuaagucuucugauacugggauguuccaaauccuacugccucacuucaacuccauagcuacagauagggcacauacagcuuccagagaucacuguuacaaaagacuguguggucucccugcuuccccucucacucugcuauaguuuugccggcagcagcugaagaaacacuuuucaaacuguaagugaacuuguggcugcuguacucaaaaugcucucuggcuccugcucucaacuuggccuacuguucaaaguaccccugcccaaccccugcuaccccgccacccaguggccuaugauggccacaacacuagucuuaucucuuuccccauguucuugucuauuccugucuagccaccauggccccuuuccucuuuuuucuuuuuuauuuuuauuugagaccgagugucacucuguugcccaggcuggagugcaguggcgccagcucggcucacugcaaccucugucucccggguucaagcgauucaccugccucagccuccugaguagcugggauuacaggcgugugccaccaaguacagcuauuuuuuuuuuuuuuuuuuguauuuucaguagagacgggguuucaccauguuagccaggauggucuagaucuccugaccucgugaucugcucgccucggccucccaaagugcugggauuaaaggugugagccaccgcaccuggccccuccucuuccuuuaaaaacaauccuaccccugcuguaagccuuugcaacuacuacuccaaguauccucucuugucacaggucucugcucaaugugaccuuugccacugaggacaggguuugcuaguucacccagcauuuuguugccaucagucucuguauccacauccugcuugauuuucugucauaauacauauauguuauguuguuacucauuuaauuguuuuguugucuuucucucccacuagauagaaagcucuaucugaaaugaaguuuuaguuggccuaaugcuuacucuccagugaucugaacaaugguacuuggcacguacucuaaaaacauuuguaggauaaaugaaugaauguacuaaacccaaugaaccucaaagagucuggaagcaagaucucauauuauaacaugccacaacacuuaauuuuuagaguaguggucuuaaauuccccacaaauguuuaugcucagaacucuguuuaauaaaacagaaaauguuucucuauauauucaaaaauguuucucucucaaauuuauaagcaaaaaauauuuuagcaacagaaagaauaaacuaauuuucuuguaaauucacuuaaguccccaaugauacuggagaaaugaauuauuauuuauuaucucaccacucaauuguauacaaauuggaaauuaaaaucaacaaauccgucuucauauaauauuuguaaaauugcuuauuuuucuuaguuauacugcgugccucugugaaauauggcauguguguauaaauaaguuccccagaaaguuaaauguaaaagaaugaaaagaacuuaaaauuuguuuuaaaaguaucaauucacaaagcuaucaucuaaaguaauggguuucauauuaaucgaaaacaucuacuucuguuuagcugugagcacaaacauacauccuugauuuuccuacuuucugauacauuugauuauaacuuuuuauaauuuuugagauaaguguugccuuuaauuggaguaaacauuccuucuaauguucccguuauauuagaaaugugcuaacauucacucauguucauuucauucauuuaaauaugcaucaacugccaagcacugaagugcagcugaaggugaaauuaacaaugcccugcccuuguagagcuuauguuuuugugggaagaaacaugccaacgaaaaaauguaaauuuauaguaugcuaugguaauuaauacuaagaaggaacauuaaauaugaaacagugggcagggaguuugggggugagguggagaggaagagaauugcuauuuuaugcugccuucucaaggaaaguuuugacaaaaugaucagguagcauuugaguagaaauaugaagaaaaugaggaagaaagccacguuauaaaucugcaggaucaugcuaggagaaauuuuucuaguccauaccugcucaaucaggcuagcucauacuugauaauaaugcaugacacauuuucuaagagugaauauccaauggauagauaugguugcguugaauguaauuaaacuaaguugauaacugauuaaaugauccaauagcuaauuuaaauuuagaauuuauauguagcauuuauaaaaccauaauauaguuuagaguuauuacauuaaacaaauuggcuucuguaacuaauucaucaucugaguaccaaauuuuacauuuuuuacuaauuuaaaaaaucaaaucaauuuuuaaaaauuuaaaaauuaaaguaauaauuugaaaaaauuauauaauuauucagaauaacaauaauuagaauuaaauugagcuuaguaaagaucagggccaauaagcaauuuuuuuuaaaggugacugcaaaauuauuaucagaauguaaagcaccagcaaucucacauucuuccaaauuaaaacauaaucuauaaucauauuauaagcuaaaaaaugcaacaauuacuauauuuuucccuggaggacauuaaucacgauuauuuauugagaucuuacacugcauuuugcuguuuucacuacuucaggcagauuauauguauauguguguguguguguguguguguguguguguguauacacacacauauauauauauaauuccauuucgcuacauuccauuuguauauaugcacacacacacauacauacaaagauauggcauauuccuccauaaguggcaguaauaaaugaauccacaaaaaguaauuaaacaugaagcaacaaaagaguaauaaaaaugguuuaaaauucaaugcuaaauagaauaaaaucaaauacaaaaagccacaaauaaauuagaaauguaggguuguuguuaguugaguugcucauuagaccuggcuccaucauaaacgugugacccugaauaugucaaugaaccccuuuccuacaggugauacacaaguaauaugaggaaguuuaaguuucucucaagcucugaaaaccccaaaauaguguuaaccaccaagaguuagaaaacuauggccugcaggcccaacccagcccacagauugcuuuuguaaguaaaguuuuauuggagcacaguuacacaucaugcauuuauguauugucucugauggcuuucacacagcaguagaauauugcaauggauaucauauggcccacgaaacuaaacuauuuacuaucugagcuuuuacagagugaguuuccaaaccucuuauccaguauaacaaauaugaaggaacuuaggaaucagaaugauuaaugauuagagugucagaugccauauaauuaaugaauagaaucugaagaaauuagagacuacagauagguagaaaggaaauuuuagaaagagggaacaccucaagcaacaugaaagagcccacaaugaauuugaaauuucccagagaugguuguagcagcacuccaugcaagcacauauugccauacugacuauuacaauauacuauccauuuuuauuuccaacuguaauaaugguuaucacucauuaugcauucuaaaaagucugcuuuuuuguuguacuaaaacauguaucucaaucuccugcagacauuaaauacuaggaaaucagucaaaucccuggagaaauuuagaauuuuuauauaauaguaaaggagggaaggagcgaaagaaaaagagaacuaacauuugaaauaauccaguauuguguuuucccauacugggaugucuuccaaaacuacagccauacacagcaauggcaaauauuuggucuccagcguacuucccuuccagggaaucuuggaugaaaauuagaaaagcagaugggccuugaguuuuauuuucacacaauuucagucaaucaugaaggcagacuagcuauaugaauccuguacuaacucaagcuggagcagaggaaauuauuggcaaauagacaugaaauagcuguugcccuuuaccuaaaagauacggcugagagguuuggcuauuggcaagggauacuggcaggaguuuacaagauuaaaggacuucagaauauacguaauugacacaaaaguaugguuuucaaaugcaucucugcugaaauauaaugucugaaaauguuucacaaaacaauauauguuuaaacuauaacacuucaaauagauguuuuauaugacccauuugguaacauaagccuaauggaggaaaacaacuaaaaacaacaaaugacucaagaaugagacagugcuagcugaacagaaauucuagcaauaacauccucacuuuuauauuaggaaaaauuccauggcaaaaggcacauucugaguugaacacaucacucuguggucuuacguguacauucaacuucugccuuuugaaguucgagcuacucuaccuauaccugcacauuuacccugcaucacguguuaugacuauuccuuuccaucaucaguagcacagcaguuccuccaagaggucuuuuaucuacccccugauguccauuucagggucauuaguuaaugcaauaacuaaugauggucagaaaugugggggggcacacaacaucgggacacucaggagcagaaggcaaggugcaguccuggagcacugaguugggacaccagacccugaaauggacaucgggggaagacaaaagaccucuugaggaacugcugugcugcuugggaagccauagaagagcuuuucguucagcuuguaauucaagauaguuuuagucauaaggaacaaggcaggaugggaagcagaaggcaaguuuguugggagguuuggccagagcuucuuaaauuacuccugaugucugcaagccaaauuuugucuaaauuuaauuuauauuuuacauuuucuaauuuucacauaucacauuuuucuuuaauaauauguggaaaguacaggaaacagaauaugauauucucuuccaauuuuuauaauaauuuuuagacauaguugagggucaaguuuaacuuaacuuuguauaauuaauacuuuuuggugaaaggcgugacuuucagagguagcagcaugcuccuuagagucaaaauauuuagauuuuauuccuagcaacauaaauuggggcagcuuguuuaauccugucuuacccacaguuuccuuaguuuuuccauuauuucaaaaguccuuuuccuguuuugacccagucguucuagauuuuuaaaucauaacaacauaaaauaaaugguuaaacauucagaguuauagaaguaugcuauaaaaauguaugcuccuucuuagggcaaagaacucauugacuacuacucaaucuagcuuauauaucuucacuuauaccauauuuuccucccauuuuuaugguucauacauugcuuuuguguaucucuugcuccagcuucccuggacuacucuuugcuauugaaaauaagauacaucuuucucuugcuccuguagaauuucauacaauacaguuaaagaaagaacccuaauaauccauagaagucauugcuauuauuacucuucauaguacauauacacagaugcaacauuuaacguaacagauauuuagauaugcacgcaaauaaacaaacaaaaaacauuuacaaucuggucuuuaacauaccuuuucacuuacugaucuaucauagaaauucccauacaaauauagccucauuuuauguauuucauuuuauauuagagaucuuuuauuauuuauauuaggcucugcauggcagaagcaacuaacuuugcacagaaaauacuagagugcuaggucauugcuaaaacaggucauaaaauugcauugagaauuaauuauuuucucauagagucuacaaauaaguucacaaaagaacuuaucaaacagaaggaccaugaagagaaguacaauuaguuugucaucaauugcuaauuuaggaaaaagcuaaagauaauggaauuggaaugaaaucaacugauuggacauaacuuaucugacacacagcgaaaauugcuaagugaauacaauaaauucaucugccuuccuuuuuucuuuuuacuauaucucucuuguuuccuacuagauggaggugaccuaauuuacucuuuuauuucauuuuccauuuaaugagacaaagcccaguguuauaggggugagcccgaaugaggcagccuucccaccucccaucucaauccuuccaauuuggaccuugaugaauauacagauggcagagaucauuaaaccacaaucaacgaaucaauugauaguaauagcaaucauuuauugaacacuuacgugauagccaaguaaauauuuugagugggucaucucauugaguuaucacaguaacccauugagauggguaguauuaccauuuuauagaugaggaggcuucagaucucacagcuaaaggauauuaaagucaggacaaaggccaaauuguaccugauucuaaggccugugcuuuugaagucuaguuuucugggacaaaugguuucuauagugacuucagguaaaaucauauauguugcacugggcuacacagaccuaauaauauugaaauugucaaauuguucucaccaccucucauuuugauucuaagaauuuacaugaaauguuacccuauauaauaauauugcaggaauuucaauauuuugugugccaaaucagacccacaucuuuuaacugaaagagguuucugcaguuuuaaauagauguucucagagaaacccauauauaaucagcaauuuaauggauaugccuacauugaauagccucagcaaaagacaucaacuuuauuucauuuauucauucaauaaauauuuauugggcacuuauuuccugcuucgaucuuuaucuccuuacaauccauuuucuucacaguugccagauggauuuuuuaaaacugggcaucagauuuugccaugcccugaaggcuuccugauggcuuccccucuuauuuaguauaaaaucgaagcuccacugggcccaagauggucuggcccugaagauaucucuggcgcuauuuuauuucacuccuucucugggucacuaagcucuagauucacucuccucucucucucauacacaccaagcacacccuugcucaaaggccuuuccauccucuccgcuguccagcuaaaauucucucuaccagguuuaaaagagcugguuccuuuccacucugauucugacgcaaauacuaccuucacuuuuucugaucaguucaucuaaauuaaccaacucaauuucugucuucauugagacauugcuuacuauucuaucacacugucuuguuuuguuucacagcacucaccacaaucugaaauuaucugguuuguuuuuaauuucuuuauuacuuuucuuguugaauggacuguaaauaccaugagaggaaggcaggugccugauguguccacucucuauucccagagccucaaaaucugucaugcagcauaacacaaccuugcagagagcuguugaaucaaugaauuacugacaaugauaagaaauaaauccaucuaaaagcaagcaaggcaaagugcuuccuaguuuugacuauugagauguauucacuucaucuguuuagcuucuaagauguauuuuuguauuuuccauuuuaaaaucugcauugcaaaagagaaauggcuucaucccaugaucuuacacauagaucuacuucacuguaucccacauaagaaauaucaucucugaucuucaacaacuuaaaaugacuuguaauuuggaaccccugaauuauauagaggguuugucuaacucaucaguacaguacaugacuuuaggacuuuuuaaauaucuuggcuccagcaaaugaguuuuuugagacuugaaacuauugacuacugucaguuagcucuuuuacaucuacuuuuagucuuaaaaagaacauaagacuuugguguuccuaauauaauauuuucauucuguaucauugaaaaucuauuaugaucaauauugguuuauauguugauuucucugccaauaauccucuucugaggaagggaacuucuuuucuuucccaauaugcagaauguagggcacaccauaggaagucuucauauauuuugaaaaauauugaacacaaucaaugcaauuuuaauagcuuauggcaaugaauaaauucauuauuuuuaaucuuaaaaauuaguucagauuucuuucauuuucuauuuugguuugucuaauagcuauguuuaaaaauaauaaugaaauaaaaguaguauagcuagaaaaucggucauguuuggagaaaucuugguuguaaaucaaauaaaaaauugucuggucugcauguaccaagggcaaauuacuucgagaaguaguucaaauuuugcuggacauuuaacagcuguagcauauuuccaacagaugguauaacagaugaaucaguuucaaauuaucuacugaacuguaauguacuagaaaugaaauagauuugugaggcuuuuuuuuuaaauuaagcuuuugacuccucgaacuugaucuucuaauuuaaaagaaaaaaaaaaacucuacaacacaaaauaauaaaaaacaauuuuuacccuagcuguaaucuggaaaacaaauugaaguuuuaauuuuauaacuucaugcaacaaaaggaaauaguauucaaaaacugaaucaccacccaggagcuaggcagagguuuuaaucucuaacacaguggugacaguagacuuuucuuuuuuuaacucaaauucuacagucucguaagaaggucgagcuaccuagaacuuuuaauaaaccaauaaucugaagaccgucaaggucaaucacaauaugacuaaaugaacuugaguacucuuaaagcuuugauugacaaucuuccuaagggcugggcucauuugaauuguaauuuauugguccacugguaaauguugcaauuuuugacccucugguuucauuaacugguuaacugaaaguuagcauuuagcaauaagcaauguacuuacugaaaaccaagucuauuuccuagacuacuuaacccacuuagcuuuaaauaacuaagugcuguagguaagcauuuucccaguguacuuggcuuaaguaacuucagauuaggccaugcaaucaagagguacagagugaaaaauggagcgcuauagagccaguaagggugaagcuguagaaaaauccuuaaucaauugacaaauguuuauggcaugauaggcuaaaaaaguagucuauaaaacaguauuuauaauaugaucuucauuuuaugaaauagauauuuauagguaaagaaaugacugaaagaauauguaaaccaaaaugucaaucaugguacuguacugauugcuagauaauuguugacuuucauuuucuucuauuuucuacagcuuggaaauguucuucaauuaacauauauugauuuuauaacauuugaaaaauaguauuaacuacccagugacgcugagugcaaaguuaauaugcauuuccuucaaugacaauuuauagagugccuacaguugggggacaacagugaacaaccuagaguuucauauuauaguaaauaauaaaaaaaauacacaguauuucagaugguguuaauuauagggaaaauagggcaugacaggaagaugaggaguaugggugaauggauaagcauccuugaaauuagagguuucagaaggccuuacugauaagguaucauuuuuagcagaacuuaauggaaaagagagaacaagccauaggguuaucugauaucuguggaguaguaauucuagcacaacaaaccccagucaaaaggcucggagcaggaacaagguggguauguucagagguccuaggaggccagugaggauggagcagaagcaugagguaaacaggacggaaaguggccagagagacugcagaagacugggauggaagccaacuuugcugggcuuuguaggggaucgauaugguuuagcagugucccaacccaaaucgcaucugaauuguagcucccauaauucccacauguugugggcuuuguaggggauugauaugguuuagcaguguccccacccaaaucgcaucugaauuguagcucccauaauucccacaugucaugggagggacccaguuggagguaauugaaucaugggggcaggucuuuccugugcuguucuuaugauaguaaauaagucucaugaaaucugcagguuuuauaaaggggaguuccccuguacaugcuaccuugccugccaccauguaagacaugacuuugcuccuccucugccuuccaccaugauuaugaggccuccccagccacguggaacugugagcccauuaaaucuuuuugcuuuaugaguuacccaggcacaggcaugucucuguuagcagugugagaacagacuacuacagggauucuuuuuuuguuuguuuuuuguuuucccuagauggagucuuguucugucacucaggcuggaguguacuggcacgaucucagcucacugcaaccucuguuuccuggguucaagcaauucuccugccucagccucccaaguagcugggauuacagucaugugccaccacguccggcuaauuuuuguauucuuaguagagacaggguuucaccauguuggccaggcuggucucaaacucuugacuuugucauccucccgccucggccucccaaagugcugggauuacaggugugagccaccacaccuggccagggauucuuaggaacugggcuucaguaacauucaaagaauggaagcccacaacaagacaaaaugugauauuuugccaaguaugcuguaaugaaaguagacguuuaauguaaacuguguuauuuucuaucuagacaugauucuauuaaaauuucuauauaagggcucucacaacagguuuuaauucuaaguaauccaaaucaacuuuuugucucuaaugaacaaggaaaauaaguuggagaauauuuaguccccuggguaugaauuuaucuuaaacaauguaaggaucuauguuaaaauaauauucauuuauuuuaauuucuguuaaucuggcauuaauuaacuauaucuuucuuaaauauauuuagauuuugagucgcauacuauccuuugaaguggcgauuugaaaaauauuccccuuugucucccaguaaucugaauucauuucuccucaugucuucaauaacacggaggaccuaccauugaauaaagaaguuguauccccuucuagaaggcuugucuucuagagaaaaauaaauuacccaguuagcuauaagcaaugggauaaucgcaauugaaaggagugaacaaagggaggaggcaagguaaguucugccugaagggguaaggacaguuuuaauauuuaaaaaaaaagaugguaugauaagaacaauuucacuacacauaaaaugacagagaagagcacuccaggcaacagagucaauaucacaauaaaguguaaauaugggaauguauagcaucuucaagaaagagacaaaaacaaacaaacuuaaaaacagcaacaacaacagaacaaacacacuuguucucgcugccuaaagugcucuucuucacauuuucucuuggauaaaugaucauguccuacaucaaaucucaggaggcaagugcuucccugaguucaccaucacuuacacuaaauuuagucugcuucccucucuuuucagggaacacacuuuccuauuuuccuuccuuccuuccuuccuuccuuccuuccuuccuuccuuccuuccuuccagcaauuaugacaauuaguaauucugcauucaucugcguauuaacuuguuuaauaucugacucuacuaugaguuauuaacccuauuaggguggacguaaggguuguguuguuugcuucuguauucuuggcauaugggacagugaccagugucagaaugaaugcacaguggauguauggaagguggcgaucauugaaucuacagaacagaugagcaaaaaggaaugccgagggcaaacugaauaaucuuauucauuugacccuguuuggcauacucucauuuuucuaucaacaaaucuguauuggauaccuauuauguuugaaucuagguaucuuugauucaagacuucacagguuaguaaaugucaugcaguaaaugugaauuauauucuguaggccuugagaaaccacugaaacggcuccuucauugaguguaguuauaugauaugguuauaucuauauuuuagaagaaacaaaacauugauaucugggugguacagccauuauuggacgaauguucuagaaacuuggacacuauuauacaccaguauaaauuaguagucuccaggugugguggcucacaccuguaaucacagcacuuugggaggacaagucaggcagauagcuugagcucaggaguuugagaccagccugggcaucauggugaaaacccaucucuacaaaaaauacaaaaauuagccaggcgugauggugugugccuguagugccagcuacuuaggaggcuaaggugggaggauggcuugaacccaggaggcagauguuguaaugagucgagauuaugccacugcauuccagcuugggcaacagagccagacccugucucaaaaaaaaaaaaaaaaaaaaaaaaaaaaaaaaagguaaauuggagaugauacagaggugaaugaaggcaguggcaguggaaugacaagagaagaaaguggugaaagauauuuuagaaggugacugaauuuguuuuucaaccagaugugagaaguaauaggaagaagaaugacaaaaauuacugauuucuuaugugggugacugaauaguguguguagucauucacugagcaauggccauaaaauauggauuugggcucauuuaccuuauuuauuaaaauaggagguuuggcucauuuaagaacauaugccaagauuguaucuucacaucuaauugaacucauguuuuugacuaaaauuaccagucauagauucuguaacucauuggugaaagcaauaaaguuugcuuaacuagaaaacagaaagcaagggcuacagcacuuguaaaagcucccuaagauguuuaagauacuuacuggccuucuuucaggcaaaacuaccgaagguuuauuuuuauauauuaaauuacuaaacguccuuucucuuacugugauacuuugcuguugaauaagauuuuuccagcaaauauggcuuuauuaauugguguuaugguaacugcgaaccuuuuuccauaagggguaaccuggaaaauaaagauagcuaugcacuaaugcccauccauuuauaacuucugagggaccuugcucucacaccccaccccaccccacccaccuuuuuuuuuuuuuuuuuuuuuuuuuuuuuugacagucucacuguguugccaggauggagugcuguggcgugaucucagcuccucugacucccagguucaagcuauucuccugccucggccuccugaguagcugggauuacaggcaugugccaccacaccuagcuaauuuuuuuuguauuuuuaguagagaugggguuucaccauguuggccaggauggucuugaucucugaccuggcgaucugcccaucucggccucccaaaguguugggauuacaggcgugagccaccgugcccggccuaaccauuuuuuaaaaaauauaaucuguucauccuccccuuucuaaugucucugucuuuaagcacacacauuucccuuauuuuaagaagaaauacuuuuuagaucacugcugacacuuccucucagugucaaguccaagaauucuguauuucaccaguaaagaaaugcucugggcaucuggggguaaucuaaacguaaaaauauguugcauugauuucuaggauauauuauauuccaaagaaaguugcuugccuugacauauaguauugauaauguuuaauuucuaaauaaaauuguuuucagacagauuuuaugaaaaauaaaaaaacuauaccaauccaaaagaaaacaaaaaguaagucauuucaacacauauaugugggugugcacucauuuuagauggaacugaaggaagaaaauugauuggaucauuuugccaucaucaccagugauaaguagcaaauugauagugcuucucaguaggagguuuuugaaauaagcaaguugaagcuuaacucuggucuuaaaaagggaaggagaggagagauucaaguccugaaaguucuaaucaggaaagaagaaucagaaaggaagucagguguaggcggugauaugauuucgcuguguccccacccaaaucucauuuugaauuuuaacucucacaauuuccacuuguugugggagggacccuguggaaaguaguugaaucauggggugggucuuucccgcauuauucuuuugaucauaauaacuaucacaagaucugaugguuuuagaaaggagaguuucccugcacaagcucucuucucuugccugccaccaugugagaugugccuuucaccuucugccaugauugcaaagccuccccagccacguggaacugugaguccauuaaaguucuuacuucuguaaauugcccagucucugguaugacuuuaucagcagcaugaaaaucaccaauacagcggcaaacagagaccagaacucaggagaucaaagccucacccagacaguugagcaccacaccugggauaaccucuuccauguuuuauguucacacagccaggagugcaugagaagagaagcacuacaaucuagagauuuucacaauuuaaaggagaucuuacaucuuuugugggcaggaaaaaaggaaaacagaaacaagcaaagguacagaaaugaaacuaaucagaggcuacaaaaagucaguuugauuaauacgccagguggguuuugggaaguguuaagaaaaagugauugaaagugugcugauccuugaaagcuaagcagagaauuugcgaucucaucuagaaaggaauugggaacaauuaaagauuucugaauggagauauuacagaaugaaagugcaagcaaugucauuacaaaaaauaaacacuguuugguuuugaagcuuucucagagaggagauucccagagaaugaauuccagaugggaaaacaaaaugcaucaugagaaaacaauguaaucagaaguaaauaggaaauggagaaggcccaauccacugaauucuguauugcugaaguucauauagccaccaagagaugagaaaaguugcuguuuuuacauuuugaaauaagaaauagagccauagcagugaaaaauaaaugagauauguauauucaugaccauaauaaugaagagauggcugcaaucucauggaaaucacuguacuauuuucccaacaccuauauuuuuacugaagccggccucugaaccugaauuuagaaaacuuaaguucuaauuuccauuuaguugucaacucucuugaucaagugacauauucauguggaaucucaguuucuccauuuguaaagcaggagaaaugaacaucauccuugggaucucuuuuauagcugacauuucuggauucuauaaugucaugaaauguuugugagagaacagaauuuuaaaagugagcuuauuccuuacuaucaaaaaagugcuuacuuaauuaucacuugcuuauguaaagaaauuaaacuuauuuaaggaacauuauaaaacaaaccccuaaaugcugauauggauucauagcagaacaaugaaaaauaauucuuuuugccccuuuaccuuuuucuagguuugaagcaguuacugugacguagauaaaucaucaaaguaauagauaaugacacugcauuccuuugucaaaaaagccuaggacacgcugccaacucugcucauuugaacauaucuggauuucaagaaauugucacccauuuacugcuaccuucauaacacaaguggaucacugucugcuuaugucaucgcauuuguucuuuuucaugaaaaauugauauucaaagcugucuaaaucacugacucgaaauguucauauuaagaaacuuuuaaaaaugaugcauccuuaagggaauuuggcaucaugauuacuuuauuugaucacauuuuacaauucugaguuauugaacugugggguggauuagaaauaaccacgaggcagugcccugugaccuguauauaggaagcaguucugaaaaauuacauauauacguguuauaacacaaauguuuaguacuauuuaaaauaugucuguauucauuuuaauaauguuucuuauacuguguagaccuauaauuucaaaugcgcuaagaacaggaaagguuggaagaucaagauuuuagaaagaacugauauuuagaauuagaggaccuaccuuugcauuuuggucuacuucucauucauaugcauucuuggguacauuuauuaacaucuuggaaccucaguuuucgauuuggugaaacaauaacucaaucaaaguuaauaaagucuuacuaccaauaggaagcccguguguauauauugaauuugggaagugugugacuggcgcagauaauaaacaucuuuugcuuaaugagacuugagagucuagaaaagauaugaaaagauaccuaccauauacuaucaagugcuauacuagagaugucaaugccgcaagaaagugauauggguacuuauaguaguacaacuaauuuugcccagaagauaauguuaucaagcauaccacuaugcuaauggagaguucaaugaaaugacacaaaauucuuuuuaaauuggaaagucauaggccaguauuaguugcuuuuacuaacauagcuuaauaaacaaauuagaguuaaccacuugauuuuuuuucauguuuuuaucauaaauucaucuuaguuaaaacaagagacacuauaagguaugugcaaaaauacaauuuuguagguagucaaaauuacuuauuuuuugcaggcauucauguaaaccaacggaguagaucaaaauauuauuuuuuccuauuuuuguuucuauuuucauagaaaaucaauuuagauucuagaauaucauauuauuuaacucaaaaagagugcaugucaacuaaugaagccuagaaaauuccuucagucauccacuuucguuucauauucauaaacuuauugaaaauccuuacaaaguauauucuauuuuagaaaauggacaacgauauggcaaauaaacauauguuauugaagcaaggcagucacuguagaccccacaggacaagaguuucuucuccaguaacugcaggaacaucuauaguacaguguccuauaaauagcacuguaucauuugaaugugucaauaaaucaguuuacaaauucauucugcacacuguuacauuuucuugaugcacuuucugacucuguguugcaagcuaaccuagagagguuugaauuauuuguuugcuauuaguucaucacuugacauuucacauuucuuauuauucagaacauaagaauaugcacacugauacauuuuucuaaguuccacuuauuggguaguguuauuugaaacauaauaugaaaaugcacuugacaaguuauccuggaggugacauagcaguuugcaaagagaaguauaaacaucauuuauucauggcagagcaauguucccuuuuugauuugaguuuucuaauaucuucaaaugccacuguauaccaauaacaauuuauuuuucaguggcacaauuggugauguggaaaauauuuuucuuggauuuaaaagagcacauauauucacacauacacuuuugaguccgucccuguucagaauauaauuuccuauagauugcagacauucucuacugugucugauucaucucugaguuuuuaugcccagcaaaguaaccgacaacaccaaugcuagauauauauuuuugaaugaauaaacaugugucuuuuaggauuggagcuuauagguuuacaggcacaaauuccaauuacauccucaacuaguauauacccuacaaauucuaaaaucaaucccauugcaggagaguaucacccuaaaauaccaccaaagacuguauucuggcacuuacucuuauaaauugggcuaauaauccauauacaauggaggcaaaaaugucuuuaaaaaauuugaagcagguuuucuccuggacuugaagcaaauuuaaugugagcagccguauuuucuuuuauuaagaauaauccuuuacuuugagaugauuagacuaaaugcuaaggaagaaacaggaaaauaguuuugagaauacggugugugguuuccggaaaacugcacuucuuagaaacagaucaccuaaaaaguauuuauuuccauccaaaacuacagggaaagaauaaauagccucucuuuccuaaccccugacaacaccugcuacauuuuuuacccaagaauucugaaaaaacuguagagauaccauucgacucuaaggcacagcaauggaacuaucacacagagaggucacagucaaggucaguauuauuauugcagccagguucaguuaaaaagagagagagagagagagagagagacagagagagagagagagagacucuaacaaccuacaugacuuaauuuuauuucucauuggauaaaagcugaagcaggguguguacagguucaaugguagucagcugacacauguuuuuguucuauuuccagggauaacaaaaauuacaauaaaaaaugaaucaaaauauacuuaacggacaugauuuuuucuccuuggaggggaaaauguucuaccuuauguugcuucuuuuacuguuuauagcaggcuuaacuauacaugcuaccuaucaauuugucucagaguuucaaccauuuucuuuacgaguuugacuccuacuagaauuaaaaugucucuggaagaaauagcauuugaguauaccuucugagaaugaagagucugaaugcaacuuucaugggugguugccuuaagggaaucaaaagagaauauuaagauaugaggcauuaaacuucagggggaauaaaacuugugucuuauugaaagcaggaaagccaauguugcuauaccacuagcuugccuuaggccagaucugccugcuaagaauguaucuacauguccacaaaagaauaaaaaauagauguagaaauagcugggauuuuucuaacauaauaccuauaaauuaugguuaagcuucuauuuucguauagguugaaucuucauauaguaagauuucaaauauucaagucugcauggaauuuuauccuauguuaccacaagcacaaccucucaguauuacagagaauucugaaaguaacaccauauggcaaacagacagcugagaaaaauacaagagaacugguaaauaaauguucuaaaagauggaaaccucugaugauaaacacaggugaaaaugguuugaauaccaagacaauguuuuccaggauaauuuaaaaauaaaucuauuuuuacuuauauaacuucuaaggaauuuguauugcuuugguaacguacaugagauaaaauucaacaugauuuuaucuaacuugcauacaauugaguauagaauauugaaagucaaaucauuccaauauuucuguauaacaguucuuuucuuauugacucacauguuaauaucaucuaaacuuucauacacaguugguuaaauucuauaaugcaacauaaauaggucaucauggaaaacacagaagcaaguucagauauugaccauucuuacauuuuuuuuuuaauuacauggaauuugcaaaaacauaaaagaucaauaauauguuucuuaaauaaaugguagcauggauaauguguaaggaaaccucaccuggucuauuuuuuuuccugaguuauuauuugacugaaaaaaauaaaucaguguuugcaauggaaaacuugacacaauaaauacaauuagaauuuucauguauuuauuaaaguguaaauaaucuuagauugcauaacaaugcccuaaauauuuuaguaaaugacaguagaauuuauuuagauuuaacugaccaagaugaaaucacaggaugaagcuuuggucagaaaauccugcacaacuugaauccauaaaagucaggcucuaugaacucugccucaacccuuggcucuaaagaaacaaguccagugagauucacucacuuuccauuuacucuguaauuauuauuaagguucaaccuuuaacauccagauuuacuugagauuuaugaaucacuuaaaccaauuuuuggcuaauugggaauuuggugcuagaauaacuggcuagccauaugcugaaaacugaaacuggaccccuuccuuacaccucauacaaaaauuaacucaagauggauuaaagacuuucauguaaaaccccaaacuauaaaaacucuggaagaaaaucuagacauuaccauucagguuauaggcaugggcaaagacuuuaugucuguaacaccaaaagcaauggcaacaaaagccaaaauugauaaauaggaucuaauuaaacuaaagagcuucugcacagcaaaagaaacuagcaucagagugaaucagcaaccuauagaaugggagaaaauuuuugcaaucuacccaucugacaaaggucuaauauccagaaucuacaagaaacuuaaacaaauuaaaagcaaaaaacaaccccgucaagugggcaaaggauaugaacagagacuucucaaaauaagacauuuaugcggccaagaaacauaggaaaaaaagcuuaucaucacugaucauuagagaaaugcaaaucaaaaccacaaugagaugccaccucaugccagucagaauggcaauuauuaaaaagucagguaacaauagaugcuggcaaggcuguggaaaaauaggaaugcauuuacaccguuggugggaguguaaauuaguucaaucacuguggaagacaguguggcaauuccucaaggaucuagaaucagaaauaccauuugacccagcaaucccauuacuggguacguacccaaaggaugauaaaucauucuaccauaaagacacaugcacacguauguuuauugcagcacuauuuacaauaacaaagaccuggaaccaacagaaaugcccaucaacgauagacugcauaaagaaaagguggcacauauacaccauggaauauuaugcaggccuaaaaaagaaugagcucauguccuuugaagagacauggaugaagcuggaagccgucauucucagcaaacuaacacaagaaccgaaaaccaaacacugcauguugucacucauaagugggaggugaacaaugagaacacaaggacacagcgaggggaacaacauacaccaaggccugucggggguugggggcaaggagagggagagcauuaggagaaauaccuaacgcauguggggcuuaaaaccuacaugacggauugaugggugcagcaaaccaccauggcacauguauaacuguguaacaaaccugcacauucugcacauguaucccagaacuuagaguaaaauuuaaaaauaaaaaaaagaggaauuagagagcaugauaaaauguaagauuuaguagccucuuuaaaauuagaaacauaaauguauacccauguuauacuugggaaaaacuuaggaaucacuuagucaagaacuuuaauuccuguaaggaaaggaagacccagaaaugugccagacucagucaguggguguguauguguguuuaguucccacuccaauuuagcagguaacauucuaacagucuaacaauauguaaauaacuuacaaugugcucuuuauagugauauguaauuauaugcuauucucacguaaggauguuagguuggcaaaaagguaaaaauacuuuaauuaaauuuguaugcucaaauuuguaugcucaaauguguaugcucaaauuuguauacucaaauuuguaugcucgaauuugagcauuuguaaauguucaaaaguuauccugauuaucuuuaaauuuauuaauauaucugcacaauaaaacuaauuuucccaugcuauuaagacucuuugagacagugccacauguauaacccaaacaccauuuuauuauuauaaauuauuguuggauuuacuuccaagauaacacuuguaaacauuuaauuauccucuuauuagaaaacauguucuuuggaauauaaaauugaaugaaugaguaaaaguagugaaucauaucgccuguuaaugccuaucagcauuauuuuuauaucucaggaagcuggacuaagcaauuaauuacuacauaaacacuuaacuuuucauggaaaaaguaguaaaauuuuugcuauuuaauuucuccaguuauauauuuaguaagccauauaguuaaguaaauuucauaaggcaaaaagagaaaagauacaaucacuauauacauuucuggccaugccaccucucaaaagucagcagaaaaaugaacuaaauauuaaguucaaugagacacuacugaggucaauuuaaagacuguggcauauuauagcacugacgacaaaagaaaagaaaauccucggcaaaugcuucuagguaggcaauagcaaccugcucaagaagcccaccaguauccacacagcaucugaucuuuauuaaaggacuagugaguguuccgccacauccaacagcaagggcugaggaugaaucaugggaucaaaaucaugagucaaguucaucucuuuucccuggaggugggaaaaacaaauggcacacucauguaguuaaauuuuaaaaauuaaugauuguaagacgaguagcugagcauacagagcagagaggagagauuaucaagauguccgagaucauucaaucucuaauuccaagggaggagggugagguagggguggaaagagaagagaagcagauucucaaacucucaaauaggagaacaaaauggaaucuguaugaucaagcaauaucagcauaggaacaucaggaugugguaagaauaugaguugauguugagauaauuuggcuuguuugggccaggauuugauuguucagauguuggcagagcaauccuuugcucuaugcuacuagaugaauucugguguuagcuaauuuaugaggauaaccacuuguacauuccaggaccucacagaucugggagucuaugugagaaaauauaaaaggaaacccauggcucaucuuuaaacaugaagaaacugugccuuucaucaccacuacuagguuaucuuugaaaacaugccauagcauugguccaggugagauacugagaagauaacaagggacagaaaaaguucuaaccccaaggcucuucugccagugguaggagaagacauguaaacagauccuccaaauauugaggugguaauacuacaaccccugaaauccaucuucuauauuuaaauuucuaccacaauuaaauuuguuuaaacuuaguauuucuuuuuaauuuuucauucacauuuuccucuauagcuucacucauucaggguuuuaucaucucuuuucugaacuacuuuaguugaugucuaauaguaaagacaaauuuguaaaacauagugacauuuaauuugcauggauagucauuuuuuggcugccuaagacagcuuggcuuuguuuuccuuggucuguacugcagaagaugcugaauaucauugacucugaugauuaacaaaaagauaaaacauacacacaaguuuaaauuaucauaagauaaucuaguaguuaagaauaaaggcuuagaugucacuuguccaugagauugaguccuagcuuugccacuugccaguuauguaaucuuuggcaauuuguuucacuuucuuuacguucacuagcaaaguguagguaauaaaaguguuuacuuuagaaaacugcuguuagguuuaguaaagauacacauacacauauauguauagauacaaauauauacauauacauauagauacauacacauauauguauagauacauauuuaguaaagauacacauacgcauacauguauccauguacauguauaccuauguauauauguauauguuauauaugugugugauuuuagauaaauagguagauagagcaauugcaaagagaaagaaggaaggaaaacuuucauaauaccugacacaugguaugcccucgcuacacaauaacuuuagcaagagaguuuuguaaaaauuagaggagcuuuaauagcuuuccaaaaacuuacggcaauuuguagucaaaugguugaauugcagacuuguuguauaaaugcuuacaguauaaagacuacaagccagaggcagauccauucaagaaccaauuaaaucacaaacugauuguaucuuagaagucauuuagucugcuacccaauuugaauagaaauuccauaguguucuuaauagauagccauuuaaucucuguuugaccacaaaguuuauuuauuuuaagaacuccuuguugaaaagcuucauuaaaaauguuuccaucauauuauaaauguuuuccauuacauugaguuaaaaucuucaaaaacguauuaagucuaaacuacugaaagaaaaaugguggcauaggauuuuuaaaaauuauaaacuagugaacuuucaacuuugucuaucaucauucuuuuaauugccuuuuuguucagcgagaagagcugagguuugaagugaacaaaauaggcuuugaauccccagcaaagauccuuaaaaaccauauagauuuggggccgggcgcggugggucacgccuguaaucccagcacuuugggaggccaaggagggcggaucaugaggucaggagauccagaccauccuggcuaacacggugaaaccccgucucuaacaaaaauacaaaaaauuagcugggcgugguggcuggcgccuguagucccaguuacuccggaggcugaggcgggagaauggcgugaacccgggaagcagagcuugcagugagcugagauucgaccacuguacuccagccugggugacagagcaagacgccuucucaaaaaaaaaaaaaaaaaaaagaaaagaaaagaaaagaaaacaccacauagaucuggacaaacuacuuuacucucugggcuuuaauauucucaucucugaaaucagguugaucauuuccugauucaaaaaguaaauaaaaauuuuuaaaaaaaggagaaaagacggaaaacuaguauauuuuguacauuguguucauuaagccuauagcaggcaguuucaucccgugaauaauuuaauauucaaucauauuggauagauauuauaaaauacauuuuuaaaguugaaaaaauuucaucaauguucaaucaaugcucuaaauuuaaaaaacuaagaaauauucaguccauaauuaucuuaaaccauuauaggggaucuauauguaaggacuugccugggagaaauuuuuaggaauccguauuuguuuaaauuacuuuguaauucagagcucacacuuacauaacacacauaguacauuuaaaaaugcccuaacuaauguuuuaaguaccauaaauagaguuuaauggguuacuuugaucuuugccuuucauuucuguuuaaacguauaaaauaaugcuuuaacauauauugauguuugcacugaacauuuagaaaaauuguaugaugaugauuaaggagugguaugcauuuuucacuauaaaacagacaaaaucauucugacagacauuuuuccuccuuaagaauaaaagcaauuauucacugaaaagaaaacaaaaucaacuuauuucaaauucuuuccguaguaaagcacauguacacagagauaggauguaauggagccacugcuguuccagguaagaagacuaaauucuacgccauauccuuaaucucucuuagguccuuuuuuauuuuuucucugaaaagugaugaucaaaaugucugccuugugccccuugcaaguauuuuguagguauaaggucagauaauguaugugaaaauuuauuagauauuaggaaaaucuauuauaaguacaaaagauuauuaucagauagccaugcacauaaaguagucauuuaauagguuuucuuaaaaguuuaacacauucaaaaauguaaguaacgagcauacuagguaguaagccaguuuccagagcuacauagauggauuaaacauauuccuuaagaauucagggacuccguaucaagagcuuuauacucuuugauucaauaaauucaauucuggggauuauuuucuacagaaauauccccaaauauggaaaaaagauaauaggaaaaaacuucuuuguugcuagguuaccuauaauagcaaaaacaucugggauaauucaaauauccaacuauaagcauaaaacuaaaucacagaauuuuaucauugaaauaucagaaccauucaaaugauuauuuaaaaggauaugauuggcaaaugcuuuugaucuaaugguaaguaggcauaaucaggauggaaguuugugaguuaacuguaauuaccaguagguaaaauuuuauaauacaagcauuuucauagggggaagauacuaaaaguaaaugugcaaaauuauucaucauugucauauuugauugguaaaauugcauuaaaaaacucaaagggagagacucauuuucauauuuuccaauuuuugauggaucuauuauuguuauaacuuuuacaugauaauauaaucuugugagacuaaggacugaccuuagucacaaacaauauuacugccaaauacauguuuaacucaaauauuuauaauuuucuccugaucuuguuugccacaaaaaaugaaaacauaugucaaaaauguccucaauuauuucauuuaaaauauauaaaucaugcuuuaauuaauaucacucugggcaagcaaauagaaacaaaauacuuuucuuauuuccacacauuauguuacugauguucauugaaacugucuuuaacgucuuuuaagaaguuaacuuuuaugaccaacacauuuugucaaaaccauagccuaaguggauaaaggauuaaccuugugcaacaaugaauuaacaagaucuaaaaaagauaaaaugaaucacuaaaugauuauaguuaacaaaaaguuccacucuacucccuuuuggagaacgauggaacacucuuuuauugaaccccauuauccuaaugagaagauagucuacccuugaucacagccaaaaggcuagagaagauauuguaaugacuuacugccagugcuuaaugaagagauuucaccauuauugaaagcacaucuguuugauuaacgagucucuuccaagauacaugcacccuuucuauuuaguggguggcagaaggcauagacugcacauaugccauaguuucucuucuuuugugaagggaaaccuuaucuaccaauggcaaauguuacccuuaacagaccucuuuuuuuuuuuuuuuuucagauggagucuugcucugucgccaggcuggaguacaguggcacaaucucaguuuacugcaaucuccaccuccagggucaagcgauucuccugucucagccuccugaguagcugggauuacaggugugcaccaccacgcuuggcuaauuuuugcauuuuuaguagagacgggguuucaucauguuggccaggauggucucgaucuccuggccuccugauacacccaccuuggccucccaaagugcugggauuaccgcgcccagccgccuuaacagacuuuuaagauggcaaagucaguauaccuuuguuuauaucuugucuuuguuuauaucuugguucaaucacccacugacuuugugauccucugcaagucauuuaacuuaccuuugccuuagacuucuuuucuucaauaaaagauaaugauaccaaacuuauaggguuaucgugaggaucaaaugagauaauaaauuuaaagcucuaggagcaauaccuagcacaauuaggacuaauucugggugccuagcauuagauguuuguaaauaaagugaaaaaacuuaaauccauuuugguccuuaauaauguuauuggguguaaaauuuaguaauggauugguggugguuguuguuguuuucuaaaaccaugaugggaugauucuauuaauauuguuaugguuugcaaagaauuauccucaguuacucugccuuucaaagcccuagagcacacaaccuugaaaucuugaaauuccaaaguuguucugaaagaaaaaggauuggauuagggaguugaauauucaccacuugauuguuuuaaaaagccaaucuuuuuagcuuacauaaugcaaauauucuacuuagaggauauauuuuauucuauugucuuuaucacucaaaucugaagguagagaaaguaggaauaacagggcuuaacuuaagcuuuguguuuuuuuuguggaaaaucauacuuguagaaggccacuugauaucaaauccaguucuauugcacccacucacacagcuguguuccucuagaaacauuuaccaccacugaauuugaaaauauucacccauuuuauuuaauuggugugacaugcaagauaguuccaacauuggaggucuugguaaacuauuaaacagagggagaaaguuacuggcagcuuaagaguuuugacuuaacaacuccauuuucaagcaaugcagacauugagagaagcaauuugcuccuugaaauguuggcaucguaaagacucuagcacaaugcuaauuauauaauaacuacuuggcaaauacuugcuaauuaaauggaagaagcagaagugagugagccagaaucagaucuuucuaccaauuuuaaauaaucacagaauaaucagcauaagaauagaaaccuuugaaaucaucccaguaaauaaggcuuaauuuugaugguagcuucuauacaucuaauguaaguuuaaucauuugauauuuaaccagguuguucauuuucucauuaaauguuauuuaaaucuaaaugcuuuuuuuuuuuuuuuuuuuuuuuugagacagagugucacuuugucacccaggcuggagugcaauagugcgaucucuguucacugcaaccucuuccccccagguuccagcgauucuccugccucagccucccaauuagcugggauuacagggacgugcaaccacaucuggcuauuuuuuguauuuuuuaguagcgacagaguuucaccauguuggcaaggcuggucucaaacuccuuaccucaagugaucugcccgcuucagccucccaaagugcugggagccauuacaggcaugagccaccacuccuggccuaaaguuaaaugcauuuuugaaugagaaaacuacucagcuaaauaagaaauuuuuuuccuggacuuucucucuaauuuaagcaauaaacaguuaugauuacuaccacaagugaauauggagguaacauuucccaggcuguuucuguuucugccaugacagaggguuuggcugucuuggaugcuguucccuauuguaugguguuugaaauugucaggucuacugcaagggcauuauucuuggugcuacuaauugagggauguguauugucauauuacaauauuauuuguguaacuuuacucagacacuuguacugugcaugguuaugauuuucaggcaaguacuuaagacacauuaaaaaaaaaaaagucacugcauaggcaggagugcauagaagagugaauuacucuagagcuuccaaaaaaugucuuuacacaauaagugacuauuuagcuaaacacaaaugauguacauccauaauuuggucgaaucacuaguuuguaauaagaugcauucaaagacaaauuccagggaugaaaaauaucccugacaaauaacuccauggugucaaccucaggaaaaaaggcaucuauaacuuaugcuaauuagguccacugaugguuuaacuuuaagggacacaaacacaccaccuuuucaagucccuugucauagaauaccuguuuguaccuccuauggacucugacauguguucuccauaauaauaagaaaaaggaaauuuuaauucuacaacacaagcauuguuuuuuuacuaaucaauuucacuaugucagaguggauagcauacugauugauguaucaaacuuaauacuggauuucacauuccagaaaagaaauagcaugaaauaccuaucaggguuucgaugcagacaucuaaaauaaaauuaaaaaaaaagauuucacuauuuuuagccaaauauuuuucugaaaaaaaucuaauuucuaaugaguucuauacuuuuuuuaaaaaaaugaaggcuauucaaccuuuagaauuuuagucuucuuuauggaaucuaugagaauaugagaaauagcuuuaaaauauuuguacauaugccuauaucaacugugaguaccaaaaaucaaugugccuaaaaaugacacacaauuuucaacuaaauacuagcucguuucccgaauauaucuauuacaguacuaaucguuuaaacuguguauaucagucaucuuugacauuuuuucuccagucuuuacaucuaguaaaucauugauuuuuuacucuucucucauuaccuacuuaaaucuucuucauucccucugaaaucaauucauacuuauccuauuguacagccuucugauuucucucucugcugcuaaucuuccgcucuucaguccguucuaaggacaaccccaugcuaaucucucaaaagaguugacuuaaaauuaucaccucauacauaaacuuuacaguuguucauuauuacacucuggacuggcauugaagaccccaauuuauauuuuuuacccuuaccauuuuuauaaguuuucuauaugauccuuaugauccgauuaaucuugccuauucuuccgugaguucugaaggcuaaaggugaacauacugguggucagugguuggcaguggaaugugaaaaguacuccuaaagaagacuuuaaguaugauggaaaauuacccuggacaucuauccccauuauauccagcugauacuuuagauaaauguuauuuauuuaguuuaugaagaaauaaauaaaauaaacaaaagacugcaaaauaagcaaucaguaaaccaugaaaguaaaggcagauggacaaaaaugccacaaacuggcucacuggaacacugccaaaacuagcuuaaauuuucuuuuuuuuuuuuuaacacagucuaaaaggagaagcaagagaaugaaagcacauaauuauuguuuuguucaguaaggagaguuuauuauauggcuugaaaaacagcacaucacaucuaacaaaguuaaucacuucaugccuggauuauugcuauugccucuuguuaggguuuuuuccuuccaauuuuuuauauuuccuaauuauccucuagcuccauccuucgguacccucuccauuccugcugcaaucucauuauagaauguauucuuauuuccuacuaccaucuggaucacuuucaucuccuugccagcacuugcggccucaugcaauauucaaaucugugucuuauauccuucauauuaaccuuuuauuuugguuguauguauaugauuccucacccuccaugcccauuccuaaaucagccauguugcucauaauauuuucccaucgaaaauucccuucacagucuucaccauaaauucauauccuuugucuuuucgggaacagcuauuauucucugugcucuggucuuucuaacuccuguuugcuuaucuucuuugucaagcuuauugccaauacacuauuauguauaaauuucauucacaauacauuucuaauaagcuaacaauuuuaccagcaaaauuauaagcucguugugucuaggcacccaucuuugcaauucuccuguggaugauaauauccagcacagcaacagaugagcagucaaaaaugccuugugggagccagacaguggaguaggacucuccagcaagcaucccuucacagaaacaucaaucugaacagcuaucuaugcacaaaaauaacgucacaagggcuaggaucuuuuuaccacgugagagaucacagugccucguuguaguacaauaauaagaaaagacacauugaaaggguaggaaucacaguuuuacaauacccacaucaccccucucccaaccccaggcagcacaguauggaaagagaugccauccacuagauagaaugaaagggaugugagcacaggauuuuuccuggacacaacacuggguacucacaggaaaacucugcaccagcagaccccucauagcuccauauuccgaaccaguaccagcagacugagccuauagacccaccaggacaccaggucucaccaggugagaccacauagccucacacuuuaagcuugcuuagugaaauuuaucucuggccuacacaacugccauauugacaucaguggucccaggcuuuggguagcccucaggagcaagcaauucucagaggcugugggcuuccagccaaacacaacaccuagccugcuguaguggguuccaggcuuuuggcagugucaugccagucacagcuguccagggauucuggcaugccccagcauuguaccagcuaaagcaggacccaggauucuggcagugcuacacuggucaacacuggcucaggagucugaugcgccccagaacuaugccugccacaaggcuuuccuagaaaaagcaagacuauaaaaauuggaauaagcaaugacuucccaugcacaggcuuugacauagaaguacaaagaucagaacaaugagaaucaugacaacaccaaacagauauuuuaaggugccagugacaucauacagaaauagcaauacaugaagugccugaaaauaauauaaaauaaccauuuuaaagaagcucggagaacuucaaaaaauacagagaagugaacaaaauaaaacaauaauaauaauaaguaaaaaaaugagaaauucauuagagggauuaaauuaaaaaaaaaaacagaaauccuggagcugaaaaauacaaugaaagacaaacaauacaauagagagcaucaaaagaaaaacugaacaagcagaaaacaauauuugugaacuuacagacagguuauuugaaaauauaaagucagaagaaaaaaauaaagaaugacaaggacugaaaaaaagcuuaugaaacuuaugugacagcaucaaaaaggcaaauuuucauaucacaggauuuaaaugguaugucuaugggaaacucacuuugccuguaaaaauacacauagacugaaauugaauaaauagaaaaauauauuccaugcaaguagaaaccaaaagagaauagaaguagcuauauuuauauaagauuaaauggacuccaagucaaaaacuguaaaaagguaaaaauaagucauuauuuaauaauaaagggguuaauucagcaagaggauauaacaauuguaaauacguauguacccauaacuggagcaccuaaauauacaaaccaaguauuaauauacuuaaaaagagauauagacugcaauaaaacaauaguaggagauuuacaacccauuuacagcaauggacagaucacccaggcagaaaacaaagaaacuuacacuugaacuacauucuagaucaaauguauguaacagacauauaaauaacauuccauccaacaacuacagaauaagcauuauucuaugcauauucauucucuaaaauagaucauaugguaggccacaauucauaaaaaaucagaauuuugaaaugauaccaaguaucuuuuaugacuauaauaauauaaaacuagaaaucaauaguuugauugaacaggggaaacuucagaaaauuuacaaaugcauggaaauuaaagaacgugcuucugaacaaucaaugagucugugaaaaaauguucaugaaaacuuuaaaaaauuucuugagaccagugaaaauggaaacacaaaauaccaaaaccccugggagagcaaaagcaauucuaagaauuacuuuauccauucuaagaaguuuuauagcaauaaaugccuauaucaaaaaagaagaucucaaguaaaugaccuaacauugcaccucaagaaacuugaaaaacaaaaacaaacuaaguccaaaguuaguagaaagaugaaaauaauaaggaccagggcagaaaucaauaaaauagagacuagaaaagugauagaaaagaucaacaaaacuaagaguugauuuuuuuagaaagauaaacaaaaucaacaaaucuuuaguuagccuaagaaaggcagaaagagaaagacuaagucagaaacaaagagacgagacguuauaacugaugcaacagaaauacaaaggaucaucaaagacuauuaugaaaaauuauacaccaaaaaauuggauaaccuagcuuaacuggauuaauuccuugauauacaccaucuaccaagagugaauuaugaaaaaaaaaaaacagaaaaucuuaacagaccaauaacaaguaaggagauuaaaucaguaauaaaaugucuaccgucaaagaagagcccagaaccugauagcuguuuggaaaauugaauauucacaugugaaaugaugaaauuacauccccaucucacaccauauacaaaaaucaacucaaaauggauuaaauacuuaaaucuaagacccacaacuuugagacuacuagauaaauacauagaagaaagcauuuuuauauuggucagggcaauaaaacuuuuuagauaugacaucaaaagcacaggcagcaaaaguaaaaauauacaaaugggaacgcaugaaacauaaaagcuucugcagagguaaaggaacaauaaacaaaacgaagagaaaaucuacugaauggaagacacuauuugcaaacuauaugucugauaaaagguuaacauucaaaauacauaagguacucaaacaagucaacagcaacaauaaaauagccugauuuaaaaaugggcaaaauaucugaauaggcauuucucaaaagaaagcauagaaauagccaacagguauaugaaaaaaaauguugaacaucacuauuaucagauaaaugcaaauuaaaacccaaugagauaucaccuuauaccuguuagaauggcuauuaucaaaaugagaaaguguaaguauuggugaggauguggagaaaaagaacccaugcacacuauuugugggaauauaaauuaguacaauugugaaaaacaggauggaggcuccucaacaaauugaaaauagaauuaccauaugauacagaaaucccacuacuaggcauauuccaaaggaagugaaaucaguauuuugaaaacauaucugcacucccauguuuauugcagcauuauucacaauagcuaagauauugaaucagcuuaagcaucuaucaaaggaugaauggauaaagcaaaugugguauguguguuuguauaucuaucuauaugcacgcacacacacaauagaauacaauucacccauuaaaaaagaacgaaguguuaucauuugcaguaacauggaugaaccugaaggacauuauguuaaguaaaauaaaucaggcacagaaagacaaaagacaaaauaucugaauaggcauuucucaaaagaaggcauacaaauggccaacagguauaugaaaaaaauguucaucaucacugauuaucagauaaaugcaaauuaaaacccaaugagaucucaccuuauacuuguuacacauaaguuauaagcguauaauaagguacguuauguauaaccuguacauaaggcacuuuaugcauaacccguuauaccuguuccaucucauucauauguggaaucuaagaaaguucaucccauagaaauaaaauaaauaaaaugcugguuaccaggggcuaggguuucugguggggaaugaggagguauucauuaaaggauacaaaauuucaguuaacagaaguuauaaauucaagaguucuauuguauaacauggugacuauaauuaauaauauacuagguccuucaaaaauacugaguugaagugaaguuuucucacuacaaaaaagauaacuaugugagguaaugcauagaauaguuagccagauuuagucauuucacaauguacauauauaucaaaacaucauguuguacacaauaaauacauuuugccuguuacuauaaauaaaaauaugucuuguaacugaguuccaaaguaacugaaaaaaauaacauucuuaauuuauuuuuuggaugcuuugaaguaucacguaaauaauaaucauauuuagaauuuauuuuucuucacacauuauuugauuaauuccuuucacaauagaaaguaaacuuacggcuaaaagcucccucuacugguucucucuaacauaccugaauaaaaguuuauauauauauauguguguauauuuuaaaauuauauaucucuaauagauauuuccuaaagucauuaauuuauugaaaaggcagaaaacucaacaauguuacuuuuuuacuuuucugugaccuuacucauaugauccaguuucugaagaaucuauguucuauuguucuuaauccuuuauuucuucagaugaagcauuugauuauuuuucuguccauaaacuguaaugcaucauccguagacccgcaaccaugcuuagcacuucaguauuuccugggaggcagugcagcacagcgguugagagcuggaacccuggagugcagcugccucacucugaaucaucucugcccuuuaguagcagcaacuaacagucaaguuaguuaauaucuacuugugucaguugccucaugaaagauagguaaauaacaacaguucuucccucagauguggugguagguuuucaauguucagguaaaacacauaguucaggaaaacacuuagcacaaggaaauaaucaauccucaaauccucacaggcaaugucucagugccccaucaaaagcagagaauaaggacaccugacugagucuuuuuuucccauugucuuugacuuuuuuuuauaguucugaacugccacaauuuugcugccaagauucuuauacaauuauccuuugguauccgcagaagauuaguuccaggacccugcuccauaugaaacuccaggaaugcucaaaucccuuaugucaaacggcccaguguuugcauauaaccuauccacauccucccucauacuauaaaccauuuccagauuacuaauacaauauacaugccauaugaauaauuguuauauuguauucuuaugaguuauuugugugguuuuuuuauuuuggcuuguaauugaccuauaauaauuguacacauuuaggguguacaaagugauauuucagugcacuuauacaauagguaaugaucaaaucagaguaaguagcauaucugucacuuggaacauuuaucaucucuuaauguugggaacguucgaaauccucucuucuagcuauuugaaaauauagacuaaauuauuuuuaacuacagucacccuaacgugcuauagaacacuagaaguuauucccgcucucuagcuaaaauuuuacgucuguuaaccaaucucucccuauuacccucuacucuuccaagcugcuaguaacuacaguucuauucucuacacauauauaugcauauguauauauaugcacauacauauacauguauauaaauagcuauaaacauagauaaguaauacagagaagguagagguguauagccacaauguauauuuaaauauauacauuuauauauacauguuucaaaccaaguuguugguguuuuuuugagacagagucuugcucuguugcccaggcuggagugcaguggcgcuaucucggcucacugcaagcuccgccucccggguucacgccauucuccugccucagccucccaaguagcugggacuacaggcccccgccacaacgccuggcuaguuguuuuuguauuuuuuaguagagacaggguuucaccguguuagccaggauggucucgaucuccugaccucgucaucugcccgucucggccucccaaagugccgggauuacaggcgugagccaccgugccuggccacaaacuaaguuuuuaaaagcucuaauguaaaaccauauugacugguuuucugguaagaauggcauuuucaggaauuuauauuuaucacugaaugguaaaauuacaaagauuuuucaaaaaaagauguaugcuuucuguauaauaccggauuguuaauacugcuuacagugaaggucauuccaauaacaauuuguuuugaucaucaugauauuuugaaaacauuucagcauauuuucaaaagacucuuucaaaauuuagauuucaugguuaaacaucuggauuucuuucucgguucauuuagcuguguuuaauauauacacgcuguacuccuucagaaaauaaaaauagauuuugugaacacuccagaggugaaagauaacagcauuacucaaaauuaaggauuuuggaaaacucaguuuggacacaguuuuaauuuuggaaaacacaucgagauuccuugaggagaggauauuaugcauauuuuagcaucauuaaguaauggcagaguuucagaauuaugaagcauguucaaaauucauuuguucaaguacaaguaacaucacaaauauuuaaaaauauuuagaaucuaauauuaguauaucuugcauuauguaguuuaaaauauugguucagaccucuuaccuuuagaccauaccacauuuuaaucuauuuccuugauguaggauauguugauuuccucagaaucucuguugucuaaauuuugugugacaccuacagucaguucuagaaccucacauaagauaauuuucugugugauaauaucaucauuccuucuuauagauuuugaacuagguuguugaacauaaaucuucagauauacuuuaugcuuuuuuauuguuauuauuugggauuucuuuauacuaaauucugugcauuuucuucuucucagucacucccauuaggugaacuccuaacaugcuuuuugaaaacaauuuuaacucucuauauauuuauauuaauaaaacagcucaacaauauauagcucuauacccagccuugaaaaauaauaauacacauuucuccaguuggggucaaauauaggaaaaacuaagcugcugccagccuaugaauuugucucaccuacuguaccucuguaccucaccuuuuauuaguacuggguaauggaaaaacauccuguauuuuggugaccaaaaucauagguacaagcuaccagcaucuuuauuauuauuauuuuaagcaagggaacaccaguuaaugugaacugacucauuaaauaucuauaagaaauuaauguaccaauguagccagcaucuugaaaauaaaugcuaaaugaagagaggguaaggagauggguuuauguuuuauagagaauauuugagcaugcagccugcaaaaacagaaaaagaacuaugaaacucucauaccauggacauggucaaguaacagauguggaaaugaaagccucuucucugugacuucauuuauccuauuucuacccucaaacaguauuuccuuucucucaucucuccucaagucuugucuggcuccuuuucucucuuccuuuuccucauuuauauuucuuucucaguccuggcucuuccuccaugacugcacauccucaucagucaaucuuaagugccagcaagcagcaacuuuuuaaaugucaguuuauucgcuauaggaaaggguagucaaacuaaguaaaugucacuuaaucuuauuauaauaugagacuguacuaguucaaacaaauuagcaaaauagucugaguuauuucaaaaucuaaaguuagauuuuuuaaaacaugguuuaaaauuuaaauuuuaaaaugaauuuaaauguauauauuuuauuucuuguuuuuuguuuuuugcaguuaauuauaaaacacuauaaauaauaagcaaacgaauaaaaugacaacugaaaagaauaaugcuucauccccaaauauucuguuuuuaugauuuauuuccuauguaaauauuuauuuugaugggaaauagguaaauuugacauuggucaaguuuguagcugucacaguuucaaauuacuaagggucuggauuccugaauguuugacuaaacugaauaaguaccuauuucccgugggcucuugaaagaguagcucuuagcaaaaucagucuauuuagcucaucagagacuuuuuagccagcauaggauuuccauucucaaucccaauuaauaucuuuucuauuaguggucuaugauuauauauuagugcagucuauuuuuuaugauuagaauaucaacuuuugaaaauguaguuucuuuuauacauacacagucacacuuucacccuguauccuugggaauucaaccaacugcagauugaaaauacauauuugaaaauacaaaaccauuaaaaucacaauaauaaaaaauaaugcaaauagcaauacaauauagcaacuaucaauacagcaucuacauuguauuagguauuacaaguaaucuagagaugauuuaaaguauacaggaagaugugugcagguuauagaaaauacuaugccauuuaaaauaaagaacugaagcauccgauuuuggauuuugaaucuuguuaucuauggggucauggaaccaauucccccacggauaaugagggacaacuguauuucuuuuugguaugauggccaaaucaguguuaaagaaugguucaaaaucuaucaucuggaacagaagaacaacaugaguaaaccuuugaauuauaaaugcauugaaguuaucucucuucuuuaaaaaugcaguagaauaucauauacaacacacaaaaaaaugaagaaggcaauuccaacaagagaggaaaauagagcugagaaaagcaucugacauacaauauuuuccucacugacuuacugguuagcagcaaggaguacacgauaaauuucaaguuuaacuggaacagcaaggugaauuuaugguaaguugaaacaaagucauaacaugugaagagaaaacaaguuuuaggaaaugagaaaugcaaguuucuguauaauaagcuuuuaugucaucggcuuuauaaauaaaaaugauauuugcuuugcagggucaaaauaauaaaauguauauuacaggagaucugaaacaaauuuuaaguagcuucuacaaacuguuuugaaacuucuaugauguucaaauucugauguuaaauguguauaagaaaaaaauagaaaucuauuggugaaucuuggccacuguacuguaucugaaucuacagauuaauuccucagcauaugauagguacucgcugggaauaauuguguaauuugggcaguuagcauuagauaucacucuauucucuaucauuuuggaugcuuuuauauauauauauagacaaaaaauguaauuuuuacuaaauaucaaauaacuauugacaaaaacuaaggaauauauacaugaguauauuuuuucaaaaaauuauuuaauacuuucuggguucuagacacugugccuuaugcagaauuucaguggugugcagaacaaaaccuaugcccuaaaggaauuuuggaauguguuaaagaaauuaaaucccaggcacaaauaauuuuauacguuaaaaacacacuucuauccgugcuguuuuaaguuucuugaaagaccuuaguuuaagauuuuaauguauuccucaacugaagauacuaauuuccaggcugccaaucugauauugugaguuguaucaacagccuacagaucauuuuuuagauuuaugaaagguuucuugauuucaucucacucugcugcucaggucuuugaacccagaucuuggacucuguucccuaaauguucauuaaacauugaaaugagcaacuugauggaaauaaaaaacaguuaagcaaauauuaaaauaaaaauauauaaaaauauuaagcaaauauuaaaauaaaaauaaaauaauaaauaauaaauaaaauauugcacgugauuccaugguuccacgugauguguuucauagccuagcaacucuggugccucaguccugcuguuguuccuaacuugucauccagccgcacugugagacacuagcaagacucuccccucaucccccaucaugguuuuguagcuuagauaucaugaggcacucguacaaucuggacacagccaggccuaggggacuuugauuucagucucaguugccauucacuagugauuugacuuuugguacaucauuuaacuugcucaaugcucaguuuucucaucuguaaaauacaaguuugugcuacauggccucuuaaaucaccucaagcuggaaaaugucaugaguuuaugaacacaauaaacacuaggcuccugaaauuuuagcacgguccuaguuuguguucuguggauagaagguuccuuugaaaauggaagcugauguugcauucauauaaaauaaaaagaauugauuauuauucaucaaugugguaaccaucuaaaacuaagguauagaauagaaggcauccuuaggaaugggaagugguggaaauaaaaacaaggaugacaaguaaaauuucacuaagugagagaauuaaaaacucacuaagucaaugaaacagauaguaggaguucuauucacugaauuauuuagccacucauucaagaaacuggucacaaauguaaauaaaacagaaaccacaguccuuguauauauauguugcggucaggaggaaaggauggggcauauuuacauauuaauaaacauuaguuauaaauaagaaaugaaucagguaaaagaaaauaaaaggggguagagauuauguaauucaacacuuuagggcauacuguauaauuacaagccuaucaaguuacugagauaaaacgucaugaucucaauucuguucaauuauauuguggacauuuauuggauguguacaauguuauaaaaugggaugaggaauucagaaauauguccaaggccuagggguuuaaaaucuaugggaaaacaaggaggacauggagcaauuaaaugacaaugaaaguuaaugugauauuaaaugucaaaauuaguuucagaaccaauaauuuuuauuggaguagggaaagagagcaaacugaguucgucaccaaguuauaaaaucuauuuauuuuaaauguuagauauauuauuuucaucaucaaagucucaguauguuucuuuugauuuuugguuaggaaugaguuuuaagggaaacaaucaaauuauacaucaucagaugauaaaggaaaccucaacucaauagcuguucagacacaguagauaauggcaagacguugcuggcucacaauuaauuguguaugaagcaggagcagagccauucuuuugugacuggggaugauuaacuccccagcuauuaaucaucuaauuguuaagauugauuaccuaaaaacuuguuagcauuuuaaauuagcucuacugucccucaccuuuuaaaaacuauguaacuggucaaaacauguuagagcuuugauuagauuuacaagaagcuguccauuuuuuguuauuuucaaggugaaaaucuuuccgaggguuuuagagagguagcuccuuucacauuuugcauagaaaauggauguaaacaauaaagagauaagaacaaccaaacugguauaauggaccucagggcugugaucauaagggauaguaauuuaauaaacucuagccuguguuuuauuauaucuauaucuauaucuauauuuaauacacacaucugguagaaauacaaauaaauauauauauacauauauuuaaaauuacucaucuauacuaguuauuguuuaacacaauuuccauuuauuuuuggaguuugacacaacaguauaaaugugcauuucucuuaagcucuuuuuuuuucuuaauacaaauaguuuagcacugacugcuucaguaaccuccuagguaaccuguguacauccucuugccuuucugaaauugacacuuccauucugcuuuuacugucgucuuucaaaaaucagaaucugcucauaugaaucuccuguuuaaaacucacugugaucaugccucuauuuuaauugaaaagacuuuugucucaacaguauauguguaugggucagcuguuuuaagcuacucccuggagguggugaguugcugucugaggagcccuaaugaagaacagguuugcugugcuggggcuuagucagcaauggaaagacucaucagaagcccaccuuccugagaugagaaaguguaauacuucaacugagcuccgcguggaucagccccagaggguuuaauuuucuacuucauaauggaaaugguuuuucauaguugaaaugaaugguauucaacacuuguggucaaguuuaaaauaucaaguagccaccucucagaguuuuuucugaacagaguuuaagaagaaaccaaagccaguugaucuaugcuaaauauauuuccacugagaacgacgaccuggcacuaagaggccauccccuucuaugguaaacagccuacacccugccugguucugaccugauaugcagcacaguacuacuucuggaacacugccacauuugaacuuaagccuuucauuuaagaucaugguagauugucuaaaaggacagaaagcugaggauuuuauucaacucgaagaacagacugugcuuuuuuucuacuaguuaauacauguuuuaauguguaauggaauuaggacaaaggcuguuguuucguuuuuuuuuuuuuugcagccuaaaaauuguguauauuaaauuguauagauuuacgguguacaaccugauguuuugauucagguauacauugugaaaugauuaccacaagcaagccaauugacacaccuguagccauuaucuucaguaacuucuggaagauacagauaucuaacaaacaagcaaaaaaccaguaagugccaaugacaaaacuggcucgcauuauuugcaauaaacaucaagggcucuccauugcauaucugauaagggugaaacucacuugcaagucauacaagcuuuccgugaccuccccacucccucauuacagcuacuuaucuugacagaccuggucagaccauaccacucuuaucuucuucuucagaccccuauuauuauuauuauucuaugcauuuucucaagaugaacgcuuuaccugaaacaucacgccacacaacuaaaucguauucaucuuguacaacucagucuagguauugucuccccagaaagauguccuccgucucugcagguucgguugggugcccgccuccucagcgugcuuccugagcaugcucgugaugcucuuugccaccgugaguugaaaucgucgguuuagccauuggaccccuucucuacuuagugagcaacaacauaacagcaggugcuuuaucuuuuucugacaaccagaaugcucagcaaaaugcuagguggccuaaauaaaaucucccaugaguaguacuucaauggacaucuagggggaacaucagggacaucucccuguccaaaaaagaaauguuuacaaugagcauuuucuuaagacccugaccuacauauuuacagagcgaauaaaaucgucuucagauauuucuccuacuaacaauuacacauacgcuucuauaaauauuacuggguagagcuugcuauuauagauuugagaauguucuuacauaauaccaaaacggccugaaaaacaugacccuguaaguuaaugaucugcauuuagucagccugacagugaaaauugccggcaauugggaaacauguacgugaaucacaacgaggcuauccaaauuauuugguuuuaguguguguggguaagugcugguguuaaauuucuuaugugaggaacacagaggucaucucaccaucuucuggauguggcuuacaaauggccucaucccuguauccuuccugugguaagugcccugggaucuaaagcaucauucuccucagugguaguaaacuacugacuuugauuaugcuuuaagaaugauaaaaucagcuccauuaguaugugcauuuauauuccaaguacaccaccuaagcuucugugagucaguuguuuccuggaaauuaccaaaaucgguguacauaaucugucauuuuauccuacacaaugcaaaggacacuguguaacagguaaucguuuauuggacaauagcgguaucauggggauaucucguauuuauuuuauugauuaccugaaaacugcugauacugguuuauaggaccauauguuuccuauaguaaaugcuccuucacauuucaacuagaauuacaaaauaauuccaaauucaagcauuuauaacuucagcagaaaaaaaagcaaaaaucaaucucuuccuuaucccuauaauuccccgacaagaaaaaacaaaaggaaaaccaagcaaguaaauauaucugguuauauuuaaugggcaugacugugugguuuauuuuuaaaaauggagaggaaaagagaaauaauauauuuugaauauaugcuauggaaaaucuguuauagcuucuuuacuaauauaaaguauuuaaacaugacaauggcauuauuauuagguacuuaauguucauuuauagauuaguaaacuguaaaaugaggucauucacaauccaagacuacucuuuacaccacucuaauuuuggaaguauuugugaaauuuguuaauuguuaagaauaguaauaaucuaaguguuggcauuuauuuaauugcauggcugaguaaaauuuauuaacauuucucuggaaaaugagaaaauuuagauuuucaugcaagaauauuagcuuaaaauaucuuagcauucaguucaucuaauugcccaccuaaacaagaaaauuuacguaauugcuuagcaaacacuuguuauacaauugaaaauugaauggcacuuuaaaaauaaugaaguaauuuggaaugcagagaugaaggccccaaaauaagggaagcuaaaagaaaaaaaauaguucucuuaccaauuuuauuuuauuuacccccauuauuuacuucucaaagcauugggaauucuagacugugaaauuuguuuuacaaucaaaucauaaaguguuuaaauauaauauucauguauuguuaccuagauauuguucccuaaauaguuccuaaauguauguucuagaaauauugaggaaaacacuuuuugaaagaaaaccuuuguuucucuauaccaaugauacacuguagagaauaccuuaaauguuaaaaaagaugccuauuaauauaaaauguaaucguugagguuuucaaaauaccccugaaguauagccacugguccuuauuguguccacccaaaguauguugaaagccuaguauaacugaccaauggguucauuuugacugcugcccaaauagagccaauuuaucaagacaggggaauugaaauaaagagcuuaauucaugcagagcuggcugaacgggagacagaaauuuuauuauuacucaaaucagucuucccccagauucagaggcuaggguuuuucaaggauaauuugguggaagaaagggggugaccuggcaaugggagcuugcuaauugguugggggugcaaucccaggggaauggaagauguuccucccgcaugcugagucccucgggguggggucacuggagugauuaguggguccagguggagccauccaucaucagaugugcaugcaaaaaaaccugaaaagacaucuggaaaggccaaucuuugguucuacaaauagugauguuaucugcaggaguaauuagagaaguuguguaucuugugaccuuugaaauaaugguggguaauccuuuaugucuacaccguagcagaauuuaaguuccucucauccuuuaaaccugguggucucucauuagcuuuacaaaggugguugagaagggcuauuaucauuuaacuauaaacuaaauauuuccccaaauuagcuugucccaaacccaggaauaauuaagggcaguuugaaggcuaaaggcaaaauggagguugauuacaucagaucucuuucacugccauaauuuucucacuguuauaaugucugcaaagguuguuuuacuaguugucagcaucugugaaugaaaccuaguguggaaauagggucuuuguagaugaaaugaagcuaaaugagguaauacuggauucgggcagacccuaauccuauaugaccaguguccuuguaagaagagacacagauauacacaaugaggagaccaccaugugagugagcauggaggccgagacuggagugauaagccugcaagugaagguccacgaaggacuaacagcaaccgccaguagccaggagaaaggccgggaacagagucacucagaaccuccagaaaaaacaacccugccaacaucuggguugcagacuuuaaccuccacacugugagagaauacauuucuguuguuuuaagugacccaaucugugguuuuguuucagcagcccuaagaacuaauacacuggacacauaaaaguuuagauuuaggccaggcaugguggcucacgccuguaaucccaccacuuugggaggccaaggcaggugcaucacgaggucaggagauugaaaccauucuggcuaacacagugaaacgcugucgcuacuaaaaauacaaaaauuagcugggcaugguggccugcgccuguaaucccagcuacucaggaggcugagacaggagaauugcuugaaccacggagucggagguugcggugagcagagaucucaccauugcacuccagccuggcgacagagcgagacucugucucaaaaaaaaaaaaaaaaaaaaaaaaaaaaguuuagauuuaacagcaugcuucuaaagucagaggcucaucaggcacugaacuggaaucuuacaaagugauuaaaaccaaacggaacaagacccaucuuuuuucaaagaugugucuuucaguauugacaaauagauuagacauuguuagcaaauguacacauguggccaucucuuguauccucauucaaaauacaggaaaaugcucuacuaugcauuacacugauuugggaaaaaaaaauaaaaacgaacaguuacagggcccuaacuauucaacaguaacuguucuaacacuuacaauguacuacuucauuuaaucaccaaaauauuccuaagacuuaaguacuacagaugacugaaaauuguuauaagccccuugagauagcaaauuggcaauaagugagauuguaggaauguagccacuuccaaguguugauucuucaguuucucaccuuugauaucuugcauaugacuuucacuacuacccaggcugcaacaucuagcaaaugaaaauguggggcagguaguaacguuugaauuccagaaaacaacuuuuuuagcauaaguaugucccaacgagugcacaggacauauuacuacaaaacaaaacaaaacaaaacaaaaaagccucaauaaauuaaauucagcggggaccuccauauuuuaucuggcaagcacacuacuauaagaccugagcauugggaacaaaaugcaauagccuauagagaauucugaaguuucacacaagaauucuaaaagaaaauaccugguuauuauuucauagagaaccaacuuucauaaugucuucucuuauuuaucuuuguauccuuguuuuugcuacaguuccugggaaauaguaaauauaagaaaacuacugauugaacugcauugaccauuuagcuaauuucucuaaauauaaaguguguucuuuaaauuaccuuaauaguucuucccaggugagucauuaguaacaauaauucucauuuguaguuuauuaauugaauguaaccguuggcuauauauaucaucauucugaucaacuucuuugaaccaauuugugaauauuuugugauagguauaauuuuaguaagucuaaauaaguaugaaaagguuucuaacuccuuuaguucccuagggcugcuauaguaauguaccacaaaucgggugaguuagaacaguagaaguuuacugguucagaauuguggaguuuagaagucuaaaaucuaacucaagauguuggcuggaccaugagcucucagauccuuccuguccccuucuagcuucugguggccccaguuguuucuugucucguggcugcagcacucccaccucugccucuaucuucccauugccaucuucucacuguaucuccauugccagaugguguuuucuguucuuguaaggacaccagucaacuuaaauuagugccuaccccaacacccaucuugccuugauuacaucugcuaggacccuaucugcaaauaaccuuacauucacagggaguaggguuuaggacuucaacauauauguuuauuaagaaaauuuuuuugagauggagucuuguuaugucacccaggcuggagugcaguggcacaaucuuggcucacugcaaacucugccucccagguucaagcaauucuccuuccucagccucccaaguagcugggcuuagagaugcccaccacuaugcccagcuaauuuuuguauuuuuaguagagauaguguuucaucauguuggacaagcuggucucgaacuccugaccucguaauccauccgccucggccucccaaagugcugggauuacaggcgugagcgacugcaccucgccaacguguauauauauauauauauuuuguguguguguggacgcaauucaguccauaacacuaacccauaauuguaauuuuggcauaaugccuaguguuuucuaacaaugucacuuacauaguaaauauuucaaaucuccaauccccugggccaaggaguuuucauuggccucaucucaucucaccaaccagccacagaaugaaaauuccuaaacuauuaauguauugagaaaggauaauauaaaugauugcugcuacuucuaaaacuuugcauuaaugucuaaauuacucaucgaauuaaauggagcaauaaucgccacuacuacaacauguuagacacaucagugcaauuaauuacuaauugccugcauucuaccccaggguauuagugucuggaaguccuaggccaagcccuacccaucacaggacacaaaaggccaauggucacccaauacaggguucagguaccauucuuuucagcaauuguuccuguuguacagcucagaaaauagugagcaccuuaucguuuaauauguuuacacaggagggcugggcaugcuggcucacaccuguaaucccagcacuuugggaggccaagguagguggaucaccugacaucaggaguucaaaaccagccuggccaacauggugaaaaccugucucuacuaaaaauacaaaaaaacuagccaggcaugguagccggcaccuguaaucccagcuucucagaggcugagacaggagaauugcuugaaccuaggagguggagguugcagugagcugaagucgugccacugcacuccagccugggcuacagagccagguuccaucucaaaaaaaaaaaaaaaaauauauauauauauacacacacacacacacauauaaauguagaauauauauauagacuauauauagucuacauauauagacuauauauagucuauauauguagacuauauauagaauauauauguagacuauauauagaauauauauauagaauauauaauguauuuagaauauauauagaauguauauagaauauauauauagaauguauauaguauauauauagaauguauauagaauauauauagaauauauauagaauguauauagaauauauauauagaauguauauagaauauauauauagaauguauauagaauauauauagaauguauauagaauauauauagaauguauauagaauauauauagaauguauauauagaauauauauagaauguauauagaauauauauagaauguauauaaaauguauauagaauguauauauagaauauauauagaauguauauauagaauauauauagaauguauauagaauguauauagaauguauauauagaauguauauagaauguauauauagaauguauauagaauguauauauagaauauauauagaauacauauauagaauauauauagaauauauauagaauauauagagaguauauagagaauauagagagaguauauagagaauauauauagagaauauauacagagaauauauauagagaauauauauauggaauauauagagagaauauauauauagaauauauaaagagaauauauauaggauauauagagagaauauauauagagaauauauauagacaguauauauauagaguauauauauagaauauagaguauauauauagaauauauagaguauauauaauauauagaguauauauauagacuauauauauacaguauauauagucuauauauauacuguauauauauagaauauauagagaaaguauauauauagaauauauagagaguauauauauagaauauauauagagaguauauauauagaauauauauauguuuacauagguucuagcucuuucucuaaauaauagcuuucaaaagauuaguuuuguuuguauucuguauuuaaugauuacauccucuacauagucuauaauaguuuauuaacacaucauaagacugaaagaaccaaaccaaagacagacauacaaucuauaauaaagagugaaaacguaacagacagugaauggaaauggaaguaagauacuccaaaauaggugucauuucuauuuuuuauuuuggaguuccuuugaacauuguaaucaccaugaaaauuauucaacauuugcaguuauccuagaaggauaauucuuuaauaaaaauguggcagcuuuaaccuuauauacagagcucaauuuuuacuuauaggcaucugaaauugauuuaggucagccucagcaugagcagaguauguaggcacuucccuccgugagcuacuuuuguguccccuaagcauaauagauaauugccuucucuagggaggcuaccagggucuuuuguaacguggaaagcugcaacauuagcaaacucagguauuugaaagugagccaguaaagagguacuacucuacaggaugauaaauggggcuggagaaacugugcugacagcauuuuggaguagacaauagggauaagaacuacuaaaaccagaaauugcaccaaaccagaggcauaguccuuuguggacaacuaaacaccuucuuucuugugaaauaacuggaaaaaaaaaaguuuuguaugaauguaauaaaacaagaguccacagaaacucaaauuuucuuuccuuuauaagcaaauuaguggugaaaacugagaaaaaacaaacaaaccaaaaaaacaguacuugccucccuuguuuuuuagggaagaauucuauguauucaguccaauguauucagcucuuucaaugcuucaacauuugggucucugcaggucuuucugcaauguaagccagcacuccuacuggguauuuacugaaugucaugcuauauaaugauaguuuuggacauuuaucggauuauuauuuccuaucucuguuucauaauugaaacaauaguuuucaaaaaauaaacaacaaaaucaaaagguuaccuuuccuuaaaaagaaaacacagagaggauaacaucaaaaaaaaaauggagaaagagaagugaauuucaaauauucagaugucuuugaaaacugaauucaaggacgaacaaauuaucccuuuucaauuagaaagaauauguaaagauagcaaaauucagugaaaaacucagagauaauggaaaauauggaaaaaacuccaauguucucaaaaaccacagugcaagcaaaaguaauugcugaagugguuugucuguuauauauuaaaaucuagaaaucugccugugaacugaaauugcaaauuuuuaacaugauuucgauucacuaauuugaagucugaaaaaauuaggcaaaacauugucuccuacuguuauacuucucucaauauuuucaacuuaagauuguuuagggacauagauuaaaacuugcuaaaauuguauuuucucacaucagcagccuugugaaauguccagcuuaguuauucucucauauuuugguggcacugcauuucuuuguagccucagcaaagcugacuguugggcugaaagauucaaauaaaacaagaccgaaggggcagacagaaugaugugauauuccaaaucaggugcaagaauugaaaagucauagaacaaauaaaauucuccuuauugcaucaacauuggguggggaacaaaguagauucaauuuaacaaaaaauagagugauuuauuuuuguaagagaaaucuuccuuacuucagaagcuaauaaauguaaaccauccuaugaauuugaaaaccccuaggagaaaggcauguucuacuuucaguuagcguauuggacauaauuguaaaagaagcacacgcccauuucaacuugugaacaugaagaccgagguugcaugcuuaacuuuggcauauuaggaacacgaagaggagcccucucaaauaaaaaacugucaaaggaaccaauccaugagacaaagcaaacuucuuggagaaagauaccguuacuuuuucuguuuuuaugauuucuuggugaugggagagggagucacaguagcagguaauuaacugccaagcaacagaacuaauacugagaagagagaaccaucuguccuuaucuaaacuucaacaauauuaaguugagcgauaacugauagugacagccagagacucaaaauuauuuauugcuccuaaguugugaaauuaaaacacuauuuuuaaucauuucauugcucuuuaagugaggauaaaaugggacauccuuccuucuaauuaaacagaaaagguuuaaggaacagagguucccagucacagaaugccauuuucccacuuagacuccaagcaguccuuagcaccccaugcacaguuacccaccaagagacacaauucuuccagucaaugaggcugugaacaagccacagaagcuuuuauuccaguccucauuuuugagaaacuucucuuugauagaaauuagccuaagcuuauaagaagaaaaguagaaauucaaauuauuucauugguuaguagacaauuaaucuuacagaauuggagaaaagcacugagauuuuaauaauaugugacaguguaaauauuuaggucagucaacaacaugugcacugacuguuuauaacuaugcguaugguaaacaaaaucgacuagcauauagaauauuaaaagaacaccugaaguuggaggcuucuguaucaaaucaggaugguaauuguuauuauauugaaguuuauuggcugcugccuaaaauguguuuucauaccaucauaauguuauuaaagguguaaaagaagcaucugacaauaauuucaaauaagcugcuuaauuuuauaaaggcaucccauuccuguuuuggcacugccauuggucauccgugugacuuugaacaaaaugcuaacacaaaugugccucggaugaaucaucuguaagguagggauaaugcauuacucaacuuccaggaucauugggauacuuuaugaaaugcuaaagagcuguguggcgucccuggcacaaaaaaaaaccucaauuaauauaaguuucuaccauuuccccagucuugccaucaucaucacuacucaaugaauaaaaccaaggugaguuaaauaaaacuaaguuaaauuuguuauuuuuuauuuguguuaguaguuuucucaaagucacauggaugaccaauggcagugccaaaacaggaauggaaugccuuuguaaaauuaagcagcuuauuugaaauuauugucagaugcuucuuuuacauguuuaauaacauuaugauagagucucacucuguugcccaagcuggagugcaguggcgugaucuuggcucacugcaaccuccaccucccagguucaagcaauucuccaugccucagccuccugagcagcugggauuacaggcacccaccaccacacauggcuuuuuuuuuuuuuuuuuuaauuuuuuaguagagacagaguuuugccauguuggccaggcuggucuugaacuccugaccucaggugauccacccgccucggccucccaaagaaaacuagguuaaaucugaaagugagauuauagcuuaacauuugugacacaaacagcucucugcaucuuuuggugguucucuccauggcaauuuaaaguggacuauuucuaaauaauaugcugccaggcauaaggaucuuucaccuauauaaccucucuuaaggaaauccacucagggggaggucugcuuaugggauaaacggaggcaauuucacaaccaguuaagaaaccaaucuuggaguuguuugccucuugccacagacuucuccucuaaugagagucugucuucuugaauaucuuucuagauauaauugaggcccccauuuauuuuaauuuuccugauuauuaaagacauuuuauuaucaaauacuguaacugcauaauagagguaugaccuugucuagcaguuaucuaguccaagcucccgcuuaagcuuuauccuuccucacuaaugaacauuucuuccugcuuaaagauugcaaagcaugcucacauauugaucuccuuugaucauaauaaccacugacauagguaggcagauauuauaauggccaucuccaagggagaaaugagaaaucuggggcuuggagacauucaguuacuuguucuaggucacucaggugguuuauagaaugauagacuccuaaaauguuaaccuauuuggucaaugagugucaaacauagauggguacaaagggcaaauacaacaccaaugcuucucucaagccugcuguguggcaucagaaacaaagguguuuguauugcagcaaagcacaaccugccuuuuagaaacacuuuggggacaauuuaaacuuauuaaacaaaaaccuccaaaggccaaauacuguuuuagggucucaaguuguuuuguuuugaguuuuuuuaaaccacugauuucuuugauccucucugaucuucuuuuagccccaggaggggaaaugguauguauaaggucacucaauuagcaccagaaauccuaagaauuuguccugcuuacagcacagccaggaccccaaaacaugccuuuuuuuuuuuuuuuuuuuccugcagacuuagcuuuccuaacaaugcgccauacaauucucaggucagggaaucuacccaaagcuuccagccauuguuuaggaaugaguuccauacuucagguauccagucccaugugccaaaaacccauguucuuuccaucugguuguaccucaauuuaguggguaagugaaugaugcaggcggcauguuaaugaccuauggcggcugcucauucuucucucaaguugggauagguaagucugcaccaccugagauccaacacugugacuuaggcauuauuaggagcaguuuaacacuugcugaacacucuaacagaguuuuggagccaacaauggggauaaggagaugaacaugacauagacugcccaaagcucaugggccucuaaagcugugguucacauauuuuuccaccaaguccuuuaaacaggcaauuaaguaaucuucauuaggcuacaauaaaaaauauuuuaaaaaacuauuuaacuugguuugcaacaauagucucuuuuugacaaaacuguagcuagauaaaacuauauuagugauucaucaaaagcaauauuuugcuccccaucacuuuagguagggugauuuucuuuuguuccucagugccaaauggacgugaaucuaguguauggccuguagggaguuugcugcugaaacuguauacaaaucaaaacuagaaccauuaaaaaaguagagguccagcuggauuagguccugaaaagaugaauaucauaguagacaaauaaugcuggacaauagauaaggucuugaaugagagcccucuguuaauauacagagucaccaaaggcccagggacuugcuguauuucacaguaucuuugacuccauagaguuuuguuuguuuguuuucuugagauggaguuucgcucuuguugcucaggcuagagcgcaauggcacgaucucugcucacugcaaugucccccuccuggguucaagcaauacuccagccucagucuccugaguaguugggaauuauaggugcccaccaccacaaccggguaauuuuuguauuuuuaguagagacgggguuucaccauguuggccaagcuacucucgaacucgugaccucaggugaacugcccgccucagucucccaaagugcugggauuacaggugugagccaucacgcccggccucuauagaguuuuagaguauaaaaauacuuguacuugcuuuaucucuuucccuucucauaggguaggaauuaccugaguagguaagaguguuauucaauccuguuuugcagaugaaaaaacuagcaaagaaagagguuaagcgccuaaccucugguaacccaaauaaugggucuagaccuagggcccagaacgucacuggacaggaccauauaucacagugacuauacuaucucuugucacuuauuuugaaggaauauuguugaaauucaguaaugugccaucaaguaucuguuuaucuuuguuuuuucuuaguuacauauauaucucuagaaauaacccauuuuuauuuaauucuuauguccauaugauuuccaauuaguuaucuuaacucgaaaacuuuugucugauucuauguuccuaugaccauggacauuucuauuuccuauagguauacacuucaagaaaaaucaguaguacaugaagcauuguguuaacacaauaauuauaaauagguuuguuaacccuaaguuuacaaaaaaauaucaucucaccugagguuuagauaugaaauagcuucacugugaaccucaaaaugacucccagucugaaaugguuccaccuuagugucuuacuuccaugauuagaaacuaguuguuuuaaauauaguaugguguuucuaggguuggucuacucaaaggcaaauaguuaugucuaagcuguuccaggcacaugguaacaguggaaauguaagcagugaacaaauacguucuagcaacagugauucucagagucuaguaaagcaaucagaugugcaguauggugaaaugaagugugagagcuaugaagagaaaugcacaaaggacugugacagaauagaggagugaauagccaugaucaugcgucacggaaggcuuucauguggaguuucuauaugagauguaucuuaaagggugagucaggcagagaagugcacuccaggagagagcaguaaucauauaaaagaauaauaagaauaaugagucaauuuuuuuuuauuugcucuaugccauucacuuaacaaauaugauggaagugucuuccaauccccagguaaccaccuuacuuuuuauauacauaugcuaguucauuuuauuuuuacaauaaugcucugagcuagguauuagcucuguggauaggaaacaggaggugaugacauaaauagagaaguuaagacaccugcucaugccauacgacaaguggcuaaaagagucaggaaugaguaggaaucuacugcuucuagaggcuggguucuaaccaagcuuucuugaguaaacguuggcagugcuugacauguaggaugaucaggaaugggaaaagaaagacauguuuggauauacugucuggaaucacauuuggaaaggaauuugucauacuugaaggcaacacaaaaugagcuauucauuauuugaugcagaaagaauagagauacauagcaacaauauaaacaauagauugcaggugaggugguugggcaggagagaacugaaaucuggagacaaaauucuuacccuuaucuagagccagcacagcuuacgaacucucugccaagcugguaguuauggacagaaugacaaagaaggggacaagcugaaucauuucccauuaagaagcaagcuacaaagcaaauggccuuccagagaagcaaaaguauugauugaccauuuagugcaaaugauggaacacuaauuaauaacugcagcugucaggaagcagugauuguuuggcuuccauauagauuucuuccccucacuuucauuugcuuuaauguucaaagcuuucuuugaugugaauuuaaugcuuccuuuucucauucuguuaauucuuucaguauuuuguacuguaucuuuuugaguaugccugcuuuuauauguuuuaucucucuugcauuacuaauguuauauuuaggguccugcgagucugagauuucuuauaaguuuuaguuuugaaaaccaaaugaaguaauucagagaggggagugaaucuuaaggugaagauuaucaagggcauuucaucucuggcaauaaauuuuaagggagggguacaggucagcgugaagaaaucaacauuaagggaauguguguauauuaaaauaaaggaaaauaagccaauagaaaaauauaaggcaaaaaaaaaucccaagcagaccaucuaaaauguaugguuaugaagucauucauggcaaauacuuuugaauugaguaacagaaaggaguaaaauaugaaaagcagguuuaaacucaaguaagauaugauaugaaaaugaagcauguuguguauaaccaaauucagccaugauauguuacagauguuagacuauuuauuuuaucuuaaacuaaaaaagaaaaaaaaaggcaaaaguagaucaaaauucuagucaugggguuaguuuuuuugaaagaaaagaaacaggcauauaugugaagagacugucaaguauuaauauucuuuuaaagguaacacuugaaauaaaucauucuggccuuucaacuguuuucacugcuuuagggaaaaaaaaaaacuuucuauucuucaaaguccaguucaaauaccucaaaauuauuaucuuccucuucugugcuuuggcaccaagcaauuuccuguuuuuuauuuuauuuauauauauaguauacauaagauauguauacuauauaguauacauaagauauguauacuauauaguauacauaagauauguauacuauauaguauacauaagauauguauacauauauguauacauaagauauguauacauauuuguauacauaagauauguauacauauuuguauacauaagauauguauacauauuuguauacauaagauauguauacauauuuguauacauaagauauguauacuauauaguauacauaagauauguauacauauauguauacauaagauauguauacuauauaguauacauaagauguguauacuauauaguauacauaagauguguauacuauauaguauacauaagauguguauacuauauaguauacauaagauguguauacuauauaguauacauaagauguguauacuauauaguauacauaagauguguauacuauauaguauacauaagauguguauacuauauaguauacauaagauguguauacuauauuguauacauaagauguguauacuauauuguauacauaagauguguauacuauauuguauacauaagauguguauacuauauauguauacauaagauguguauacuauauauguauacauaagauguguauacuauauauguauacauaagauguguauacuauauauguauacauaagauauguauauauaaugagauauauacgaaauagcuucagugugaaccucaaaaugacuuccagucugaaaugguuccaccuuagugucuuaauuccaugauuagaaacuaguuguuuugaauacaguaugguguuucuagggucagucuacucaaaagcaaauaguuaugucuaagcuguuccaggcacaugguaacaguggaaauuuaagcagugaauaaauauguucauauauauuauaaauaugaacauauauaccuauauaguauauauuauauauuacauaguauauauuauacauauauuguuucuggcauucucauggauauauauguauauuauacauauauauuuuacauauauguacauauauuauacacauauaauauauacauauauguauguuuauguuuucuauuauauauuauauauuuauauguauauauaaaauauauauguauauguauauauaaaauauauguguauguguguguauguauacauacauaugugugcaaauucugccuugcaagcauuuucuccuguauauacacacauauaugugugugugugucugugugugugugugcauauacaggagaaaaaugcuugcaaggcagaacuugcaucuugccaaccuguguucuccccagcaccugagccaagagguugagcaaggagguuccaaguuaagugaaggauuaguaagcaaucaaacccagugaaccaggcaggugccucaacuuucccucugucugcauugcuuugcaaugggccagcuggagagcuccuaacuuggcuaaugauucccaaugccaagaccggauauauaugagugaggaguacuagccccuuaucuugaaauauccuacagucuugugacauaauuuuaaaaguuuucaaauggugacugauuuuaaauuagugauugcucuaaugaggauaagaagcagucacaguggccacugacucugugagacauugccuguaaaacccaaauuauauguaaaagacuaaauaagagaggagaacagaggaaaaaaaucagaagugcauuaguggugaggaaggauaaugccucagagugcuccuauaguaguaacuuugucaucuacugccuaucccuucauugcuacuuaaauaagugaaauaaaacuaaugagaaauaaugacaaaacuacaaggaggauacuguaguugauuuuacuuauuggguaguuucucuguuucuaggaaagauaugguucugaugguaaacuucaaaccucaaucaaaaucugugucaacaagaaugaagggaugagaauaggaaacagucaggccucuuguccuauacuuuucugugugugucucauuuuccccacuuaugggaucaguugcacuucuaagcagcaacacuacaguucccuugagacaaaauucugauccccaugacauuuguuuucauauuccaggauugacugguaguucuuagauuuuguguuuguguccugguucuguacccguuagcuccuaauccuaauccuaauccauguuucauucaucucuuacuccucugacacugcuuuccaauugugagccacacuuccugcccuggucucuggccaguuccucucugccuucgcugaugggccuuggccugacagcccuuuucauucagauccuugcagcucacuucuuagucuugccaccccaauucuucuaagcuccuaaucgauugugaaaacauugagucucuccuauacaauguugaccuuucugcuguucuaaauccccauacucagagccagccuguguuuccaaaacuaaacagauguuaguucuuggacucugaacagagcaugggcaugcaaaacuuguuuuucccuccggccgcccuuuguggccaguaugccucucaagauacaccccacacccagaguucauaguccagaaaaucucaacuccagucuggcccuccucagccugcuguauuuuaccaccauccagcuucucuacuugagaaguagaagcugaaaccacaagcuggagacauccagacugcacacugccauaaaucaaauuuagauuauguugugcuucugaauucuccuuucugcuuaugccucuuuguuauucagcaacaggguucuccggacaaucauauccaugcuuuuguuuccaacugagcaacaaacuuuaggcuugacugagagucagaacuggcccauucucagaaguaagguuccccaaacuucuggcuuguacuucugaaucuagucacacauuucaaucaaucaacacaauguuacauaugauuucccuuucauuuuagguuucucguaucagcacuagcauggauuguggugcuguagaacuacaauugcuuucaugguuagaaugcaugguggugaguacagugaagagaaaaguucauaaacacgacccaguucugcuacuagugaguuaaggacuuugaacucucaaucacaguuuuauuuuguuuugucucuuaaaaaaauggaauuugacuaagauuccuccuuaacacuguuucuauaauauggaaaaaaauguuaauccacauaaugcugccuuguauuugacuuuacagaugaaaucacaauuauguuacccagauaaaugauguuucuaacugugguugacuuuauccauucauauauagaaaauaagccucucaaaaucucuuaaaauaucauauuuaauucccauagugaucuuggcaccuucauacuucugaauuauaauuuauaucucaaacauacauaaauugaccaaggcaucugcauuuaagaaucacuuuuuuuuggccaggcgcagugguucacgccuguaaucccagcacuuugggaggccaaggcagguggaucaccugaagucaggaguucgagaccagccuggcuaacaaggcaaaaccacaaaaaauacaaaaauuagccaugugugguggugcacacuuguaguuccagcuacucaggaggcuggggcaggagaauacuugaacccaggaggcagagguugcagugagaugagaucacgccaccacacuccagccagggcaacacagugagacuccaucucaaaaaaaaaaaaaaaaaaaaaaaaaaucacuuuuuuuuuuuuucuuaaacagagcccggagagaacaaaacuggcauuuuaauuacagaaauauaaguucuggaaauagcacuuuaauauuucaggcuaaauagcucauuuauuuguaguaauuaauuauuuaaaaauuauuuuaaagcauuuaagcuucagcaaaagucuccuaagagagaaccacaaaaaaaugccaacaaaaagaaagaaauuucuaacaagugguuaccuuauugauuauguugagaucauuuauauauacuaaguaauuuguuaaacauguaucauugaaggccuccuuccgguaagguccuguauuauaaugaagguaguagcuucacugcaagcagagcccagcaauuuacagguuugugagcagaagcacaguugucaaaauuaauaauacaagguagaaaguaauaaguucuuagguaagaagacaggcuauaaguguucauuguauuuauuucuuugguauuuuuuauagagucuugucuucuuuuacugaacuguuacuucucaggccucaggugugaauauaguaacuuuauuuuuggcguaagaacccaucacucauguaacagacacaaacagguaccauaaaucacaguugcugaugcauacauaaucaaaaaugucgcuuugaauuuccuacuccaugcauuaaaaaaaagugcuaugccuacccuacauacuucuccaucaguuaucaagacucaaguugcauuuuauggcugaaaccaaagaguuaaccuuugaaggauuacagaugcacauucuuauuuugauaaugacacaaauguauaaugcuuaaaacuuucuuuucuagaguuuccauuaguugaacauggaaccuauuaacagacuuaaaaggaaauaaggaauaggaaauagacagaggaaagcuugaccauuucaaaggucauguugaacuaaaaauuuaaagagcaaggcccuucugagagauggagauggugucagagucacagggucaaccugacucuggcaguggagugcagcccaggccuggagaaucaugaaugaagaagagcuguggcaagaguuucuaagagagaaccacaaaaaaaaucccaacaaaaagaaagaaauuucuaacaagugguuaccuuauugauucuguugagaucauuuuuauauguuaaauaauguguucaacauguagucauugaaggccuccuuccaguaaggcacuguauuauaaugaagguuauacugaagacaauggagugaggccccaugcccaucacaaaugaagaggaucugggccaggcauaagagguggccgugaauagaagugggagucugugcuaguauuguggugacuuagaaacacuuccaaagacuucaggcacacacuggggcuucaggucccagccucuugaaauggcugugauagaaaaagcagcaauggccacccagaauggucaugaaaaguguugccucugccccaauagauaguacagaauaaugauugaauguugugaauguaaauacauucgaauugcagauuuuacgacguggcuaauuuucacugccaaagugcauuuugcugggcuauugccaagcacuaauguagaauuuuugcaagucuguacuucaaauaguagaguccagugccuuugaaucuuuuuuuuuuuuuuuuuaacuuuuaaguucagggguacaugugcagguuuuuuacauagguaaacuugugucauggggauuguuguacagauuucauugcccagguauuaaaccuaguaccuauuaguuauuuuuccugauccucucccugcucccaccguccacucucugaaaggacccaguagguguuguuccccuuuauguguccauguguucucaucauugagcucccacuuauaagugagaacaugcgguauuugguuuucuguuucuguguuaguuugcuaaggauaauggccuccagguccaucuaugucccugcaaaggauauaaucucauccuuuuuuauggcugcagaguauuaaacauccaaacuuuggacauucagcggccgccuguucacuuggaauaauuuauuagcaugguauacuauucauuuagauaaaucacauucauuauucagauuguaacacuuugacagauagcucuucccuggcuauccaggcugagaagaucuccaugaaucucuuucuuuuuuaauuuuucuucauagcauuuucuuaucacaaucuagaauuauauucacuuacuuucuuaaugccuaacugucucauugggcuauaaaguugcugagggugggacccauuucuguucaguuugcucaaauaucgcuagaaccaaugagaauccaugagaacacacgaaacacaaugguagagaaaaagguuacuucaucuccauuucccuaccacagugguucccaacuagaaagauucugacucucagggaacauuuggcuaugucuggagacauuuuuuauugucaugacugguagggguguuacuggcaucuagaguccacgcaugugggcaaucuuccuacaaugcacaagacauccaccacaacaaaguuauuuggcccaagauguccauaagguaucucuugagaaacucugucugcuaugguuugaauguuugugucucuucaaaaugcauacguggaaauccuaaccuaaaauccuaauccuaagaaugaguuggauaccauaugauauagcuuggcuguguccccacccaaauaucaccuugaauuguaauaaucccuaugugucaagugcgaggccagguggagauaauugaaucauuagggcagcuucccccauacuuuccucauggugguaaauaagucucaugagaucugaugguuuuauaaauaggaguuccccugcacagcucucuugccugccaccauguaagacgucucuuugcucuuccuuugucuuccgccaugauugugaggucucccagccauguggacugugaguccauuaagccucuuuucguuauaaauuauccagucucagguauauuuuuauuagcagcgugagaacagacuaauacguuguaccaagaagauuguauuaggagguggagcauuuugcggggugauaggucauaaggguagagacuucucaucagugucauuagugccuuuuuaaaagauaccccagagagcugucuugcccuccccaccaugcgagaacacagaaaaaaguuaccaucuaugaaccaggaaacaaauacuuaccacacugaaucuuccugcaucuugaucuuggacuucucaccuaucaggauugugagaaauacauauucguuguuuauaagccacccaguuuacggguuuugugaucacagccuggaaggacuaagagucugcccuauucaaacugaugaugcaaguuaauauacugaggcacuggucaacaucucauccuaaacacuuuuuagccaaaagcucucaucacggcauuagcaagggaaauauuugucugagcaucugaaaaucauuaaaugaccuaggggacaagggugccucccaaacagguagucaaauccuuuuagcaaagaggccgcuucucucagcugagagacacugucaucauuugaugugccagaaauuucagggaucugaccaucuagcuaaaagaaauauucucuucaaggaaaguugacaggaaagaaaauuuaggugauguccucuaaccaccauuuuuagagcccauagguaugcuugggucuugcccacaaugcagauauagucaauagaagaagaugacuagaugagguuugagacuauuuuuauccuaacauccuaauauagaauuagaauuuuuucacguguucaguuuuuaagccaaccugaccuauguaggauauggagaauauuuacccuucuaugaggcuaguguuuccuaaacuauuugguuaaccaauugaccucacauuaggcuagugaguauuuucuaaucuuauuggcaaacauagggcccagauuacauuuaaguguauaucauuuguaagagugugaugggaacauagacacaggaccugaaauuuaaguagucaaacuuugccauuaacuauuuccugacuucgcgugagucacuuggcccaucuuuagauuagcuucaucugucuaaugaugguuucuaagauugccucuaacugcaaaaauucuauagacuuauguaacaaauuaguaucuauuuugucuguucuggcuuccaggucauacuaacuaaaacuuucucuuauucuccuucucuguaucucacuacuagacuauaauuuaguaaaauugcugggacugggcaaugaggcugagcuuauaacgcauguagcauacuggagacugugugcuguguggcaucauuaaguaauuuuuacaaugaguggcaaugacauacuugaaaacugaccaugugugucaaugcaaaaaagguugucucuccaugauugcaauuuacaaaauguauuuacuauuugacauuuuguucuuuucucuuagagcugcauuuuuuauauuaauuuguucagagucuauuuaaaaauacaacacagguaacaaucaaaguagacauaugaccuauaaaagucucccacuuaaaauauuugaagaggaaauaagagaaagcacagaugaaaggaguuugucagagaaaaaaauuaaaauaaagaagacuuggaacaaagaagggagagagaaauggaaagacaaauggaacaaauuucaggaaugaagugcuaugguucaaaaguuuguguccccugcagaaugcacagguugaagccuaauccccaaugugauguuauuaaaaggugggaccuuugggaggugaucaggucaugagaacggaaccuucaugaaugggauuagugcccuuauaaaagagaccugagggagcucguuuuccucuucuaccacaugagaacauggcaagaaauugcuucuuauagggaacaagcccucaccaggccccagaucugcuuaaaccuugaucuuggacuuccuggccuccagaaccaugagaaacacguuuguuguuuauaagccacccaguuuaugauauguuguuauagcagcccaaacagacuaagacauaaaguaaaugcuagaaaaaauacuuaaaaaaugaguuuggagacuaauuaauauucugauguuugauuuuguucaacauuaagcaugacagaguuauuuaucucuaaaaauauuuuccacaguuugauuucugcauuuuuucguacacauuaccaaauagaaaagucauaucaugagacauacacuugaccaacccucauagagaccccuccagagaaauggcuauuguagcuauuucaccaugcugagaccacaugguuuauuucaguuuaggauacugauuugucaguagagcugaaaauaauaguguuaccaaagcuccuacuaguugauugaaugugaguacacaauaggucaagaauaccuuacaagcauagauacaucugcugacuuggcuuuuucuuuuguaacuuuaauggguuaagaauuuauuggaaggauaacuugcuuugugagaagaaaaaaauauuuguuuuuaaggaucccuuggggauuugucucacguaaaaagagaaacucucaauaugcauauaagaucaacaacaaagcuuuccugauguuugcuaccauuguugucaaugcauauaugauuugguuggaaaugaacuugucuuaauuuugcaguuuucaguauuguuuauauaugaucuuuaacauguuaaaggucguuagagcaagcaucugaaagcacacaacauuaauuuuugauuaaaaacacaaauacagaaauuaugccacuauuaauaaucauucagaauugagacauuccaccuaaaugaguuuccagauaauugaaguuuaaauauuuugggcugugccaucuaauaaaguauauuaggcacacauggcuacugaaaccucaauuuaagauaauuaaaaaugaaugaaauuuaaaaaaucagguuauaucuuacauuggccacauuucuaguccucacuggccacauguggcuaauggcaacuguacucaacaaugcaggcacagaccauuuccaccaucacaaaauguucgauuagacagcucugacucagaguauuuaaaaacauuucuagauagaaugcuuuucuaaaguauuucacaauucucugcccuuuuaauagaauaaaaauacuuaauuuuuucuauagaacgcuuuucuaaauaauuucacaauucucugcccuuuuaauagaauacuuaauuuuuuucuauagaaugcuuuucuaaagaauuucacaauucuauacccguuuaauagaauaaaacuacuuaauuuuuucuaauuucuguucaccuauuuuauacagugcuucagcuauaguuaaguacauagauguaggauuaaauggauaccaacuuuagugcugucccuaagacuugcuuucaggaaaaaauauuugaugucaaauagaaacaucuguucuuuucucacaaugaugaagaaaaagauuugcauuugcuugcuuucaaauaaaguacaauauagcugcaugucuucaaaauuaauuauuucacucuccagcgaagcacaccccucuccuuccucauuguuguaacuuccuuuuguuuugacacaaaauucaacagaaauauuacuuuucuaauugaaucacaagcauagccuauguuuuguccacagaaguuuauugcauuguguauugauugaauaugaaagacugucucuuuuaugcugaaagacuucuugguaagaauauuuugagaagggcuuacuucaaaaucugcaaauuucucaauaucagaguauaauauauuuucaaggaugaugucaaaguagaugucauacuauuaauucuucagauacaauucuauguguguguguguguguauauacaaaaauuuaacaaucacauugaaugauauaacuuuguauuuaaaugccuguaggauugaaauuauugaugauaucuccucuaucaaguauuaaacucuaaauaauaccccugucuauaaguuacaucaaaaaguaauuuugaaagacuggaagaauauauauuuuuaaaauacaaccagacaucauaguuugcuuuguucaugauuuaaaggaugcuauuccaaauauuuagcaaccaguagaguaugggcauuggcccagaacaaacaugcuaauaggauucugcuggaccucugcuacugcaaauacuauccaccguguugcacaaaggccaggugcucuaagacucucgggaaggguuucaugaugaggggcaucuggaggucuaagggcaguggcuuuaccaacaagcugaaaagaaauauuuuaauaauguuuagagccuuacugaagcaggccagcagaacaucggccuugugcaauuguuuaacugaaaaauaucuuucccgccaacagauaagcaguugguuuuauuuauuuuuucuacuaaaggaaaaaauggugauaaaaucacuuggaaaaaucauccuuguuugaucuacuuuuuuuuuucagagccuugacuccauauuauucaggcaaauaauauuaaauagaaccuaaacauuuguccuguucuccaauuucuuuccuaaggcuagcauaauuuuaugugcucuuucaacuuuuacucagaggaccuugggauucuuauccuuuguuggcuugcaaauauauauugagucugcaguauuugauggauuauaucucaguuuugcauuguguuacaggaaacucccccuggaccguggacuuggauuuguggaugcacauuuaugguggccugccugcacgcagagcuaacuaaggacauuuugaaauaaacaaugacugggauuuuauuguuucucuucucuucucuagaaacauacuggcauaaucaaauacauaguaaaauaauacaaagaugcaaauauuuuugauuucuuauucugauauaacuuccuuugaaugcccccacacaguauauuuucacugccuagagccuacuuuuucauugucacagguaguuuuuauaaacauacauguacaaugccuuuagguauaauugagcuuccugaaggucagacuuucagauuacugaaguuaucuaguuacuacauacuuauuuuuuuaauuuaaaaaacaagauuagucuuaucugacuuuuaaagaguuuagaaaucaucacucugguccucacaauaagaaaaaugcugacuaaacugaaaauuaguaauuuuucuuagauccuucagauaaucaggaucacagggcaaaccacugcccccuuugaaaaccagaaggacaggugaacacacagaaugagucacagcacaccaaaagaagucaacacuagauccaacaaccagaaaacugaagggauaauugacuaaugacuggacaccggguguugacuaguuugagggaugaaaacccuuugagguccagucuuggaaggggcuacacucuuauucauuuuacauccaagaggucuaccaaguucuucaguuaaaggugggagaaaaauccccuuguucuuuuaucagggaaaggggaaagcccagauugugaaauacccccugaauauuuccuucuuuuucuuuuuucuugagacaaagucucacucugucacugaggcuggaguguaguggcacaaucucugcucacugcagccuccgcuucccagguucaagagauucuugugccucagccuuccgagucgcugaaauuaugaauauguaucaucacacccagcuaauuuuuguauuuuuaguagagacgggguuucgcuguguuggccaggcuggucucgaauuccugauuucagaugauccucccaccucggccucccaaagugcugggauuacaggcaugggucaacaugcccagccuagaaauccuguucuuaacaaaggccuacccucaaagaaaacuaguuuacuacagcccaauggacugagguuuuaccagagcugaauuaaucuuaaagaagagaaauaccuaaccccagcucccucuagccuucuuguaucacauaaguggauaaaaagccgagaaacccuugugauggucacaacccaggggcccaggcucacuaaaacacugagaccuaauuaugagacuguagaaugccuauccucccucacacccuaucaccacaucagcagaacuccugcauaauaaugagggaauacaagugaaaagccuucaugucucagaucuuauuuaagauaaguucucuguggcaacccaauaacaacaggggagacaaaaacauuuuagucucugucacauauagcuacagcaaauaguagacacagcuuaaauccugggcagacuaacauaaaaccucaggcuaaggcacuauguguuuuauuuucccucaugcaucauauuuuacaaggcaaguuaaagucagagaacacagauuaaagagacaaaacaaacaucauaaccuacuuagauacagcagaaacuuugcaauuauugaacugggaauuuaaaauaacuaucaugaguauauuaaaaccucaaaugauaaaaacaaacaacaugaaagaauacauagguaaugcaggcauagagaugagaacuccaagaaagaauugaaaggaagugcuagaaagaaagaaaaaaaagauaaaaauaaagacugcuuuggauggguucauuaguaggcuggacacagucaaggaaauaauguguuugaagauaugucaauaggaacuuucuaaauuacaauguaaagaguaaaaaaaugaaaaauauggaagagcacauucuacacauguaugaguguuacgaaauguguaaugugcauaacgcaaauaauauauggaggagagagagaaagagagagagaaaggaacagaaggaagagcccaagaaauaaugcugaugcuuuuucgaauucaaagacagacaacaaaucacaguucuaggaaacucagagagugccaaacucucugauaaacaguuaaaaaucuccuuccuggcauaauauuccaacugcagaaaaucaaacaagaagaaaaucuucaaagaagccaagaagggguggaggaagccaacacuguauagaaucauguaagcaagaagagagugguauaaaauuuuaaauauuuaaauaaaaacaaauaaaaguacagccuagaacucuguaucaagugaaauucuuugaagggaaauaaugacuuucucagaaaaaugaaacuugaaguaauauuuucgguagcaagccucccuuuuaaaaaauauuaaaagaaauuacucagagaaaaaaaugacucagauuagaaaauuggaucuacauaaagaaagaguauuuaagaaaaaauaaaugaagguaaaauaauuuuuuuugguucuuagaggauacaacauaaaauuuguucuaauuaauaauagcagcaauauuuuggaugguucuagcuuacagauaaaugagaaaugaaugagcaauguuacaugugaugacauagggggaauugggaauacguuaauguaccugugacgccugugaaguaagguagaguuauuugaaaguggacuuggauuauugcaaauguauauugcaaauguauauugcaaacgcuaagguaaucucuaaaaacagguaaaauagaaguaaaaaagagauaagagaaaguagaaaauaucaaaugcgcacuucaaacugaagaaggcaggaaaguauguaaaacaaaacaaaauguaaaaacaaaaacaaggacaauggcuagaaagcaguuauaaauuaugguaggcauuaauauaaauauaucauuaaucacuuuaaaugugaaugaucugaauauaccaaucaaaagagcuuaucacgguggauuaaaaacaagaaccuacuauggguuggcuacaagaaauucacuuuaaauauaaagacacauauaaauuaagaugaagggauggagaaagauacagcaaugcuaacauuaaccaaaaacaucuagaguaaauauauaaauuucagacaaagcagacuugugaguaaggaaaauuaugaggcauuuaaaauaagggccaagcgugguggcucacgccuaugauccccgcacuuugggaggcugagaagggaagaucacuugaggucaagaguuugagaccagccuggccaacaugaugaagcccugucucuagcaaaaaacacaaaaauuaacccggugugguggcacaugccuguaguuccagcuacucaggaggcugagcagggagaauuguuugagcccaggagacagagguugcagugagccaagauugcgccacagcacuccagccugggcaacagagcaagacccugucucaaaauaaauaaauaaauaaauaaauuuaaaaagguauuaacucucugaugaaacagaauaauccuuauugugucugugccuaauggagugucaaaauacaugagauaaaaacugauauaacugcaaagggaaauaaguaaacccacuauuaugguugaagacuaugauaccccucuauuagcaauugacagagucaacacacaccaaauaagacauaguuaaucagaacagcaccaacaauuaacugguuuuaauuacaccaucugacaacacaaaauauauauucuucuuaagccuaccuggcacauucaccaggauauaccacauucuaggucacaaaacacagcuuaaugaauuuaaacuauugaaguuauuuaaaguauacuguuacaccagaaugaaauuaaagucaaagucaaaaauaaaaagaagcugaaaauuccaaaauauuugcagaauacaauaaauuuuaaggauuacaugagucaaagaagaagucugaagaaaaaauaaaaauaguuugaagugaaaauuaaaauacaacuuuucaaaaugugugggaugcgacaaaaccagugaugagagagaaauuuguagcacugaaugcauguauuagaaaagaaagaucuaaaauaaauaaaaguuucugcuuuagaaagugagaaaaauaacagcaaaauaaaucugaaguaagcagaagcaaaucuauaauacaaauuagggcagaaagaaaugaaauugaaaacaggaaauuaguagaguaaaucaaugaaaccaaaagcuaguguucuuugaaaaguucaauaaaauuguuaauccucuaaccaagcuaaccagaaaacagagaaaacauacaaaucacuaagaucagaaaugaaaaagaguaauuaacauugacuucauagacauuaagaaauuaggcguaagcauuuuaaacaauuucaugcuuacagauuugauaaccuagaugaaacggacugauuccacagaaggcgcaauauaaaaauugcacacagggagaaauaaauaaccugaauagguuuaauaaauuuaauugacaauuaguuacuuuucaaaagagaaagcaucagucccagauguuuccacuggugaaucuaccaaacucccaaggaagaauuuaagucaauuuuuuucaaacuuuuacagaaaauauaaacacagggaauacuuccuaacucauucuaggaggccagcaauacuccaacaccacauccagacuaagaucuguuaagaaaugaaaauuacuaauaucucucaugaacauaaaugcaaaaaucuucaagacaauuuuagcaaaucaaauccaauguauaaaaagaauuauacaccaugacuaagugggcuuuauuccagauacaaugguugguucaaauucaaaaccugauaaauaaccaugugagguaauauauauguuaauuagcuauuuagccauucaacaaaauaugcauauuuaaaacaucauguuguacaugcuaaauauaugcuuauuuguaaauuaaacauuaauuggccuggcauaaugguucacgccuguaaucuuagcacuuugggaggcugaggcaggugaauugcuugagcucaugaguucaagaccagacuaggcaacacgaggaaaccccuucucuacaaaaaaaauaugaaaaacaaucaaaaacaaauaguugggcaugguagugugggccuauaguucugcaugggaggcugaggugggagaaucaccugagccagggagguagaggcugcagugagcuguggccaugccacugcauuccagccugggugacagagugagacccugucucaaaaaaaauaauuaauuaauuuaaaaaucaauguaauuuaaaaaucaauguaauuuaucacaauaggcuaaggaagaaauaucauacaaucauaucuauaaugcugaaaaggcauuugacaaaauccaacacacauuucucauaaaaacucugaacaaauuaggcauaaaggggaacaacuucuacuugauaauagauaucuacaaaaacguaguuuuuguaguuaauaucauagcaaacagugugaaacuggaugcuuucccccuaagagagagaacaagacaagggugucuggucucaccacuccuauucaacauugucaugaaaguacuagcuuaugcaauuagaaaaggaaaucaauuuauacaggcuggggagaaagaauuaaaacuaccuuaguaugcaaaugucaugauuaccuauguagaaaauuccaaagaaucaacaaagaaguuccaggaacaauuaacuaauuauaguaauguuguaggauucaagguuaaugugcaaaaguuguuuuccuauauaccagcaaugaacacucagaauuuaaaauuaaaaauauaaaaucauucacauuagcacaaaaauuaucaaacacuuagauauaaggccgacaaaauauguauaagaucuacaugagaaaaguugcaaaauguuaacuacauuaaaucaaagaugauuugaauaaauguaaagauaugaucaugaauagaaagacucaauauuguuaaaaccugaauucuucccaaauuaaucuauagacugaaugcaaucucaacgaaaauuccaguaaauuauuuuguaaauauugacacacugauucuaaaguuuaucuggaaaggcaaaagacccagcauggccaaacaauacugaaggaugagaaagaggaccuacccuacccaauuucaagaccuuauauuaggccauagugaucaagacuggguagcaucauugaaagaauaggcaaauacaucaauguaacagaauagacaguccagaaauagacccacacaaauauaaucaauaguucuuugacaaaggagcaaaggcaagucaauggaaaaaguagucuuuucaacaaaugaugcuggaacaaguggauauccacguggaaaaguguaaaucuauaaauggaacuuacaccuuucacaaaaugaaaaguauuguuuacacauaaccccaaauuauuuucuauuuagcccuuugucuauucuuuacaacagcagcucucuuccuuagcucucuagaugcugaguuuuaauuauauuccuugcuucucucaguucaucacuuaccuuucuuauuuuccaauuauauucuuaaacaauguaugauuuuucucugaacaaaaauauuauuuuuagcuucauaaaaccaggaagcaaauauucauacuuuaugugaaaugauuuuuuuuaaucuggaauuuuaaaauaauuacacugcuuuuuuguucucacuuaaaauuaggagcugaacaaugaaaacgcaugggcacagggaggggaacaacacacacuggggcuggucgggggauggggucauggggagggagagcauuaggaaaaauagcuaaugcaugcuaugcuuaauaccuagguguuggguugauaggugcuacaaaccaccauggcacacguuuacauacgcaacaaaccugcacauccuguacauguaccccagaacuuaaaauaaaaaucaauaauuacacugcuuuucaaucuuaaaauauacuuuguugcucaguauuucauuuggcacugauaaaaauacuaaugucaguaacauugcaauuuaauagaugaggaaacagaacccagggaggggagauuacuugucaagguauaauauucuggcagaauaagaauuaaacuuauaucuuauaauauuuuucccuauucuaaguauccuggagccuagcuuauuuuacuauuaaugucucaaaaauuuucaauaauaacaacacauguacaauaagaaaaucaaagaaaaaaccucaaaacacauauagagaguaagaagaaacaaaguuaauggaguuauaaaauuuugauugaauaaauuauuuguuucugcuugcagauuuuuuuuugguacauaaugucaaaaaauaagacaucuaauucauaacaucagcauaagaaaauacaugaaagugaaaauaaacuuaauucuuagcauaaauuucuagaagcacucacuauaugcagagccauuuuauuaaacuuaauggaagauuauuacacagcuaauaugucaagcacaaugcuaucuuuguuacuauucucucuuggaucuuuugaaguagguaucgucuccauuuuauagcuaacaagccugaauuucagagauaucaagugauuucuucaagauuacucaaguaaaugacacaaucagaauuaaaacucacuuccuucaucucaaguccagugcccuuuuaccguauacuauaguucaagguaaggaauacuuaagagcauaauggauaguguauuucauggcaguuucauaccaugguggcugacgaacugcagggaaaaaauggaugacauuuugguuugcuuuauuguagcaucaguaguauuaauauucaaaauaauagucauaauagcaaucacuuccugaguggcuaucacauacauaauuuacaccauguuaggugguuucaagcuucuaucucagauagcuacagaaacuuugcaauuaaaacauuaugauccccauuuacacaugaaaaaacaacaaaaacugaugcuuacagugaucaagggauuguccaaaguuagacaaauaaauauuggaacugagauuugcuccucaaggguccaaacucuuuaucuauuuuaauucuuuguuaaccacaaucaaaauggucauuuucauccuuucuauuuucccucuugacaauagguuaaaauugcacuugcaauuaaacauuucuucaguuugcuaauugugugcccaauuucaugcucuggcugaaagcacccacaauuagcaagcacugauuagaugcuuaugcaguuuccaacaggauaacucuuaguaugcauaaaaggagacuaccuuuuaaaaaguuggccuuuacugguauaaguuuuaaagguuuuuauguagggaaaaugucaauucaaauacaacaucaaacggcauuuccuaaaugcauuuuacaugcucaccacugugacaggucucuauguaaauguuuauuguaugaaagcauaaacucuaacagaaaagcauuuuuacaagacaaaaggaaauguagaagacuacguaagacugcagagaugacaguaacuagagaugaaaaacauaaaugugcccauuauuuccaggaaccugaaagacacauuccuuuuuugcuaguuagacugucaucucugaccaauuuuacacauuuuaaagcuagcaguucuagaaggacccuugugcaucauuggaugucucagaacauucguaauggguuuuaggaccuuaaauuuuuaggggccugauuugaauccaauccaagacguuaccauugaaaagccauguuuccauuguucaaaguagucacugaauuugcccauuuuauacaucucugaacacuguugaauuuacagguuaaacaauuuaauucaugccaacuugaccauugcaagacauagagauuugagaugagagugaaugcaaaagggggaggagaguuucgggguugguaguauggguagaauuacgaaccuggcucuaacauucaguaaagaaacauuggaaacacauaaagaauccucugccauuuuguuaaaaaggaaacuacaaacccucccugacuuacgauuauuugccuuacaaauuuucagcuuuaugauggugcaaaagcaaaugaguauugaguagaaucauacuuugagugcccauacaacucugcguuuuacuuuuaguacaguguucaaugaauuaccugagcuacucaaugcuuuauuauauaauagaacuuguguuagauaauuuugcucaacuguagacuaauguaaguguucugagaauguuuacaguaagcuuggcuaagcugugaugcaugcuagguauuaaacgcauuuucaacuuacauugcuuucaacauacaauggguuuauugaguugugacuccauuguaaaucgaggagcaucuuuacauguuuuucucauugaacauauugcuuagagaaaagaaacagauccaaauuaguggcuuuauauuuaucauuaugacucagcauuuuccuaaagaaggugauuacccaauggaaauauuaagaaaauggcggaaauuguuugguuaaaguaguuaucauuugcacauaaacagcuauagguacacauauggauaugcaucauauaacaugcagguauuaauuuggagaagauuccaagacauauuucaaugagaaaugcacaccuuguuuauuuuccagaaucacagcauaaucagagaauaguaaaggugugacugcacauucacuuuaggaacuguuccagaugacaguuuuucauguucuuuccaaucauucuauauauuuuuagcccagaggacugacaaaaugaaacaguugcuucacaaauuaaguucccuuuccuccuuuucacucaaaauaaacuguauuagaaauuagaaaaagagaaacagaaaaauuuuaaaggcuuuuuucuuucaaaaauuaucaugauguauuuuccccuuuccuaaauaauuuauacauaaaaacauaggaaauauuaccuuguuugcauagaauugucugugaaccauuacaaaauuucuggcaaaugcuacuaccuucuacuggucgagagcagauucuagcuaucauacgcauaaaacaacuugcaaaugaggccauuaaagaguuuucacauauacaaaacauuuauuuaaaucuuugguaauugugacuuuaaucuggagaaacaaaaaccuauuaauaagauucauguuucaauagacuugugaccacugugagcaaacuguagccacaggcauuuugggagcuccaacuggucagaacacaggggaaugaagucccugucucugcauaaacugaauuauacaaauuauacaugugcagugaccaaucacuggagacuuugaaagaagugucaugauugguuacugaucaugacguaugucuccucuuuauguagugaauuguggacugaaggccuagcagcaaaguuuguaauuuaugcaauuaugguuaguacgcuguggauugaaauugaacuguuguuggaagacugguauuauuuaaaucgauuccaguaaauggaauucuugcagauaggaaucacaugaagagaaaauuuccuguaauuaugugaaauggaagacucaucaaauuuagaaaaauuguguguguggcuauuugcaaaauuaucuuaagauuuaaauagauauauauaaauuugaaaaaaauuaauaaaaauauuaauauaaaaauaaucaaauuuugauggaaacaccauuccucuuccuacagggggucugucauaugagaaaaacugaaaccuuaguaguaacucauugauauauccauccuguuugcucucuuuuacaaaagaaagaaaagauacacaguauuucugcaugauaaaauguaguauauucacauaaaaguuuccagaaaauaacuuaaaugugaaaugcuuuugauucccugaagaaaccaaauauauucuucaguguaccucacaacugcagcuuuuuaucagauugcuuuaauaauggcaccucuguucaauuuguuauauuucaucagacaugcguggcagucagcacaaaggacaaguuagacuuuaaaaugaacugugcaaaucuucugauaauaaaacgagagugacagauauaauuaugagguacagacagauaaaugaaagauucucaaggacguugguggccuacuguuuagagcuuauagaacaaacaccacugagaaaauuccuuuguauuuuccacuuccucaauuuuuuuuuuccuuuguuuucuaaauuuccagagagcuccuacccuggaugaucucauggucacuaaggaggauauacauauaaacacauauuuauaauaacaauacaaaugugauaaaauaugcauaauacauuuuauggcaauucacugcuugauaaccccuaucuuaauuuggcuuucaaaagacaggguaggcauuuugaucaccacucauagagaagaaacuaaggauuagccaaauggaguaauuuacucaagguuacccgaguaaccuugugaaauguuacucaucagagggcaagucaaaaggaaacaauuuuuaguaaaguauauauaacuguauauaacagcauauguguaugccuccuaaauucugauaugaagagacuuuucaaauacauucgugaaaaaguguuuuaaaaaugccaacauuuauaauuauuuuuugaagcaucauguaagcuguauaauaaaagaugaacauagaaaguuuucauagcuaaauaucuuaguuuuacauacuauaauuuuuaccagacauuuuuuacaugcaugcuguaaucagcuaacaagaaugguagcuaacugaugaagaguuuugauuuacuuccuaguauaauuaggauagucauuaauagucuuuguuuuuaugucauuucauggcaacauucuccaauugguaugugucaggccucugagcccaagcuaagccaucauaucccgugaccugcacguauacauccagauggccugaagcaacugaagaacgacaaaagugaaaaauagccaguuccugucuuaacugaugacauuccaccauugugauuugcucgugucccaccucaacugaucaauuuaccuugugacacuccuucuccuggacaaugaaucucaggagcaccuugugaccccugccccugcccacaagagaacaacccccuuuaacuguaauaauuuucuacuaccuacccaaauucuauaaaacugccccaccccuaucucccuuugcugacuccuuuuucagagucaguuggccugcacccaggugauuaaaaagcuuuauugcucacacaaagccugugugguggucgcuucacauggaugcgcauaacaguaugugauaacaugaugacacaaugauuauugcagaauuugaaaugaaacuuauagaacaguucuuaugauuauugcuguaucagaugaguucacucugauuaauacuauuaaauaguacagaaauuaacaaugauuugaguauuauuuaaaauuaguaccuuccuuauaaaugaaucacuucauggcaguuugugucuacagacgccuauuuaaugcugugggauucccucuccauguggggucaauacuagcuuagggaccaacaaugucuuuucagcgacaucuuuacuuccagcuguuuuuagccacagaaauuaaguuucugcaccuacaccuucuuugcuguaaauuauaauccccaguugauuaucuugggaaaagucuguguuucauuaguaauguaaaaccacuugaacucacacacacaugcacauacacagccugugcucuucccauggaaagcaucagugcuagacugcaaaacaacugggcuuauccuauaaacaacagaucuugcaaaagcaaagaaaguuuugcucauuuauaucucugucucucucuucgccccuccugguugcauugucaucuccuuauugcuaaauauauucccucaaugaucacauuuucaauguacuuuuccauuuucauuauuuuuuaauaucugaaaaugaaaugaucugauaacuugauucuuuaaaaagccauaauuaucugugcaaacacaaaagccuaaaaauaucacaaauccacauccauguauuaaaaauucaucuauuugcaucauuuagauaagaacuaccagaaaacuuuuaagucgagucguucccuucuuuucuauggugauacacgacaaaaaggggcacagacaaugaugaggacuguagcuaauauccguuacgugcuuacuuuggcaagacauuuuuguccauguacuaucucauuuaaaccucacaaugacccuauauagcuggugugacuuuucucuuucuguguauuaggaaacucagucagagagaaauuauguugcucaagaucacauauuuaguuaguaucuaagccaagauuucauuccaggcaguuuaaccacagggccuagacuuuuaaccaacagucaguauuuacagauauuaagacuaguuuugauaaguucuguggcuuuagagagcuaggcaugagacauacugaauuguagagacauuuaaccguugagaaaugaaaauuuucucugaaaauaauagaacuaugauucaaugacacaauaauagugaucucucagguaccucaugcaccucgcucagaagaagaaugcuaguuaggcauauaaacuaacgcaccuuauuggcagaauaauugauuaaagaaauaucaucaacauagugcuucauuuuugcaguauagcauuggcuccaggagcacccagccacagaagcagagagaaccauuuccagcaugcaucccuauguuacgacaaacauuggcugaaucuguuccaaagcuuugcugaaaauuacauugacuccauuuuaaaguaguguauagaaauuguauaugccauuauaaaacugccagagaauuaaguaagucaaguaauguuucuuaugacuagacagucuuucuaagaaccaugugacaagccagcauuuuguucucauauaccaacaaggaaguaauacugugaaaagucaucaacaaugaaggaaaauuagaacuccuuaaaaauuaucuuuuaauuuccuuuuagacuugccgaugaucugugccucgaucuuacagaagaucuaguuccaugguagaauacagucccuaggagaggaguacauaagucuguauuuguaucucaguggcuagcacauauuuauucccuaauaaauauuuguugguaacuggagaaggaaauucuggaagaggaugauugaaauuucggaaguagccauggaaauauguugcauucugcacacgcaacacauacaggcuacguacaaucgcacugcuacucuauucugacuucaaaaauuguuugauuuuuuuuuucccuugagacagggucucacucugucacucaggcuggagugcagugugcaaucacagcucacaacagccuucaccuccuggguucaagggaucuuccugccucagcuucccaagguaauacagguacaugccaccacuccuggguaauuuuuuaaaaaauuauuuuguaaagacagugucucaguauguugcccaggaugaucuuaaacuccugaacucaacagauccuccagugucagccucccaaagugcugggauuacaggugugagccaucaugccucaccuggaauauuuuuuucugaaucccaaggucaauauuacacuaaguguuauuaaauagauuaaacaaaguagaagaaccaaauacauuugcuaguaucaauacuaccauugaacacauaacuguagagauauagacugaauguuuuccucuuucagcucauuuucacauacaucaauuauaaacaguucuuuccauuaggcagauaauuauuucuaaguuuaauagaaaauauaucaguaaggaaaauggauauacacaugucuuagaugucaaaagcauuuuuuuuuucuaauucaccuagaaaccuuuuuaaaccaucuuuugcaccucaggacagaauaauuacuccuuuccacauuguuauuacuacguaggcuuguuuuucauucaaauaaacuuuauucagcacuuauuuguucugugugaaaacagaaaugcagagauaaaucgggcauggauucuucuucucaagauagucacaaaagucauaucugagaaaggauguauuuuuuugguucucccacccuuuuaccaggaaaugucaaccagccuguaccagcuugacuugaaagaugaaccaaaacccuaaugauacauaauguucauauauguccaugcaauucucuguucuauucaguaaucugagaugcauguuguuugugugucaucucaaacacccuggcaaucauaaaaucaucuaucuauaggaauguuucaaguugcauguauuguugguucuuuuacaaaaaauaaagcggcacaauaccaugcuauccuuugaaaucggcaugauaguggauacagcuuggcaguuaaaagguugucauucuuuuaugucaacucguuuggguuucaaaauucacuccuccacuaucuagauguguaaucccuauaccuuaauuucuucaucuuuagaacaauguugaaaauaaugguaccugugcaucauucuuguuuuuauuauuuaugaggacuaaaauacucuguauuaacugucauuuggugugagcuugaagaugauuauuuuuaaucacuuucucaguaagauuuauguaacauuuuaaaaucuguggcucuuuagcuuacauuauuuaauugacaccaucugaaagccaaauccauggcuuacagcucuagggacauauguuaucaaggucacggagcaccauucaugaaaacaguaugaauagcacuuucuggaguuggguuuccugauucuuugaaaacaaaccucgguagggacauugguguucuuacuugugaaguaagucaugugauuugaaaaugucaaauagguaauaauaguaauugcaccaggucacauagucaauaacuggcagagcuaaauccuccagcuuuuuuuuuuuuuuuuuuuugcgcuggaucuauuauugcucgaagcuguuuugggaacauucuauucugucauggugaucuugucaucauauaaauauuaaaacucaccauuuucuaguuuaguuggcccacauaaguuaugccacauuuuugaauacuagaaguguuuucagagauuuagaguagucaaauaagucuuuaaauucaagaauaucugguucuggaggauauuuugauuuuuuaccuccauuugcuuguguauaauuacacuuguaaaaacugucagugcauagcuauugauacauaaauaggggaauuuuuguuuuauucucacuuagcucaucgaaaacagcaguucuuaaaguugccuuugcccugacacuuccucgugaguucuucagcugguuugugaacucaucuuauauuuuggaauaugguaugguagccaacaucuccacuucugggaaucaaaaucauggggcaacagguccaguguaagguucugcacuauggcauuagauucagcucaaaagcaauggaucaagggaaccucugaaagucagugcacagacucuccuguuauccucuggaggauuugcuagagagagagccguaacccaagagacgggcuugucaaaggagagcaagaauuuuugaaccagaaggugagagacagaucuugggaaaauucccuguuuccagugaaagguguagcugcuaugacuauuuacaggauggcaagagucucacaaaucgucaaagugucauuaagagccucaguucuacacacccacagggcaauauuuguacauauaucauuuuaccauaccuugaaacaggcuguccuuugaaauacaucacuuaagagcaugaauuucacaucacuuauaugccacaugugauaggcuuaauaucuuaauaggaggauauuuucauucaugacccucuuaggcuuucugaaaaauccugugacuaaacuucuccuaugggguaagugacucauugaacaaacauacaaaugcacaacacacaauaaaugcugaguaaacucuuuguauguuuauuguuucagccuguuuaaaggaauuccuguuauuugaaauauaauuaauguccgguaugacacacagaauuuccaaugucucuuguggcacuguaguuugaguucaucuggucuucugagaguuucaaauauaauuauuauaaauaucaaaaggaagauaaucuauaaagagauuaaccauuugacacuuuuauugaggaaaauauuaagcaacaaggauucccacuccccgccaaaucacugaaauauuuuagguaacgacuuggccgugcaugguggcucaugccuguaaucccagcacuuugggagaccgaggcaggcauaucaccugaggucaggagguugagaccagccuggccaacaugguguaaccccaucuguauuaaaaauacaaaaaucagcuggcaugguggcaggugccuguaaucccagcuacuggcaaagcugaggcaagagaaucauuugaaccugggaggcggggguugcagugagcugagauccugccacugcacuccagccucagugucagagagagacucugucucaaaaaaaagaaaaagacuuuauauacaauguuauauauguauacaaacacaggaaguagagagagauuaaugugagggugacagaauagcaguucugccaugucaguaguauguauucauaauaacugagacgauaaugcccaccuauaaauuacuaccaggaugaaacaauccagugcauggaacacaucuagcucagauuauaauacauuggguacaaaagaaggucuuuaauauugaauuuuucuuccuuaucuauuaaccgauuaugcauaauguauuucugcuuagcaaugcaaauaucuuugcccugaaaugucuguugaccaaaaaucuuuuuucuucuagguguauuuuaguuacuaguacaacuuguacaacucuuuucacaacagaguuacauuagaucuuuugcuugauguuuuucugugguuugcacugcuugaaaaagggaacucaccucuucucugguauguacuuugcauuuucucccagugauacgugugcaacccagaaaugaagguaacuugccucaaauaacuguaaaauguauauuagauauuaaaucugugaacuaacaugaaguuuggcaauaauguuuugauugucaccuauguaauaagccacugauaaaaccugauagcaugguccuuacuauaaacgguuccaaaccucuuaacuauugagcaguguacaaagauuaauguaauauaaccuuugcuggcugaacguuauguucucacacuaggcuuaucacucaacagggaacauuuccuggaugagagaguacuuacauuaaaaauauauauauauacauauacauacguauauacauauauuguucuuccacagugaggaaacuaggucacucuaauuaauuaaaauuuugauacaaagaauuuauaagaugaaugauagaugugaaauuuacuuucuguuuucauaaagcaucauuuuugcugucuuguucuacagugagcaaugguucuaugacuuaaaacaccaaagugaugauauaugaugauguagcuuauacauguguuucugugcgucugaccugagagaacuuuauaugguuuuaucuggaaauaggagauauaaaaauauucauuaaccugaaauacuauguggaauacuuagauagagaugaugaauagaaaacuagcauaauuauuguggggaagggaguagaaagcauuagaagcucuuacuuucugaauauaacacauuaacauauucucuaacuuuuagcaaggcacuuaaucuuucaaaccuuuauuuuauguucagggguacagguuucuuacauagguaaacuugugccauggagguuuguuguacagauuauaucaucauccagguauuaagccuaguacccaauuacuuuuaguuauuuuucccauuccucucuuuucucccaaucuccacccucccacucuccccuuucccacccccucccaucccccaccacccuuucacucuccaccuccccccacccucccaucucccucccccaccacccucccaccccucccacccucccacuccccacccuucucccugccaccuuccacccucuacccucuccccccgccacccugccacccuccacccuccaccccccacccacaggacccugugugucuuguuucccucuauguguccaugaauaacaccauuucuaaacacccccaaauaacugcauauucucaaagcaacuauaaucugaauaucaccaauuuuauuuguaauccuagcuuucccaaccccuccugucucccaaaaggcaagacucaacuauacaggaaguucuaaaguauucuggacaagccaugacuuagcacuuguugcacccuguuugauuucucuccuuucucugcaauaaacaaucauuuuuucugugacgcuuucugaggccccuaagccaacacugauccuccgcacuuucuuuucccauagcacucuguugacacugccacuaggauuauuuuagaguauucaaaaguuguagcauuuggaaauuaguagcucuggcuucuguaagggccagugucaaacuuugauuaaccuuuuuuuaguauucaucucaucagcuuugauaggaaguuccacaguaauccauauuaaguccagcacucuuguaacaccuucacacauguucuaucagauaaauaauagaugcagugaaccuauguaagaaugccuuugcuugugucacuuacaggcccauggaucagugacauguuucuuucuaguaugucccggauccaugugacuauaacugcuguagcauugccacaugcuucguuauuaucaucugcacacugcagaaaaggaaauagauguuuucauuaagcuuuuauuucagaacacacguacagaaagccuucacucauaaagucaagucacacauacgcuaugauaugacagaggguuugaaugguuuguauuuuuucauaaaugaacuaaggauaauugagguaaaagauuaagaaugacuucugagaacacuaaauaaggagagaaugaggcaaaacucuaucuuccuuuuuucucucucaagaguucuucagcugcuguaaucaagguuaugaagguuuuccauuauacuauaauacaacacucccuccagucaucuguuaagaaaaaagagguguaaaaacugacagauaauauuuagacauagucuaaagaacagaauucagcuuuuagcuuuuguuuagggguuuuguuugcuuuuuggugucuggaguuuuuguuuuguuuuuuaaauuucccuccacacauaacaugugguuacauaauccaaaagucuagguuugaaucuugauucuauugcucacaaacgaacugcccuugacaaaaucaccuaauucauugagccuuaaguccucauguauaaaguggucauaauaauaauaccuaacugaaaugaauaagguaugcuuauuuaauaauuuaaugaugacaauuaaauccgcuacauuuuagaagugcuucuaaggaugguuucugacacauaacauguucuacauauguauuuuuaaaugaaaauauaaauguaaauugauacauuuguuuuauaugacuaaaauaggacacauuucuuagauauuauucuuacugacauuucaaggcaaaaaguaguuuagaaugucuuaaaaaaaagaaugucuuauaauuaauuuggaauauaaauaaguauaaagauuuaaacuguaaaagucccaucaauugaagucaaguaauguuaccgcuauaauugggaauacaggcaaaagagaaaagaaagaagaaacgaagggaaagagauuaacagagaaaagagggaaagauaaaugcagaaugaagacagagaaaggaaaggaggaaggaagggagagaaagaaacaagaucagccgggcacgguggcucacgccuguaauccuagcacuuugggaggccaaggcaggcggaucaugaggucaggcguucgagaccagccuggccaacauagugaaaccccaucucuacuaaaaauacaaaaaauuagcugggcguguuggcgggcgccuguaaucccagccacucaggaggcugaggcaggagaauugcuugaaccugggagguggaaguugcagugagccgagaucgagccacugcacuccagccuuggcaacaggacaaugugagacucugucuccaaaaaaaaaaaaaaaaaaaagaaacaagaucauguccuuugcauggauauggauggagcuagaggccauaauccuuagcaaacuaauacaagaacagaaaaccaaacacugccucuguucucacuuguaaguggaagcuaaaugaugggaacacaugggcacauaaagggaacaauacacacuagggccuaucagaaggcugagggugggaggaggaagaggaucagaaauaauaacuaauggguacuaggcuuaauauuuaggugaugaaauaaucuauacaacaggccuccaagacacaaguuuaccuauguaacaaaguugcacuuguacuccugaacuuaaaaguuaaaacaaagaacaccuaauauuccugaaaaagaaagacaauccugaaaagugacaugaugagucaaauacucaaguugccauaaauuuuauaaguguuagaaaagcuuuauaguaagcaauuuaugaucugaaaacaaauuauuuauuauaaguauuagaaugcaauuucaaauuacuccaccuacuuuaccuguaauuggauuuucaauauucaaauagucuauuuuaaaauguucuauauuaauugucuauacaaaaggaggaaagaaaauugagagauuguuaaugugguuuuuauaauguaugaauuaauuagaugauuucauaaacccuuuuugcaaaguuagcuuucucuugaaacacauaaacuuuugaaaaguccauaagcauuaauuugugacuuacuaauauaaauuauucuagugaaaccuaauagguccuacugaguacuguggaauuauuccuuacuaaauuauauaugcaaauuuucgacaguguaaauugagcuauuucuaaggcacauuaaaaauauaaauaauuguuuugcauuuucaaagguccuugaauaucucuugauuuugcuuuaaaagacugcauuugaaaauuauaaauaucauaauuaagguaauaaauaugacauuauggcugggugugguagcugaugccuguaauuccagcacuuuuggaggcugagguugguggaucacuugagggcaggagcuugagacuaaaccagcccggccaacguggugagaccccauauuuacuaaaaauacaaaaauuagcuagguguggcgguggucgccuaaaaucccagcuacucaggaggcugaggcaggagaauugcuugaaccugggaggcagagguugcagugagccaagauuugugccacuguacuccuacuccagccugggugacagagcaagucuccagcucaaacuaaauaaauaacaaacaugccauuuauauguguauaaauuauauuuauaagcauuucuauagucaaauaucuaaauguugagaaaaguaaaauagcucagaauagcaugaacuaugcgagguaugcaggcccagagagauaugagcgugggacaucagucaugccuucacccuccaacacuccacaucccaaccccugcacccacgucugggggcaauuauuucaauucauuuuguuccugauuagcugcuucaccccuuauccucuuguuucuggaauuucugauauagagaacaacguauagcuaaucaauagcuuaagcuauuuuuauguaaauucuuaguaaacaauucaggaacugccucuuucuccuaaaaaaaaaaaaucaccaacuauagcauguucucacuuauaacaaggagcuaaacauugggcacuccucggaacaacagacacugugaacugcuagaggacagagagagggagggcacugugggcugaaaggcuaccuauuggauauguaaaccaaaaauaaaauucuaaggcccccagucaucugaauagaccccucuucucagccaagggcauuccgaagguaaccugaaaauaugccuuguuaccaccaaugcagaccucaagaccaauagaagugacucuuuaaguuccauaagaaacauuuacaaucuauucucucugaauccugcuaccuugagguuuugucugcaugaucaaaccuuggucucuauaaccccuuaucacaaacaagauauuccuuucuaugcauuccaggucuuuagauaauaaccaauugccaaucagaaaaccuuuguauccaccuauaaccuggaagaaccccacuuccaguuuggaagccucccacuucccccacuuccaguuccacguauaacauggaagucccucacuucaccuuuucagacugaaccacuauauaccuaauacauauugauugaugucucaugucucccuaaauguauaaaaccaaguuguagcccaaccaccuugggcacauguucucaggaccuccugagguugugugaugggcauguccuuaaccuugcaaaauaaaccucuaaauugauugagacuugucuuggauacuuuuuaguguagaagugccaauaugguuuggcugugacccacccaaaucucaucuugaacuguagcucccauaauucccauguguugugggagggacccaguaggagauaauugaaucaugggggcaguuucccccauacuguucucaugguagugaaaaagucucaugagaucugaugguuuuauaaaggauuuccucuuuugcuuggcucucauucucucuugccugccaccauguaagaugagccuuuugcuuucuuccauuauugugaggcuucccuagccauguagaacugagaguccauuaaaucucuuuuucuuuauaaauacccauucucagguacgucuuuauuagcagcaugaaaacagacuacuacaggugcuaugcuuacuaccugugugaugggaucuguaccccaaaccuccacaucacuuaauauacacauguuuacaaacccgcacauauacucccgguaucuaaaaugaaaguugaaauuauuaaaaaaaagaacacaaacacuuguagcugccacaaauuggaguguacauuuaggaaaacuugaaucaaugcucccagguuguaaucuucaagcuuugcccagauaaacacuccauuaauuucaccucaguuucuucuuuuuaggucaacaaugucuaacaugagaaacacuauagccaauucauuauaguuucuacuauauuugccaaugaauguuuagauuucgcauauuuauugauaauuacaauuaaaucauuaaauuacaugaaaaacauguauaucauaaacaaacugauuuaugauauacauuucauauuuaugaagaauguuucucauaaaauaauuacagaacgauauuuuagaauauuauagaacacaagauuauagaaaauauaauauagcuuagccuaucaagggcaaauuuauauccaaaagaauccaaauguuauagauaauuuuaccaacaacauuaugugacugaacuagcucgagaaccaaauuucacuuuguguuuccuaguaugcaagagaaauggaaaacaggauggguuaugaaauucuacuuacuaauaaaaugaagcauauguauugauaaggaaagcaaauguuuuuuaaugacuaaauugauaacaaugaauacaacuaagaacauugccuucaacaauggauagucuuauaacucauuuccacagaacuuuugaaaaagucaauguuauaacaaaugacuagugaaagugugugaaggguuauacuuacauaauaaaauggcuaacauuuauuaagcuccuauggugugggagcucuugaaccacuuaaaguauauucaccucuuuaaagccaaugacaaccaaaauagguacuacauggcauucacuuauucaaccaaacauacugaauacuuauuuuguuucaggcacucaggacuuauaaguaaaccaaacagcaaaaagccuugcccaucauuuaaaauaaaauagcugagacuuaagaggcuaugaaaccuaaggucauagagcaagucacuugguggagccaaggcuugaaacuaguaagauugcuagcccaugcuccuaaauguuaagucagaugugcuuucaauauguaaauacauaucagguuuuuuuaguaaauguauuucagaugauccaagaucagaauucuuucugaccaaacaggaggguaugucaccaguaugaggggaaaaaacagcgggagaaggccaauuuggaaugaaaauaaucuccuagaagccaaaaauguuaauuaucccauuuauuauuuuuuuuuucucaaacaucuacuggauaccuacucugugcuaugcacuguuacagacaucagagaaguguaaauaaauaagauguaauguuugccugccaacagccacagucuuguugguuggggugaaagagaucagaauaugcuaccccaaaauaugccacuuuagcauaaggaguauuuuaagcugaaggcaauuagaaauagcaaacacaagaugaacugucuucagcaaggcaugaauuuucugguuguaaaggaaacuuauaccuguaaagguguccuacuuucuuauaucagggagaagugaauaagucaccaccugagaugccuuaagguugcauaacaaaccuuacuaaauagcccuuauuuacuacacauuuccuagucauuuucccacaaccuacuccggccacccagggauuaaacccuccuuuucuuuaucuagucucuuccccacacuuuaucacacuuuguuaaaaugggauacagggcccggguccaacugccucuuugggguauuccuugcuuuuaugugagcugccccuguuccuccccagccccuacacaucaaauaaauauuuauucuugauaaucucucuuuugucaguauaauucacaggccucagccacugaaccuaagaaggaagaaaaaugcuuuuuuuuuuaauuuuuuuuuuccuccaccagacagaggcucagcagguuuaaaguccaucaaauuaggaucaauacugguuuuacuacagaauguuuggaaucuuaaacaacuuauuagcccaccuccauuuucuuauuucuaaaauuagauaaaugcuaucuacuaauacuucaaaauauuacuaagaaaguacguaagacacuacuuauaaaaugucugacacauaguugcuaaguaaauagcacuuuuccccauacuccuauguauguuauuuccauuaaacucucuaaggcaguucugaggucuugaaagagcacuagaacuuagauuuuugaagauuuuagaaaguuuccuuugaaucuuggucauguuaguuuaguaguuguagcugauaguuacuucaugcauucauucagucagucuuucauuacgcaaauguuuauuaaacaacuacgauuuggugacaucaugcuaaauaucagggaaugaaauuuagcaccucugccagggacgaacuaaaaguauucauaacaguaaguacauaaagguuuuaguaggguuauguacagaauguaaguaggacacacucugacuggcuaauuugaucuuggguuuguuuguuuagaaauuagugcuccagcaggugcaauggcucaugccuauaaccccagcacuuugggaggcuggggugggaagaucucuugaagccacuacuuugagaccagccugggcaaaucagcaagaccucuaucucuagaaaaaaaaauuaagaauuagcugagcauggugcuccacugcagguuuggaaaggauguauggacaaaggaaagcuacauagagaaaacggaagugaggcacagaaacagccagauugguuacagcuggugucuggcuuauucaaacacaguuugaacagguggacccugugugugauugaaguaugguugucguaaugggaugagacuuggcuacuuguuacaagaguaggcuauacucuguuuacacauccaguuagguuacaguucacuauguauggaaaaaccuuuaggccaaacuuaaaacacauaagacagcaucuuuaggcuaaacuuaauucaacauuucuguuucguuucuggcauaacuauuauauauagaauguaaauaguucuaauauauuuuaaguguuucuuuauguaugacauauuaugagugaacuuuaguuaaaacugaaaugaacaugguaaugagaaaaauuuacacacaagugauuuugaaaacagaauggauugcuuacaaauuacaggaaauguuauaacacaaaccagaagaauucaauggaaggcaauaagggauucugaaaugaaaauuauaaaaguaucaagaccaaugaagguuauuugaauaucaaagcuauuaugcaugaaucuaugauucugaacuaauguaacaagaaaaacuacuaucuuaaaauuuauaucauuuaauggaaaaaaaaugagaaguaaaccaaccaggaagaauuuugauaagaaaaaaaauugcugagcaguagguaguaaccaaaucuauaaugauaguuuuaaguggaaaauuacauuuauugccuuaauacauuuaaguuacaaaauaaaaucaaagcccaauaaagaauauugguccuaucuuauagaaacaugaagacacaaaaacaaaugauucuaacacaaauaugagauugcaauuguacacauuaaaacaaaaauauaaaauaaguuuugagaauaauguguuaugauuguuugguuauuuuaucuuucuaaagacacauuccaacauuacagugcauuguaccuauuugagaaauacuaaaacuauggcuuuuuacucuuagggaucuuguaauccauuugaguguaauaauaagacugacaauauuagugacacaguuuguuuucaaaaaggaggauaacccguguucccauuccaagugguuuuuugugaugugacuuugccguguuucuccucucccgcagucucacaucuuuaaucuacacugguccuaugacuuguuuuggccaagagaaugcaugcagaugcagagauggcacugaaugacuucuauaggcaugagcuuuaagaaauuuuaaagcucccguucucacccuuggagcugugucuuuguucacagauaacaugauugucuauguagaauuacucgaaggacaaggaaacaacuccuggaacuaauagagaacugauuuugagauguguguaagaauaagagaaaaagggaagcagugagggcuauuucaacuaagaaagauuugcugaagagugaacggucacugcguuuuggaaugguuauguuucaccaggaugagagagagcaucucugaugggugugugcaauguggagauaaccucagauaaaaugagaauacuacuagccggguguaguggcucaugccuguaaucccagcacuuugggaggccgagguggguagaucaugaggucaggaguucaagaccagccuggccaagauggugaaaccccgucucuacuaaaaauacaaaaauuauuugggugcaguggcaggcaccuguaaucccaacuacucgggaggcugaagcaggagaaucgcuugaacccaggcggcggagguugcagugaucugagaucacaacauugcacuucagucugggugacagaguuagacuccaucaaaaaaaaauaaaaauaaaaacaaaauaaaaaaaagaaaagaaaagaaagagaauacuguaucuguggauugguaaaaauauuuugacuaaaauggaaggagaaauauaaggcuaaauuaucauuaucuuuauuuuuauucugguuuaggcauuguccugaaggcuguauaggaauuauuuaacuuauuuaucacaaaauuuuugaguucacaauuauuagacuaucacuuuuauguaugggaaauuugaagcuuagaaaguuaagaacccacagaaaucauucucugcguaacuaguggagcuccaaauucuaaccccaauuaugguuuaggcuuuacacaagcagugauuuuuacaggguugcuuuuguauauguguguccgugugugugugugugugugugugagugacaaaaaaagagagaaacagggagacagaaaaagaaagagacagaggugggauagagagaaauaguuuaaaggaagaguaugauagcaaagacagagacuaaaaguagcuugccucuuauuuucauuccuuuccaaagucuagguauauagaccuucacacaggugaugggucuugggaaaccuccuauguaacucaugguggccuccaggaguagacuaaugacuucacugucuagagaaagaggauacuaaucaguuacuuuuguuuuguuuuuacaguuuaagaagaaaagucucuuaauguaaugaagacauuucuagagagaaggguugggaguuuucuaacucugagauaagcuguccuggucaagaauuugaggagcuggauggcaccuuugaaguucguuguguuuauaaacugggagugcuagguccuaagaauuaccacuauugaagugaacagguggaaacuguauaauuaaacuuaauauuaagggaaugggguugccuucucucaaaacucuuguacaugaauaagacagggaucuuaggaauagaaaaguguagucuaccagacugggcggagcaaagccucaguugccagugugggaguggcuagcuaugacuauagugagaaugguccucucacuccaguccuucccuuggcugugaaagauggacugcucccucuggcuuggaauuguggcaguacuggucuccuuguguaauugagagugaugggaucaacauagacauguggaauauccuguuaaguugagacgugagaauauacucauucugaggaauacauuaaaguggauugcuucuauucacuucccaaguuuguggaaaagucucuguuuuauuaugaaauaaagcaguuaaaguauauuuuuuaauccgagucugucuauaagacuauaaacagggcagaauuuuaaaacuuuuuuuuugcuagaguucgcacaucuagaagugagaguuuuguuuuuuucccuuagcuucuauuuuaggacuaucucuggcuacguucuucauaaacagaaaaaaaguccauggcauacgcuggaaugaggugcaggcaaaauugccaaaguggaccccuaggucaacguuuaguugcuucuuuaggugacuaugucuacaagugauauucaaagaugggguugguccaagcaguauguaacuaaugcuauguucuuagcagauguugccuggggaaaacuaaaagaccugaaauuucuaguuacacaaaaagaauguacuuggccuaguaguaucugguucuuccuaaaauauuagcuucuuaaaaagaaacaaaacuacacugaacaaauacauacacuaaaauaucaaaaaggacagacagcgggccuuuauacauauuucuuuaaaaggccuauuauagauugaauucucuuugaacaaaacauuaauguauguucuuuuacagauuacaaaauuugauugcucuccagagaguuugaaaggaaauagcuacuaaaaagcuguguucauugcuuuuuguccucagaaucuaagauaaagaacaugaaaaaacgguuaaauuagaacuccaaauuugcuuaguaaaauguuguaguacuuacacuaaaguuuaaaaaaagguugaaacaauuuuuaauacagugcaucaaauuuccuuaaccucuuuuaaauauccaguuccuaguuggagggagauguuuugaccuucauauugcugccccagaauuacacuuuugaagugugauccauauagcacugcugcuccaaaggaguccuuuagguaucuacgggauguucaaaaaccaaaauuaccaaaguuggauaaauuuuaaaaagcacauguucugaaguacauuucaauauauacuuaaaacacauaaaguaaaauccuaagcaacagaauuuuugcauuuguuuuuggcaugagauugguuacacgcaauugauguuauaacaaaguuauauuuaaauaaauaugcuucuuagacugucuccuguguauauuacuuaauccuuaucugcuaucaaaagaaaaauucuaagaguggguaaagaagucugaaauuaaauagguuucuauucagauuugugucaaacuacugcaaaaucuccaugucaaaguaaauagaacauacuaauggagaaggugggcuuacugccuguucuucaaacugcuucuacuacaucccaauaacucaauuucaaggcuuugagaacaaagccacugugcagucaaaguggcuaugagagaugaaaguugucauaaaguuucugaauuuuuuaauuaguggcauaauuaacccuuacguuucuuaaguuuuccugaaucauucaaaauauauuaucaggaaaguauuauuguauccauuuauuugauauuuauagaauaugcaggaacagaaaaauauacuuucagguacacaugaaauauuuaacaacauagaccauauucugagacaaaaaaugaauuugaaaagaauuaaaaugauugaaaucauacaauaugggcuaacuagcaauaaagugagaaagaaaacccaaauaaaaaucauaaaugaaaaaggaggcaucauaacaaauaccacauaauacaaaggaucacuagagacuacuaugaacaacuauacaccaacugaaaaccuaguugaaaaccuagaggauguggauaaauucuuagacacauaacuuaccaagauuggaccaggaagaaggagaaaaccugaauagaccaauaauaaguaacaugauugaaucaguaauaaaaagucucacaaaaaagaaaaguacuuaacuggauggcuucaucacuggauucuauucaaucuaugaaggagaauuaauacaaaucauucucaaacuauuucaaaaaauugaagccgagggaauucuuccaaacucauucugcaagcccagucuaaaucuaauaacaaaaccagauaaggacacacacacacacacacacacacacacacacacacacacacacaggaaaauuacaggccaauaccucugacaaauacagaugcaaaaucuucaagaaaauacuagcaagcuaaauccagcacagaucacaaagauaauacaacauaaucaaguggcauuuaugccaggaaugugaggaugguuuaauauacacaaaucaauaaacaucauacauuaaaucaauauaauuaaagacaaaaauacaaucauuuugauagauucagaaaaaacauuuaauacaauguaauaugccauuauauuaaaaaucucaauaaaauagguguagaaggaaauuaccucaaaauaauaaaaggcacauauuacaaacacacaauuaacaucacaccaaagaagcaaaagcuaaaaucuuuuccucucagaacuggaaaaaagacaaagaugcuaacacucaccacuugcacucaauauagaacuagaagucccagccagagcaauugggaaaugaaaauuaaagggcauccacauucaaaugaaugaagugaaauuguuccugucugcagaugacaugauccuauauauagaaaaaccuaaagauucuacugaaaaacucuuagagcugauaaaccaauucaguaaaauugcagaauaaaaaaucgacacacgaaaauccauagcauuucuauacacaagcaacaaacuaaaaaaaagagaucaagaagacaguccaauuuauaauaguguacaaaaaaaaaaagaggaaaccuaaaagugaauuuauccaaggagguacaaaaccuuuaaaaggaaaacugcaaaacacugaugaaaaaacugaagaggauacaaaugaacagaaagauacaucauacucauguaucagaagaauuaacauuguuaaaauggccauacuaucgaaaagaaucuguggagugaaugccuucucuauaaaaauacaaacgacacuccacagaaauagaaaaaaaauccuaaaauuuguaugaaaccacaaaagacccaaauagccaaauaaauccugaacaaaauaaauauggaagcaucauauuaccagauuuaaaaauauacuacaaagccauaguaaccaaaacagcaugguacuggcauagaaacaucuauaggcuaauggaacaaaauacagaaugcaaaaacuaaucuguguaucuacagccaauugauuuuuugacaaauguacugaaaacacuaauugaggaaaggacaggcucuucaauaaaugguacugggauaacugaguaucuccugcagaaaguaacuaaucccccaccucucaccacauacaaagcucaacucaaaauagaacaaagaccaagauauaagaccugaaauuauaagaucucuggaggcaaagagcauaaauucuucaagacacuggucuggaaaauauuuuaugaguaacaaaaaguuccucaaaaguacaacaacaaaagcaaaaauaaacaaaugguaucauaucaaacuaaaaagcuucugcacagcaaaagaaacaaucagacugaaagacaaccuacagaaugagauaaaauauuugcaaacucuacaucugacaagggauucacaucuagaauacacaaaaaacucaaacaucuaaacagcaaaacaacuugauuaaaaaaugggcaaaugaucugaacugauguuucucaaaagaagacauguauaugcaacaaaugaaaaaugcucaacaccacuaguccucagggaaauacaaauuaaaaccacaaugugauagcaucugaccccaguuaggauggcuauuaucaaaaagacaaaacguaaccaaugcuugaaaggauguggagaaaacagaacucauauacacuguuggugggaauguaaacuaguucagccaaaguggagaagaguauagagguuccucaaaaauuacaaauagaacuauaauaugauccagcaaucccacuacuuggcauuuacccaaaggagaugaaaugaguauaucaaaaagacaucugcaucucuaugucuauugcagcacuauucacaauggccaagauacggaaucaacuuaggcguccaauaagagaagaauggauaaagaaaaugugguguauauacacaacagaauacuauuuagccauaaacaaacagugaaauucugucauuuguggcaacguauauagaacuaauagauacuauguuaagugacauaagccaggaacaggauccuuaaacacuacauauucucacucaaauauggaugcuaaaaauagccgaccucauaaaaguaaaaaguauaauagaagacacuagaggcuggaaaggguagggaacagggagagagagggagagauuuaucaaaggauacaauauuacugcuagaugagaagaauaaguucuaguguucuauaccacuuuaggaugauuauaguuaauaaucauauacuuuauaguuucaaauagcuaaaagggggauauugaauguucccaacauaauguaaugacaaagguuugagaugauggguaugcuaauuaucccauucugauuaauauacaguauauguacugaagcaucacuuuguaauaauuuacauauuauacauaaauauuuuuaugucaguuuaagacaauauaauuuuaaaaguguuauaaaauuaaaaauagaaaucaguuacaaaauguauuuuuuuuuuuuuuuaaugagacagagucucacuccauagcccaggcuggagugcaauggcacagucucggcucacugccaccuccgccuccuggguuuaagcgauucuccugucucagccucccgaguagcugggacuacaggcaugcgccaccacauuuggcuaauuuuguauuuuuaguagagaugggguuucaccauguuggccagacugguccugaacuccagaccucaggugauccacccgccucagccucccaaagugcugggauuacaggcaugagccacugcacccagccgaaauguaucuuaaaaaccccaaacaugaaaaacaaacaaaacaaaaaauuacagaacagacuucuaaauuacccaagggucaaagacauagucacagggaaauuauaacuugaaaacagauuaaaauaauagagaaaauaagugaaacuuaaagcugauucuuuguaacaaucaauaauaguaauaaaucguuauccagauuacugacagaaagagagagaaaggaaugauaaaugucaggauagcaagacgccgggcgcgguggcucacgccuguaaucccaacauuuugggaggccaagaugggcagaucaccugaggucaggaguucaagaccagccuggcccacauggugaaaccccgucgcuacuaaaaauccaaaaaucagccggguauuguggugggugccuguaaucccagcuacucggaaggcuaaggcacgagaagcgcuugaaccugggagguagaaguugcagugagccaacaucugaccacugcacuccagcugggcgagagcaagacuccaucucaaacaaaacaaaacaaaacaaaaaggauaacaagagaguacuauuaaccaauuuaugcuccccaaauucaacaacuuggaugaagucgacacaugcaaagauacaaacuaauauuuacugaagaagaaacagccuaaauaguccuauaucuauuuaaaaaaauaaauuauugguuuaacuucuugcaaaaaaguaaacuugagguucaaaugacuucaauagugaauuuuuuccaacacugaaggaagaaauauuacuaccucuaaacaaucuugcuaacaauaaagaaaaagaauuuccaauucauuuuaugagccaccauuaguacauagaaaaccuuguggagaaauuauguuaaagaaaacuacagaucaauauauuucaugaauaugaauacaaaaauccuuacauaucacauccagcaauauauaaaacauuuaguguaucauaccaaguggaguuuuguccggaaugcaguguugauuuuauauucaaaaaccaauccauggggcugggcauggugggucacgccgguaaucccagcacuuugggaggcugagaugggcagauuguuuaaggucaggagauugagaccagucuggccaacauggcaaaaacccaucccuacugaaaauacaaaauuagcccggcaugguggcacgugccuguaguccuagcugcucgggaagaugaggcacgagaaucacuugaacuccggaggcggagguugcagugacccgagaucaugccacugcacaccaaccugggcgacagagugagacugugccaaaaaaaaaaaaaaaaaaaaaaaaggaauuuauuguaacaacaaacuaagaagagaaaguauaugcucaucuuuacgcaugauaaaaaugauuuaacagaauucaauagucacuuauaauaaaaacccuagcaaacugguaauagaaaagaacuucuucaaccugauaaacaguaucuacaaaagccugcagguaacauacuuacugggaaaagacugaacguuuuuccccuaagacugggaagaaagcagggaggcuugcuuuuaccacauucaccuagagguccuaaucaauguaauaacucuacaaaaauaaauaaauaaaugaauaaauaaaaaauuggggcauauagauuggaaaggagcaaacauaaaauuuucuuuauucacaguagacaugguggcguauauagaaaaucccaaacacuuuacagaaaagcugcuaaaacuagugaguauaccaaggucauaggauacaaaaaguauuccauuauguuucuuuauauuagaaauaacaauucaugaucaaaugagggaaaaaguacaguuuaaaauacaaacaaaaauuaaagcgaagaaaauauauacaaaauaugugggcuuaaaaaugcaaaacauaaaagagauaaauuuaaaaggccuaaauaaauggagcuauauaauagaccgauauuugggaagacucaauauuguuagauugucaauuauccuccaaacugaauuauacauucaaugcaaucucaaauaugauccagcuauucuaaagguuauauggaaaagcaagggaucuagaauggaauuaaaaaaaaaaugagaaagugaaacaacuaaggaggacucacauuaacugauuucuuuuuuuuuccuuucuuuuucuuucuuucuuuuuuuuuuuuuuuuuuuuugagauggaguuucacucuuguugcccaggcugaggugcaauggcugaucuuggcucacugcaaccucugccucccggguuuaagugauucuccugccucagccacccaaguagcugugguuacaggcaugcaccaccacagccggcuauuauuuguauuuuuauuaaagaugggauuucaccauauuggccaggcuggucucgaacuccugaccucaggugauccgcccgccuuagccuuccaaagugcuggaauuccaggcauaagccacugcacccggcucugauuucuguaguuauucuaauguuaugcaaugaagacaauuugguguuugcaaaaggacauaaauauagacaaaggaaauaauagacuagagugucuggauacagacucgcaaauauaaggucaguugauuucucaugaaggcacuaaggcaauuaaaaggagaaaauaugguauuuaaaaaaauguucaauuacauaugcauaugcagaaaaagacucaaccaacuuaaaaugaaucauagaccuaaauguaaaauauguaacuacaaaaauuaucaaagaaaauggaggagaaaauauuugugacaucuuuuacacaaagauauuuuauauggcauaaaaaauacaaacuggucaggaaaaacacugauaaauaaaaauuaaaacauucuauuugaaagacccuguuaaaauauaaaaaauaaaccacaguguggggaaaauauuugcaaaaaaaccuauauaauuaaggacuggugugcaaauuauguauaaugaauauaaugaacucaauaauagaaaacaaaccaauaaacaaaacaaaacaaaacaaacugggcugggugcaguggcugacgccugcaaucugaacacuuugggaggccgaggugggcggaucaacugagguccggaguggaggccagccuggccaauaugguaaaaccucaucucugcuaaaaauagaaaaacuagccaggcgugguggcgggcgccuauaauuccagcuacucggguggcgaaggcaagagaaucgcuugaacccgggagguggagguuucaaugagcccaggucgugccauugcacuccagcccgggugacaaagagcaagacuccgucuaaaaaaaaaaaaggagagaaaacgaacugaacugucuuccccaaagaaaagauaaggauggcagauaaggauggcaaacacacacaugaaaaauguucggcaucauugaccaugagugaauuacaguuuaaaacuacauuaaaaaaacacuacaccuaugaaaauggcuguauuuaaaagagacaauaccaauugcugacaaauaugcaaagcagcuaaaacuuuuauauuuuuuggcuagaaaugcaaaaugguauaaccauguuuguuauuuucucauaaaauuaaacauacaaaaaugaacauauaccauccuacccagccauuuacuccaacauuguuacccaacaauaaugaauacaugugccuacacaaugaucuguacauggaagcuuauugcagcuuuauuuaaaaaaaaaaaagaaagaaagaaagaaagaaaaagaaaaacucuccaauguucauccccuagugaguggauaagcaaacaacucuggcacauacauaaauuaugauacaauggaaaaauucucugcaaaaaagggaacuacugauacaugcuauacaacuuacagucucaagagcaucauauuaaaugaaagaagcagaaauagcauggguacaaacuauauaguuucauuuaugugacauucuagaaaagguccaacuacagagacagaaagcaaaacaguggugaccagggguuaaggauugggggagaauauugauuacaucggagcauggggguccuuuugggggcagugguuacaugacugcauaccuuugccaaaauucguagaaccguacacaugaaaauggugaauuucaaugcauuaaaguaugauuuaaugaacccaauuaaaaaaaaaaccuaaaagcccuuaaguauagaugauuaaaauuagugaaagugugguuucacccagggcugccuguggauauaugagcuaaaaugauaaaguaccagauacaugauuuucaggaagaaaucaaaggagaguguguuuuugggagaaaccuuucuggaaacugucaaccgugaguggaaugaugcuuaaugccucuggaaaaaugccaaccucagcaccgugugaauaucaguaagccgaucagagcugcugaaucuuuuggccaaaaaacaaagcugggccuguuccagugcuuuuuacccugcauuucccauccuuaucucugcacuucaaccacuuaaucacaauccuuccacauuccccgccucacuucuugcuauggugagguggcuaagagccacggaauacaaggaaagguugagggacuggguguguucaguccauaaaagaaaugaugagugaaguuaacgauucuuauuuucaaauaugugaaagacuuucaguaaaagauaaaagauauaacauuuguuuuaagaagcccuuaagucauaaugaggauuagcaggcuuaaauuauagagaaaaaaaucaguuuaauauaaagcguuucuaaccauuagagacaucugaaagauagaauaacaccucccauuuauugagauaguguuauacgcauuaucucuuuuaauuuuguaacaacagugugaaguaggcacauuggaauuaaaacaucugcuauuuauugagauagcuguuauacacauuaccucuuuuaauuuuguaacaacaauuugaaguacacauuacuaucuuaaagguauacacacugaaauuuagcucgaugauauaaaauacuuaaguuuauauaguuaaugaccaacauagugaagauuugaacucaggucuuucugacuuugcuaucccaucuuccaguuggcugcauguggggauccugagcuucccaucuuugacuguauguaagaccacuggguaccagcugacuggucuguuuuauaagggauucaaugguggauaaacuagauaucaucgacauacugcuuagauaucauccaaucauuagauauuaugagauuauuuaccagugaauuuucuuacuuacauaauaaaugaauauguauugcccucccuuauuaccauucaagucuuuauuucucuugcauauaaaagaaaggcauccucuuuauuacccuaaauuaccagagguauguucaggugaaagggaugacuucuuagucacuaacagcauaaccgugcccuuggcaguguuaauggaguuugccaaugggauaaucugcucucauaugcagaugcugcuccuggcccucacuuguaaagcaggcuggccagccgccauccuucagcacugugccaacaucuguguggaaggaggcacuuuucccuccccacuauggaguucuugcauaucacuccaaaggcuuaauuggagcacugauggauauuuauaagaaaaguuuggaauccugaaaagggcugauaagaaacuccuuuaauguucguuucccaccucauguacucauuuuccucaaaguuauuaagacgugaugaauauauuuaauucuuuuggcuaguuaccuuuuauguuuugugauuaacuaaucuacucuuuaaacacauuuuguuauuuuuagaugagugguuugggaaucauaaaauuguaaauuuuuaaggaacauuagcugccaacuaaaccaucuacugccuacuaugagaagcucuucuagagaaucccugaaaaaaauagaauuaaacuuuugcucaaacacccaacauauuaaaauagcaggacauuuuugccaugagcucuaguuaugaggaaguuauuuuucacaaauaccuaaauuucaucuccuaauaacuucuaucaucuauugcucucuggagcaacacagaacuccacucugccuuuccaaaggcaggccugaaaguacuuauagauauuaaccuuccuugaccauuuaaauugguuaucucuauauauccugccuagaccucuaacacuuaaucccauuugugcuagaugguaacuaacuaaccuucuaacauucccauaaucuucucugcgcccuuuucuuuaaucacugagaauaagaaaacuaaaauuucuaagacucccuugccaacgguauuucaucagguuuggggguaaaauugaaacccagagaauaaacaagggauuggguuucuggcagcagccaccagaaguacccacggucaguagcaggagguccugcagccuuaguggcugcggugucuccaguagcugcaggggagguggcugcagcucagaggcugagagagugugggguucuaggcuccagcucaaaaacuacagcaccuucuaaucucugccuaauaccaccuuuccccuuuucccuagaucacauuucucuccaccuguaauccauagaggcauucguuuucucgacuuguacccugacguaagaacuacuguuauucuuuucacacugugcauugugacaguuuucuguguccacacacuuaccucaucacuggaucagucaugagaauuauacuuagcauuugacucauaaauauuagguaugaacauuucucaugaauuugcaucauaucucccuuuagccuucucugcuuuagacuacauacuuccaguauauucaaugucccucauaaagcaucaauuccaaauguuucaucuuucugaucauccuuuucaugccauugucuccuguuucaauguuuuuuuaaaauguccaugcagaaguaaacaaaacauuccagauaugguauaauaacaaacuucaaaaugaaaaggaugaauauuccuuuuagcugaauacucugcuuucauuaaugcaaacuucguauuuuuuuuuuuuuuggcagaaaucaccuaacaggcaaaacucauauuaaaacuccguucaaacaccagcacuauaacuuagcucagaauuccacacucucaaaauaauuucaguuauuccuucuuugaucuuuaccguuuguaaauuuaaugugcugccauucuaugccuucauucaagauauugcaagaauguugaauagaaaaucuaaaugcagaggacgcuaugcaaaguuggugaaucuagccucagucugagccauaaguuagagguaccauuaucacucucaacuucauuacccccuuacacggaauguucccaacucucgauaguuucacuaguuucucacuagucaacagucuagaaauuuaaaaauuauuuuaaauauauuuauuguacaugcauauauuuauacaugcuugaauguauguuuuacaggcugaaauuuauuuuuaggauuuggcauuauugguuuuuuuaaugaugaacuuauuuugucaaaaagaaaauaaucauaguuaccacuuuuuuguuauuguugauauuuaauagaauuaaaauuccuagcuauuuugcauucuaaaagguuucuuugacaaaucuuugcuuuuaaaauuagacucuuuuugacaaugaagaucauugcuacaauggauauaugguucauggaagucccugcaggaggucuguaccuuagaucuaagaaauacaguccaaaaucccaaagaaaaaacaguuauggcaaaaaacuaguaguuuagagaacaaaaccaguauucaaagauaagagggucaaaaucuaagagacaaaauuugguguccaugcaaaagaauagagagagaaagagagaaacagagagacagagaacgacagagacaaugugguuaaagaaauaagagagcaacucagaaaacuuguuuuuugaaguagcuacuagaaauagcauccuccaccagguaccugaagggaggcaaagaaagaaaacccaggccuuuucucucauaaaguucaucaacuauuuggaaaucuuugauugacucacaugauaaguuaaaucuacaaaagcaaacuuuccauaucaaugcgagaccacauuaaagaucuguaaagcaaugccauagagguagguuggaauaccaaguaaaugauaaacaggaugaaagcucaggagaagaauaugccaucuauugguggauuaguuaaggaacaguuuuuguuagaagucaagcccaaauugagaauaaaugagaucuuaauaugugaggcugugaggaucauuuuaguugagcaaguauacauguauucacacacacagagagagcuacagagagagagagaugacaaaaagauaauugcaugucuucauuaguagcuuaaucuguuugcagcaaagugauaucauaugagucaaaguugcaaugagauauggacaaaaagaggcauugaauugggaucucaauguacaaaaaauuguuucuucuaaaggcuaugagaaaauguugaggcuuuuuaaauaggagauugacauaauaagccauaauacuuuuguuuucuaucuugauuaguucagucuuuugggcaaucauucuaguaguaaauauuaauugauuaagguguuuauaauuugccuuuugaagucagaaaucaaggaaaauauuucaagaauauuuuuccaaaguugacauacuuuagucaucaauucacagaagagaucugagagguaaagucuuggcaaagccuaccuaacgccuuuaacaacagcugcuuuuguguuucuuucucacauuggcacaccuguuaagccacucagccccugucuguuugggaaaccaacagacugauccagccuggggaaagacaaaaucucauccguaugcuuacaaguggccauuuaguaaaaugugaaaguaaauugccucaguuuuguuugcugaauuugacauggaucagugacaauuucuaacacugagcgguuucacagauauacuguuucaaauuuuuguuuuuaauacaccugauuucuuuuuuuuguuacuucuaauuuucacgauucagugauuugaaagaugaaaugaauaguaaugaagaugagagacaguuuuacuuaguuccuuugccaggugaaauuguuuggaaugcagaacgagugugugugcaaugaucuucacagauggaaaagaaaggguaauaagagaugaacuuuggccuucagccaaaagaccauaaacguugaaacaugcagaaccagucagaaugauugaagguuguuuuggugguuaaccggguugcgguuuuacucugugguuugucuuuagcacgggauaguaaauuacaaauuuuugaacacugccuguuugcugucuguuuuugagaaauuauaacugauaauagacaauacaaaagcaugaccuugcuaugcuucaguggaaaucacccaaacaaaaccuaucccauuuuuuuuuccuauuucuagagagaugcucagagaagacaaggaaagaaaaguacacaaaccauugucacauuaaauuuuauuuuauuuaaucaagaggaaaucauagaauacuggucuuaugaggauucuacuuuacaauuagccauacauucauaagagagaguuuucauggauaucuuuaaaaggacuucacagauaaauagaaaaucaaauagcaauacauuuuccaauacuauuugucagaaacaccuguuguacuauauuagacucauuauucauguucaauuuauuuuaaaaagguaacauguagggagaucaauuauuuacuguauucacaagcauggaugauaauuggcauuuuucuguuuccaaaaaugaaguacaccuuagaauggaaaauauauucauuauggaugauuuuugaaagaauauauuuguagacaaagcaaaacaaggcaugauuucaggcacugacaguaauauugaaaauaaagauauauuuuucuuucuuuuuuuuuuuuuuuuuuuuugagacagagucucacucugucuccaaggcuggagugcaguggugccaucgcgacucacugcaaccucugucucccgaguucaagugauugucuugccucagccuucugaguagcugggacuacaggugugcaccaccauaccuggcuaauuuuuuguauuuuuaguagagacaggguuuugccauguugguugggcuggucuugaacuccugaccucaggugauccaccugccucagccucccaaagugcugggauuacagauaucuuuaaaaaaugugacauauucagagaauuauguucauuucacguauugugacuuauaacuugaauauacuuaguauaaacuaggcuuauaaauuuauaauuauauaaucuauaaguuaacaugcuauguugagagauaucauuacagauuucucaugaacuugccuauuagguaaaagggauuuauuuuuucuaagagauuauagcagaguauuuaauuuuauaaaagauccacuuaauuuuccaauuaaaauauccauaaaugcauuuuggauuuucaucuaagcugcuaauaauaugaucucauaacaaaugccuaaaacuuacuucagaacucaugaaaaaugacuuguaauugaaacugcuucaaaaguacaaaaaaucccuaaaauaacuguuucuauaacaagccaaagacauuauuucuuauaacuucauaccacaaucauuucauucaggaaagugauguauuaaacaaauacaacauaaacauuaaauuaugcaaccaaaucacuauaugggacuaaauucagcaacugcuacaaccacaaauuaugcagccccaaguauuuuuugacuauuucuguauauuacagauacaaauaauauuauucuuaaucuuuaauauuuaugucauuuugucuaacugcaauugcuuucaugugaauugucucauuuauuucugggaagccaagcuauuagucuacuugucuuucaauagaaaggcacauucuagggugaguaacaagugcuaccaacaccacacaacucaauauaaugaugcagacuagggaaaccacacacauucaucaguguaaacacaggugaccuacgcauaccaggccaucuaucugcuuggagccgcuguccugcugagacuggcccagcucccugacaguaaaucuuuacgccauuauuuuauccucuguggcugaccagacaucucaugcugugaggagccaaauguuuaugugcaaggacaucguguccaucauuguuauuagaguucuacccccaugcauucgcaagcaacauuaaagaccaaauggguaagaaaaagagcuucuccugggccucagcuuuacaaaccaagcccaguuucuauggaauauguaaaggauuuuuuuuuaauauacaaagaacuguucugggauuauaauuucuuacccaacagucaguggaaaagcaacaaacuuacaagagggcaguaauaaagcacuaaagaguccaaggaaaugauuucuacuucugccacuaaccaguuaugugauccuagcaaauaccuuaccuugcuucuuccuucucuucuucuguuucuuucccuuuuaaugagagauuuccuuucagccaaaaauguauuuaaggacuaaaugaucuacaaugccccacccauguuucuauaaauuaacuuccaagauaacauccaauacuuccuaagaugauuuucccaagucaugaugauacaaggguacugaagaaaacuuugaaauuguuuugaauuggaacauuuuuccuagucauugaccaucauauuagcauucaacuauggacuaucaggucuaauuuuaaaaauguaacauuccuuuuccaaaagacacuuugggauuuaguguacuuuucaaagaguaguuuacauguauugguaagagucaauacaaauguucuauuguuauuaaacauagagacauucucuguagauugaaaauuuauacacagucuagccgagaagcuccaugaaggcagugaccaugaaugucuuguucgcuauuauauuuuggggugccuaaaauuugacacaccgcaaaggcccuauaaacauugauaauaaaaauuaaacuacaaugacuaucaguaaaggugcagaguuaagaaccaaagagauagcucuguggaaucauuagcucaucuggaaucaggagcuggcaacacugaagaaugacuacuuucucugugacucgaggaguuaaggaaacuuuaaaauggaccaaaauagaagcagacucuuuagugagaaagaaaagaacgugagcuggcaaccucucaauuuucaucauuuuuuucaucuguaaucaccugaacagaauuucuagcuuuauaagucacaguaugccuuguaauaaagcaaguuacauuguauuuaaaacagaggcugugaauacuaagcccugcugacuaaaaaggaaaggcuuuuucaaccauauugguuccagaaagacuccacagucucuggauggaagcaagauagugacaacauaaggaaguuauccagccuucuucacgacaacgaagucuucaaagcugaugaaauacaguugccuucuuuuuccucccaaccacaaaauuauaaugucaaaucaaaauagacugaaaugauccagucucuuuacuuuauuguaauucuacacuuugauuucugucaugaucuauuuggucugaaaauucaaauucccauuucuacuacuucuugaaguucaaaguuauuuuuaaugacuugucuuacugugaaauaagucuauaauauucuauuucucuuccuuuaagaauacaucagucauuaauaauaacccaaauuggaaacacaucuccagaaguaaaaagauuguuaaaggggucaugacaguaaaauuuuucagugaagucaaaugucuugaaauccuacuuacuaaucauaccugucaaaaaucucuuguucaaaguuucagaggaauuuacacauuaagcaauucugaaagcaguuugguaaugugcccacaucgcaaauaaauaaugaaaacagaaguagcccacagugagauaaucagagaaccaacagucguaggucuauuucccaaaagccccauguccuugauaaauucauugugucauucagaaaauguuccucuuugaaguaacuuuauauuacaguaggaaggcauuaccaguuugccauuuucuuguguuaaaauuaacacaaguaauuaacacuaauaaaugcaaguggcuuuaaaaugggguuaauuuuuuaauaacugaauuuaacuuuuuucuuuucuguccuuguuuuggaagcauuuugggaauuuccuuuugcauuguuguucaauuuaucguuauuucuaauuguuauacuuuuucaccuuuaaaguauccuucuucacauacuuuauuucuauugcucuucccaccauuuaugcuuuuuaaaauauuuuauuaggauagccagccuaucauaauauaagcccauccauugugugcacguggucugagucuguuacuugaaaagguuuuuacuuagugaugacaaaagauacuuuacugugacagacaaugguuuugcaugaaaacccacauacaaauuucagaauaauauauagcauuggugacacacuaucucaaccuugcaauuuaugcccagaugaauuaguucauugguuuuuguagccagugucuaaggaagggagugacagcaauaagagaauaucauaauguuguuuccacucaggaacugccuuauucuuaucuugguguacuauacagauaacaguuucuaucucauaauauaaacaacacuaagaagaacuucauaaaaugugaaauuucugaguuguuaguaauucaauguucaacauuguaagacaagagcaaguuuuuuccccacauguccauaccaguuuauacuaucaauaacaaaguacguaaguuccuauuauugcguaucaucacaacccuuggucagucuuguuaugugaaauagcauuuauacauuuuaguuagguuguccuaauuacuaacaagguugagugacccuucauauguuacaggcuauucuuguuuccaaccuguuaaggguuuguuuauuaugauccuauguuuuuccuccuugagucaaaagaguuguuuaugaauucugcauaacaacacacacauuucuugugcuuucugguauucuaaaauacugucuguccacuaagcugcucuaaaaaaauacgcaauuuuucaguuuuucacuuacuacccacucugucaugagcucagagaaugaguuaagaggguuuagaauucucccugauuuccugugaucucaguuauguauuagagugugauagucuguuuuauggagaaucuaguuguucuuuaaaaaaaaaaaaauucacuauguugcccaggcuggagugcagucacuauccaccagcgugaucauaucucacugcagcuuugaacuccugggcucaagcaauucucacaccucagccuccugaauaguugcgauacaggugccuaccaguccaucuggcuguuuucuaaugaaaggaaucuucagaguaacuuaucuccuauacuuuguaaagcuacaauucuguauaucugauuauuagcacuauaucauuuuauuuuuccauuuaauucagauguaugacuuacaauguacucuuuccauuauaucgagggggugaaauaaucagauuuuauauauuucuuuauuauacuuuaaguucuaggauacaugugcagaaccuguagguuuguuacauagguauacaacugcguggugguuugcugcacccaucaacucgucaucuacauuagguauuucuccuaaugcuauuccuccuagccccccaccccgcaacaggccccagugugugaugucccccucccuguguccauguguucucauuguucaacucccacuuauaagugagaacaugugguguuugguuuucuguucuuguauuaguuugcugagaaugaugcuuuccagcuucacccgugucccugcaaaggacaugaacucauauuuuuuauggcuguauaguauuccauaggguauauaugccacauuuucuuuauccagucuaucauugauaggaauuuggguugguccaagucuuugcuauugugaauagugcugcaauaaacauauguguacaugugucuuuauaguagaaugauuuauaauccuuuggguauauacccaguaaugggauugcugggucaaaugguauuucugguucuagauccuugaggaaucaccacacugucuuccacaaugguguaagacaaauuacacucccaccaacaaugguguaacuaaauaacacucccaccagcaguguaaaaguguuccuauuucuccacauccucuccagcaucuuuuguuuccugacauuuugaugaucaccauucuaacuggcaugagaugguaccccacugugguuuugauuugcauuucucuaaugaccacugauggugacuuuuuuuucauauguuuauuggccgcauaaacgucuucuuuugagaagugucuuuucagauucuguauauuucucuuuaagauguuuaagacuaugguuugggaaauaaauaggaauaucccaagaaauaggaagagaaaaagccuguuggaauauuacuauaauagcccagaauaaagauuauggaaauuuagacuaaaauaacaucacuaaaaauggagagaaaugagcagaauuaaaggacccauuuccuauugagaaagauguaaauuuuugaaaauguuuuaaaugagucuauuuaauaagaugguuauucauacacaauauucagaauaauuuccaguuuccuccauuuauuuuggaauugccacugaggggaaaaaucacaaaaauuuaaaaacagcagugaaaaacucauguuuucauuucacugaaguuugaaauaaugacaauauguagcuauaugaaauuaauccucuagcauuuaucaugaacuuacaucaugucacauguaucauaaguucuacuacuuuacacauucaucacacccaguaaaaagaaaauauaucaagauauacugcagaagcuguucauuaccauuuuaauagagauugcuguugaucaauaaaacuugguucuauuauugcuccagguauucagcuaaauuuaucagcuagaagacagaucagcagcacaauaucuugaaaauagcagucauucaauauauauuuauuaaguuguauauaaaucccuuucaaguuacaaaugauuaucuaaaaccauagaauauucaucuaccaaauuuucauuuggcaauguaaagaggcaauguuuccuuaagaaauccacuuuggucuucauuuucaguuuacuuuuugguuuauccuagugacauucugaauugcuuuuuaaaauuuuuuucugucuucuucugucuacuacaaagcaagagcgguauuucccaucaucuguccgccaacaauuagauuuaauaugauuaaauugggaauuauccuaugaaguaugguaaucagccacuucucuccucuguugauuugagucauuccuauucuucuauuuccauuuuaauaauaauuuuaucauuucacauuaauuugcuuccaauaaauuaaauuaaaugcaucaaagggccucaaagcaaauuaucuuuuugcuaugucaggucuuaaagauccaaaauaugauuguguuuuuuguucuguagguuauaaauaugcauuacacauuggggaaaaacacuuuaaaauuaauuuuucauugcuuacaaaauaucugagaauuucaucuaggcccagagaaguuuuaacauaaaucuauuuggucucuuagacucaaaaucuucauacauuuauaagauaagaaaauauuaguuuuuuaaaaaacauuuaaagaaguauugcauaauaaaaaauuuucacagcauaaaaaucugguuuguagacuuuuugcuuugcagguaaaaaguuuuucuaauuaaaaaugaccccaagcuaugggcuuuauuauuuuuuuccugauuauaacuacaaagagaaaagucauuuccuuauaaaguuugaaaacguucacuucuuucccauggggaaaauauucauguuuucucacccccuauaugcuuggaaaauagaaauguaaaggcauaaaguuuguuccaaaggaucacuugaaaauaacuuauuuaaaacacaacaucuaccuuauaaaagguauuaaggguuacauuuaagucccugaaguggucuguguacccaugaaguagagaaauacaaaagcauuuuaugagagagguuuguccaaccugugauacggaagccucauuuucaugugcaguccuggcuccaggucaggugaggaaaugacuauagccagauccagggucugaugggauaagaauugugguacauugggugaugaguuggaaagguugggagcugaggcugaagagucaaagcugcacuuaagucuccauaaauucauggaacugcuaauguaacuguggcauguaaauauaaaacauguucuuuauacacgggaacccuucuuaggaugacuauagauuaguagaguaaaagauuucuuuuaaaaaucucuaaucaaaagaauagguaaagagauaugaaagcugacaggagagaaugauugcuucuaacuguugggaucaagaaggucaaaacggaguuugagccuuggauuuccugugcugcacuguuuaucaaguaagaccuuauguuuuucuuuucgcagccaccaugcugaaccagucugccaacacuuguugcuucccagugauuucucuuuaucacugcucaugaggaauaaggcagaauuuuaaaccuuuuuaaauacauuuuguuccaagauuaaacaauuaauguuuuauaagauuuuuaauggccuaguaacaaccaagaaacaaacaagagaaguuugaauauuauauuauguuuucaguuauuuguuuuuuuaacauaaucccucagacaagguucuuauaaagauacugaacuuuucuuucuuucaguguacaucauggacuaauauaagauuauuuuuuucuucuccuucuuaacagaaggauaucaugcucagauuuucuggccauucuuuaaaggaaauggggugaggaaaggagcucgagauaaaguccagaauggagcccuaaagguugcugucaaacagcgagggagccaauuuggacugagaugcuguagcauugcuggauuccuccuucucuggagguagaaacagcuccugggauuuaccugccucuuguuaucccuucacccauuggcacuacagacucugcccucagucaagccuccgaugagacaagggcauagggcauauggccgggagucccuguccucuugugaccauugauauugugcccugccucagagccuuuuugguugaagaaucauugcccauuguuucucuccaggguguucuaggauuuucuuuauaauuuguccugugucaaacuggcuuggauuccauuuaauuuuugcucuuuuuccccauucaccagcacuguuucacuaggcgacucuugucuugacaccuucuuucuggcacacuggcugcaggucacagaagaccagcuucucuugcaugugauuaucaugaacagguuaaauaucuuuguagaacugaugacucaagacuccaccauaaaauuagauacuggccaggcaagucuauuuaguguggauaacaagaaugguuuuaaucagaaacugaaacauuauuuaugccagaaaauuugagaauauguccaccaacagaggaacuuccggaaauguacuuaaggaugaauuagcuuccucaauuauaauuuuaaaauacacauauuuaacuacuguguguauauauacuuuuaccuauaauguauauuuauguuauguaauuuacagcuuauauguuauacauuacuguuacuauauauuauacuacuuauacagauuuauuuauaccugaacccucugaaaauuuuaauguaaauaauuaaaaauaauggcuuguucuaauuuauauacacauaaauacacaugugcacgugcacacacacacaaacuagugagcauucacauauauuucacaaagcuaugguauuuaagcacagaaacagacaaugaacauguucaagcucccuucucgaacauguucaugaacuacauuaugugauuuucuaaaaggaggauuuuucuaagcuucauuuugccaggcuuuuaagcagauauguuuucacuuuuacaagaaugggugagacuuacuuaaccauggcaaagcacuuguaaagugugaauacaagacuauaaaucauuaaugugaauuuaauguuggaaaccuuuucacuagaaguuuuaacauaguaauucgucaccuguaacagugacauaugugacuuuucccauagcuuaauaugaaauuucagacaguaucuuuagauaaaauauaguucagagagcucacaggaaaaaagaaauugcucauuuugaaguauauuaccaacacuauugaagacagacagaucuggaagucagugcagcuugaguuccccacccuaaccacaaacacccacauaaacauauacaaauucacacacauacacacacacacacacuggguagcuuaguugagaccugacuccacagaucugacuuaagaacauauaacucuguggauacacuaaaagccauugaauuucacaguuucaaugggucaccuauaugguaugugaauaaauauaucucagucaagcuguuaaaaagaauacaguuaugcagucauuagaugccaagugccccucacccccaucuccaacaagauaccuccucacuuccucaaaaaguuuuuguuguuucauacccacagggauguucccugaucucauuuuucguagauacauauuauagaacaugacgggauagaaacccuucuccacuggcacuguggccaggggguaugcagacccucuaagccugacauagaaugagggaugagaaucgagguuauuauauguaaucuacuaguuauuuaaguucccuccagcccccaugcaaugaucuugcuucuaucugcacuaccuaugacuaguguuauaacucugugccucuuucgaauggcaaccauagccaugauuuuuuucuugugauacacacauucauucauuauucauucagggaauuguaaaugagauagaagagcaaauaagacagacaccuguccugaucuuuggggcuuacauuaucaaaguacauaucagugcauccuucaagcccugcuuuuagaaguacuugccuauuuuaauaaaugauuuuuuugaauuucuuuuuaaaaaaauuucugcucuaaaauucucuuuuuugguugugucucugcccggcuuugguaucaggaugaugcuggccucauaaaaugacugagggaggauucccucuuuuucuacugacuggaauaguuucagaaggaaugguaccaguuccuccuuguaccucugguagaauucggcugugaauccaucugguccuggacucguuuugguugguaagcuacugauuauugccacaauuucagagccuguucuuggucuauucagagagucaacuucuuccugguuuagucuugggaggguguaugugucgaggaauuuauccauuucuucuagauuuucuaguuuauuuguguagagguguuuguaguauucucugaugguaguuuguauuucugugggaucgguggugauaucuccuuuaucauuuuuuauugcgucuauuugcgaauuuuagaccaauauccuugaugaauauugaugcaaaaauccucaauaaaauacuggcaaaccgaauccagcagcacaucaaaaaccuuauccaccaugaucaagagggcuucaucccugggaugcaaggcugguucaacauacgcaaaucaauaaauguaauccagcauauaaacagaaccaaagacaaaaaccacaugauuaucucaauagaugcagaacaggccuuugacaaaauucaacaacccuucaugcuaaaaacucuccauaaauuagguauugaugggacauaucucaaaauaauaagagcugucuaugacaaacccacagccaauaucauacugaaugggcaaaaacuggaagcauucccuuugaaaacgggcacaagacagggaugcccucucucaccacuccuauucaacauaguguucuggccagggcaauuaggcaggagaaggaaauaaaggguauucaauuaggaaaagaggaagucgaauugucccuguuugcagacgacaugauuguauaucuagaaaaccccauuguuucagcccaaaaucuccuuaaacugauaagcaacuucagcaaagucucaggauacaaaaucaaucuacaaaaaucacaagcuuucuuauacaccaauaacagaccaacagagagcuaaaucaugagugaacucccauucacaauugcuucaaagagaauaaaauaccuaggaauccaacuuacaagagacgugaaggaccucuucaaggagaacuacaaaccacugcucaaggaaauaaaagaggauacaaacaaauggaagaacauuccauacucauggguaggaagaaucaauaucaugaaaauggccauacugcccaagguaauuuauagauucaaugccauccccaucaagcuaccaaugacuuucuucacagaauuggaaaaaacuauuuuaaaguucauauggaaccaaaaaaagagccugcaucgccaagucaacccuaagccaaaagaacaaagcuggaggcaucacgcuaccugacuucaaacuauacuacaaggcuacaguaaccaaaacagcaugguacugguaccaaaacagagauauagaucaauggaacagaacacagcccucagaaauaacgcugcauaucuacaacuaucugaucuuugacaaaccugagaaaaacaaacaauggggaaaggauucccuauuuaauaaauggugcugggaaaacuggcuagccauauguagaaagcugaaacuggaucccuuccuuacaccuuauacaaaaauuaauucaagauggauucaagacuuaaacguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucccaaccuacucaucugacaaagggcuaauauccagaaucuacaaugaacucaaacaaauuuacaagaaaaaaacaaaaaaccccaucaaaaagugggcaaaggacaugaacagacacuucucaaaagaagacauuuaugcagccaaaaaacacaugaaacaaugcucuucaucacuggccaucagagaaaugcaaaucaaaaccacaacgagauaccaucucacaccaguuagaauggcaaucauuaaaaagucaggaaacaacaggugcuggagaggauguggagaaauaggaacacuuuuacacuguuggugggacugcaaacuaguucaaccauuguggaagucaguguggcaauuccucagagaucuagaacuagaaauaccauuugacccagccaucccauuacuggguauauacccaaaggacuauaaaucaugcuguuauaaagacacaugcacacguauguuuauugcggcacuauucacaauagcaaagacuuggaaccaacccaaauguccaacaaugauagacuggaugaagaaaauguggcacguauacaccauggaauaccaugcagccauaagaaaugaugaguucauguccuuuguagggacauggaugaaauuggaaaucaucauucucaguaaacuaucgcaagaacaaaaaaccaaacacugcauauucucacucauaggugggaauugaagaaugagaacacauggacacaggaaggggaacaucacacucuguggacuguugugggguggggggaggggggagggauagcuuuaggagauauaccuaaugcuaaaugaugaguuaaugggugcagugcaccagcauggcacauguauacauauguaacuaaccugcacauugugcacauguacccuaaaacuuaaaguauaauaauaaaauuaaaaaauaaaaauaaaaaauaaaaaaauaaaaaaccaaaacaaaacaaaacaaaauuugucuuuuaaauaaguuaugauaagcuuuuuucuuuaaaaaacaguaaguauagcuucaccaaccuaaaaguucucuucaauuauacauaauuuaaggucauauauuuuguuucauguucuuuucuugaauguucucauuuacaaacuagugcuaauuuuaaaacuuuuuuuaaucugacucacaaagccugaagaacaauuuuugucuucacaauuacugugccaaguuugcaaauaauaacaacaaacccacaaaauauuagguuuuaauaugcucacugauagacauauauucaucuguucugaaucucuaugauaguuguaaaacuguaauucucucugcagugacaaaaaugucaggaaaaacauuuuuuucucucuccuccgaaacaccugcaugaaacucuuaaguagagaucaaagggaauacaaucuaucagaaugucaugauacugggccacugucacaccagcaccugccuuccauuaccccacauaaccagagauuaaagaguagaaagagcuaaagauugaagcugagagaaauaaucauagaaacagaaaaauaaauuagaagcaaagaaauccaaagaggaaaaagaacugaaacagaauuaacuguccagcuacuucuuauaaaauauggccuacauuauaauuaacauaaaauauguucuucucuuauaaauuauuagaaaccugcccaaguauuugauuuucugcuucuggaagaaguucgucucuuuuuaauuuauuuauguauuuuuauuuauuuuuuugagacggagucucgcucuguuccucaggcuggagugcaguggugcgaucucggcucacugcaagcuccgccucuggguucacgccauucuccugccucagccucccaaguagcugggacuacaggcccccgccaccaugccuggcuaauuuuuuuguauuuuuaguaaagacgggguuucacaguguuagccaggauggccucgaucuccugaccuugugauccgcccaccucagccucccaaagugcugggauuauaggcacgagccaccgugccuggacaaguuugucucuuuucaauugcaaacuauuggaaggcugcuauaccuuauuucuuguuaggcuuuuacuuauucacauuuuaggcauuuucucccuaacaagcauuaauagauagacccuguucgcagauguugucuuccuuacauuuguuuauuauucuuuccacauuaccucuaacagugagauuuguuuccuuuuccuuucuccaagucuauuuauuauuuuccuuugcagaaaaucaacaucaauucauccuucaaacacuggaguuuaaaauuuucgcagucaagaugcuuuauauuaaagaagagaaaaaugcaccaaacaagagcacauuagugcaacugcauggauacugacucuuuuacaggaagcaauuacaguaggugcuacggauaaccuucgccaaaaaggaagcccaauaguaaaauccucuuucaaucaaaucgaagucuccaaauaaacacaauaauucucauuaaacuaauuugcuaaauuucccuccucauguacauuuugccacuccacuuagagagcauacucuacacauugcaaggaaaaaggagaauugacauaucuuuaaugaggcaucaggcuaauucaccaaagaugaccuucuagcccuaaggagaucuucagacaauugaucuccagugugcacauuaucaaacaacagugcaaauuagaaccagccaccaaagacauucacucucuaaaugauuuccugacauuugagaacauuagagaagaaacguaucuuuccuuugggauucacaucagcguucaguauaauuccuuuguaaacuccagaaagaaauauuccaaaagaagaaaauaauaaaacaaggccauaaacauaaaagguggcauacauuuuucacauaaaaauguuuugcuaagauauuucaugagaagcuaaggcuuuuauagcuuucuuguuucuucuccugauaauccccagaauuagaacagguagguagaguacacaggcaggcacccugccguggaacuuaaggaggaccaggaagacuuccuuauacucugaccccaucuuuaaaaaugcacauccucaauggugaagcuucaaaagcuacuaagucuugggugccguuggcuauuucauaauaguuacuagaacaggccaugcagucagacugccuucccucuucuucggacucugccacuucuuagcugugauguggacaaagacuuuuaaccuuuauaaguuucaguguccuugucuacuaaaacugugauaauaauugaccuaugucuuugauagauucugauuauuauaugagauaauaccuguaaguguugaccacagugccuggcacauggacaauucucagcaauugcuaacuacugucauuuuuacuucugaauacucagaucaacuccacucccuggaggagggguugggaaaugugagaucacaaggcuccuguucagaggguaauaaauccuuaguaaauguaucauaguaaaugguagugagagguaagaaaauauauuuuacacucaagcaaguuuuauuuaaccuucugaaguacgguuuccucccccauaaaaugggaauaaucagagaaucuaucuuacaugauacuuguggggauuccaugagaugagauaaugcuuguaaaaugguuagaaugcauaggauguggcaugggguguguguuccuugaaaguuauugguuaucagguguuuucuuuauaguagagaacgaugucacaucaugcuuuuuccgguaaugugcuucagcuuuuaaaguagugaacagaacuuuuacaaguaaaaauagcaugaauuuuaaaagcugcauacaaaauaaauugguauguuagccuuuuagucucaaauauauaauauucauauaguugcuaucagauggaaucacauaauuggcaccugaggcauacagccuacgcugccuaaugauguuucagucaacuaugcuucacauaugcaauggugguuucauaagauaauccuaccauauuuuuacuguaccuuuucuauuuuagauaaguuuugacacacaaauacuuaccauaguguuacaauugccuacagcauuaguacagcuguauguuauauagguuuguagccuuggaaccauagguuauaccauacagccuuagguguauaguaggauccgccaucuagguuuuggaauuacacucugugauuuuuguacaaugacaaaaucaccuagaaucacauuucucacaacauucccaucguuaagaaacaccuggccgggcgcgguggcucaagccuguaaucccaacacuuugggaggccgaggcggguggaucacgaggucaggagaucaagaccauccuggcuaacacggugaaaccccgucucuacuaaaaauacaaaaaaauuagccaggugugguggcgggugccuguagucccagcuacucgggaggcugaggcaggagaauggcgugaacccgggaggaggaacuugcagugagccgaaaucgaaccacuguacuccagccugggcaacagagugagacuccaucucaaagaaaaaaaaaaaaaaaaaaaaaagaaacaccugacuguauuaaacuguuuuaauaauauugucugauccaugaagaucugcauauuuuaauaugcuaccaaaugagauauccagugauacuugccccagccaaaauaaaguauguguauaagagcugccuucauaucccgccuacuuuguccaacaaacuggaggucauuugucagagccucaaggaacugaacacugcagggauacagggauuucuccuaaugcuuaauaauuuaagucacugucaguucauuguuuuggaugugauaucauuagggaauagucauaagcgccccuuuaguucagucaguuucucuuaaccuggcuauacgcuuacagacagaaauagaacaacauucaauaaaagcaaccaacagguuugauuuaucacuagaacugauuugaauugucauagaaccugccuacacagcauggguuacugcaacaggugcacauaugacuagauacaagguccuuauagacacacuaugugaucacaugguuauggacaauauauauggauguuauauagaauaauacaaauuuguacaaaucaaauaacauauauguugguuuuuguuccuuuaaaaaaucaagaauaagguaaacaugauuaauacugauuuuaaaauuaaacugguaucuuauuuuuucccauaucuuaguauuuugccauuucaaauccaauagccuuucuaaaccagucugaguuacauuuaugugggguuuaggaaucaauuccuacucugcauaguucagaggcacucuguacaugcacauuacacaccaguguguguucaacuucaaaacugguccugucccugagaaaauacacauuagaaaggaucaaaucaaagagcauuugcuaauagugauuauauaacucaaucaauaucgagcaagagugauacgucugaacuacugagaaaauuguggugaaacguagaaaagcacauaacuauugaagugaacuaggugguggcuucagagcuuccuguugaaaaagaaauagaaaauaaaauccuaguaaaaauuaaggaagaaugaaaaaagcaaagcaagugacacaaggaacuuggcuaugcauguuauguuaagagauaucuugucaaucaauguauaaaaugcaaacuuaagacuuccuuuguuuaauuaaaacuuuaguuuucauguguaauauguauugaaaaaugugaaauuaaaaacuaugccuuuguguuucugcaacuucacuauuuuacaaggugucccaauaaauguaucagagaaucuauggucauaaagucuuacgaugcuacugcaagaauuuaugaagcauuccucugaucauuuaaaguaagccacucagcaaaauuucaauauuugguuuucagaaauaaaccacuauuucucucaagguuuuuauuuaauuaaauuuguugcugacauuauugcccaaauugugaauaccauauuagauuugcgaaguuuagagauacgcaauuuauaugcguguguccaaugacacugugauuguacauuucucucuauguaugccucuggcaaugacuguagggucaauuucaguuuuauauauguuuggaauacaguugaaaagcaagguuaugaggggauuuuggaaucacagcuuagacuuggcaaagagacgccuaacauuuucuauacaaacaaaugaaaugccagagcagggucucaaugucagagcuuuugaagaaaaucugguuuggcucaaccagagugaucuguguguauuaagacgauuugaccuagaaacgaaaugcucucuacaaauaaucagugaagcugaagggaaauuaaaaugauuuuagugguugaccuucucaguugcauacuggacaauuaugagaagguaauuaguaucugagcauagguuguaaaauaaugaccauugcuaguacaaaguugcuaaguaauuucagauuucuuuaguuauuuaaacacagaauuauaagaggcaaaaauuggaaaagauauugaaaaaaucauagcccauuucggcaauuuuuuuagauaaggagaaacugggcuuuuuuucuaguaacaccuccugaauuucauauguguguguauguuuaucugaaucuucagaguaauaauauaaugccuuuuaaaaauucguaaguuaaaauauaacuuacaugccauaaaauucacugugauuagcauacaguuccauaaguuuugacaaaugcauauguuugguaaucaccagcacauucaagauaaagcacaaucccaucaccccccgccccccugcccugcccagaauuccugugggcaccgcuguaguccaccucuccccuacuuuuguguccuggaauucacugaucuguuuuccgucucuguagcuuugccuuuaugacccacauuuuaauaacaggaaaaaugcaccugucuguuguucaagauguuuggugaaaacagucucauaauguacuguuuaauacuauaaggcaguuugcuaaagugagcaagcaauacuuuaggcggcuccauucacuugccacuggaacagucccuccuuuuuccugccccauuuauugacuccuggcuagagacaggcauuucggugcucuuagcagaguaauuugaaaccccuucaaacugauacucuaaauauuuucucaacuguuuuuuuuuuuagagaugaguccuggcaccuggaugagaacaaaggcagaaaaggaggacuccggaaggcagcacucccugcuucuuauaucauccacuucaccaaacaaacacagcaauuacuaacaauuccuggagcauacgggcuuugcugugaguggaacagacaaaagccucuuacagucuaccccaugcagcuuaaccaagagguccuuguaauacacccaguauucucuuuuaagaagaauucugaugaauacaauuuucuucuuugcuuuacacuuucagagauguuuuaugguuuagugucugaggcgauugacuaccccaccuccucuucucuacgaugugucaucgcuguaccucaccuaagaauguccacacaaagccaugacagccccugacacuucaggaguuucaugcucuccuguuacuagcauagcauccugaggccacuggcugguuguaagagaaaagugucacucacugcugguuacuaaggcagacagguaggaagagagcugcuguguuucuuagagccaauauggaaucuuccauuaaguuuucacauagaaacaaaguuuaaauaaugauuagauuuuuauacacuacuaguauagcacauccagguauuuuucauuccuuucuuccuucaucuaaucuuuauuuugugugugcuauguuugaggccuugugcuuauuccuggacgcacauuuucuuugcccucagagggucuugguggagugagauuaaaucucugauuuccuaccauucuuugcaaaguaauuucuuacagaaaauacaugacuaguuuaaguuccuaacaguagcuuuaccaguaaacuuugguaauccaaagcuguuuaucaacuuggaauugcuugcauauuagaaacacacaacuguacucuauuaauuauuaaagucucauuccuguuaaauuuaagugccauugguuuaauuggaaugagugacaaaaaacauugcagucccugaguuugcgauuuuaagaaauuauuuuuuucuugacacauauaagugccacugaagauuuuacaaaaaguaacaaaacccagagauuagacucaucuuguuugcuuauucuuuccuugcaaauuggaaaaggaagcuugucaucaacacugcaugacugguugcauuuuaauauucagugucuaaugacuggcaugugauaacucucucauuaacauauucaugaauaaucagauuaaaugucacaucuccaaagaaagaucaucugaucagggguaaaaucaguuaauuucuuuauuuguuuauagagcacuacuaaagugggagcaaucaauauaaaaaaaaucucucuauugauguuugaauuacauauaaauuacgugguaccuugcacuuggaaugauggagagaaaucagaaaacauuauuuccuccauuuuuaagaaaaaugaaugagaucaguuuucauuaauguucuaauuauucuuuccaacaauauguuacuucuguauugauugucagcucucuucugacugaggauucggcacagggaaguaugguuuucagaaauauuuugaaguaaaauacucuagauaaucaaguacuuuguuacaaaagaauagccacacuguaaucucauagugaacagcugauuucauugacagucuuuguacauaauuggcaaauguguaccaguguguaccagaaaauaacugaaauuuaaacgaugugguugggugguguggagcuaguguuggggucuugaaaaaaggcaccucagccucuuuccaggguagcuagcagggcucauagauuggcccauaggguacucuuccuacuggaucaaucacauuguaggcugccugccagauggcagcaaagggagaaauggaagaaaugucuaucgucucuuuuuaagaugacuccaaaaguacaccuacugacuuccugcaacuuagacguuucuguuuuuuuuuuuuuuuuuuuuuuuucucuagaugcagucucgcucuguugcccaggcuggagugcaguggcacgaucuaagcucacugcagacuccgucucccggguucacgccauucuccugccucagccucccgagguagcugggacuacaggcgcccaccaucaugcccggcuaguuuuuuguauuuuuaguggagacgcuaugguaccauccuuauaucuauuuuuuaacucaauauuuuauauucauuuuucccuaaagauuauagguaccaaaauucacaugcuguucagauaacggcagcauuuguucaugcaauuuauuaugaaaugaugucauggccuguuauggagcuugugauuaacuucacacuaacaucaaagccauaugguauccuauccauuuacagaacaaagcuaucuccuuaaugucauuuacuguagguuaauuuaugauuugccagaaaugcuguagaaugguaccucuuuccagauauagaauuuuuuaggaaauaaaaaugaguaaccccaguuaaauggaauaauggugaaaauuaauacaugguggggcaagccucuagggcaaaagguuucugacucccaaacuucuuauuuuaauuagaauuguggaaguauuugguagaucuugaauuuagaaauccaucuagucugaaaaguauaaucuacgggguguacauacaucaauauucccaggaucggaugccuccagcugggaaaggaaguauguucauauuguuaaaccagaggcaaacugcuuacuaaaaaagggacaaagaaaaaaguagacaguucucuuuuauuucagaaaguugcuuuuuuaaugacauugauuguggagagcauucauucucucaauucaguaauucuuccgauauuuuguauuuuuuuuuuugcuuaccaauuuucuuuuguguauagucuuucaagcgaccacaucauuuacaaauuagcucagccaaauugcuaauucauggaagcaauaaaucuuuuacuauaaauucaggaucuuuauaaauucuaaugugauuuuugaugaguauucauagauuauaauuuuaaauuccuuaugacuacaugauuguuuauaaauuuauauucuuaaauuauauuuaaaaaguuuauguccucuacaaauauaggcuaauauuuuuuauaaucuuugauauuucagaucaaaagguuuuggauuguaaauguuacucuacguuaugguuaagaacuuaucuuuuucauuuuuuuguucagaaaauguugauuuuugaauaauuaacuugaaaauauucauuggauauucauaguguauuagaucucaauagucuguauauuaaaaucccaucuuuugaacacauggccaauguuacuuaagucuaaaucgauuuuaaaaucugauauuuuaaaaucuuauuauuggaugccaguauauuugaggcauuuuauauuuaguacuaaaaauucauuugcuguccuauguugcucauauaguuuuaacaugaacauuuucuuacuguaaaauaacaaaaauauauucacaugaaaugaaaauuguaguuuuuuauaucaaauccuaaaaucccuggaauagcuuugggaauaggucaugggaauuuaccaaugaaaaauacaaucacuaagaauccacuaagguuuccugauucagucaaacccauuccuccucacacaaccaaacucucuaaauuuucauuugaugaaacuaaagcauacagacgcauagugacauguccaucaucacuccugugagaccaaagcccagacuaccuuguuugcagaauaugcucuugcuaauaaagucucuaacacauaguaauuacaucauaugaaugguuggaguaaaugauauacuuuuaaucaauuuuuaucuuaaaaaguaaauuuuaaaaagugauuucugagccuuugagcaggcacugaagaaaguuacauuaguaagauuuugaacauuuguauuugggagaacaacaacaaaagagaguauugacugacauuaaaacuuggagauugguaaagugaguuuguauguaagugagagauucuuaaaaaaauaccagccaguauguaguucacuguggaaauaauuuaagaauugguugaaaauuaaacagcagacucaguaugguccaauagcgugccauuuuaucacacauaaaauuugaucuuuucagaacucuugcuuuacgaaagaucuuugcaaccuagagaagacuaaccagaauucagaagagaccagaaaacuucucuuguaaagaacaagugaagaaccuggggucauuugucuuacugguauucaucaaauacucagaaggcucucacauggaagaggauguagauuuaccuugggacagaaccgaaagccuuggaguuucagggauguaaauuuuaguucaguguaggaggcaugcccauaauaacaggugcccagacaugaaaugggucccaaacaucuaugauucuggcagaauuuauuuuugaauauauuaauuucacccucuuuaaauuauuucaauguggucgauuucaauugaccauuucaaauauuuguuuuccuuucaaaugcagucgaaaaauucauauuuuaagaacacaguccuguuccauuggucuauauuucuguuuugguaccaguaccaugcuguauugguugcuguagccuuguaguguaguuugaagucagguagcaugaugccuccagcuuuguucuuuuugcuuaggauugucuuggguacaugggcucuuuuuuuguccauaugaaauuuaaaguaguuuuuuuucuaauucugugaaaaaagucaaugguagcuugaugggaauaacauugaaccuguaaauuacuuugggcaguauggccauuuucacaauauugauucuuccuaucuaugagcauggauuuuuuuuccauuuguuuguguucucucuuauuuccuugagcagugguuuguaauacuccuugaagaggucuuucacaucccuuuuaaguuguauuccuagguauuuuauucucuuuguagcaauugugaucacucaugauuuggcucucugcuugucuauuguugguacaugggaaugcuugugauuuuugcucaucaucacuggucauuagagaaaugaaaauuaauaccacagugagauacgaucucaugccagucagaauggcaauuauuaaaaagucaggaaaaaacagauguuguugaggcuguggagaaacaggaacgcuuuuaccauguuaguggggguguaaaucaguucaaccauuguggaagacaguguggugauuccucaaaaucuaaaaccagaaauaccauuuguuccagcaucauaacuggguauauacccaaaggauuauaaaucauucuacuauaaagacacaugcacacacauguuuaucacagcgcuauuugcaauagcaaagacuuggaaccaacccaaauucccaucaaugauagacuggauaaagaaaagguggcacauaugcaccauggaauacuaugcagccguaaaaaaggaugaguucauguccuuugcagggacauggaugaagcuggaagccaucauucucagaaaacuaacacaggaacagaaaaccaaacaccacauguucucacucauuagugggaguugaacaaugagaacacauggacacagguaggggaacaucauaugcuggggccugucuaggaaugaggggcuaggggagggagagcauuaggacaaauaccuaaugcacacagggcuuaaaaccuagaugacggguugauaggugcagcaaaccaccuagguaacaaagcugcacauucugcacauguaccccagaacuuaaaaaaaaaagaacaccauauucuaugcauuauauggucaaauuuauuuuauaaaauaaaauuucuuaacuauccaguguauaccccauccuaaaauaugaaggcuaaugcaauacaauauuuauuucucccuaaugaacucaucaucaccguauucccuauguuaacuauuauuugcaguuucugugugaaccagucucaaaacauaagccuccaguuucuucuuguuguuauuacucaugcacagugugccauaaaguuuugggauuuuccauguaacauauaaucugcaagaagaaaauuguuuuuuaaauauacggccuaguuuauaguucuaguaacuaguaauaaccuaacaaauauauauuugaugaugauuaucaggguuguuggaaauguuaaaucaucaaggaaaauuucauuuucaggaaaucauaugccauaauuccuugguauaaaauauucuguuauuuagaagauuuuauauaguggcaauaacaaauauuguugaaauuugacaccuagagaaacuauucaacugcucuguucuacauuuuuaaaaaaugauauauuuuugauaaaguuauagcauuuuuaauggauuuuaauaaaccuuauuuaaagaaaaguauuaacuuccugcacaaguuuuagaaggguuauuauuaaaaguagugacaaauauuaugacaaagacauuacauuucucaugccuacauuagcccguuucuaaauaguauguaauucuauguguguggcugaugaggagugagagggguaacugccaggggacagacuuguaggaggcagcccucugccaacuuguuuaaaguuacacacaauuuggagcauaugacauucagcauguuauuuuuuaggaagaacauuucugaauuauguugaguauggaagcagauaacauuagucaaaagcauguauugugaccuaaaagauaagggaaaucaaccauuaucauaaauaaagauuauuuugguagauaaaguggaacacuaucucacagguacgugaaaguuugagcccguaugacuuuacaugcuuacuucuuuacaauaaguuauauagagugugcaguagguuauuuaaguuuccauauuaauucauaaagaauaaccgucaaguaaugugggcaaaauaugguucaggaaguauuuguagcugcuuaaaugauucuuaacacuuugaucuaguuucugugagaugacuauuuugcuccggggcucuuaauacuagguccuucugugcucauauacuugaucgaaguacagucucuaaauacuauccuaugaauguaacaggaaaguucuacucucucuaaagugcucaaggguucauaguuuucuuuuuucauuuuuuuauuuuuuaaaauugacauaaaauuguauguauuuacuauaugccacauuauauuuugaaguauauaaacauucugaaugacuaaauucagcuauuuaacauaugcauuaccugacauaauuauuuuuguauugacaauacuuuacauccacucucagcauuugucaauaauguauuguuaacuauagucaccaugguguauaauagaucucuuaaacaucucuauuuaauuaaaauauuauaucauuugaucaacuacucuagcuccugguaaccacuauucuacuaucuacucuuagauuagcuuucauagauuccgcauaugauaaacaaggugcucuaaaauuuuguugggacaaucugauacuguggcucuugaguucucuaauguuauacuacagauuuaucagcaacuuaucuucccuugagggaccaauauugucugcaugcugaggugauaggaauggucuaaagcucauuucagucuaagaaauuacuuccugcuuaaaggaaguggaaaaagauaucccauaugaacaaguauggauaucauagauuuucuauuuaguacuauuaaauauaucuuuggaaaaacuggguaaaauuauacuauaauaaaucacaaagauauacgugaccacacacucauuggcaaacacacauaaauuuguauauacauaauguaccacuuucccaaaccaaauagaacaaaacugaggaauugaagcugaaacuuaaaaccaacugaguuauauaaaagaagaaaguaguaaccagugucauuauuuuuuccauuuuggugcuuccuugaggagaaaaacaguuuucuaaauuuucaugcauuuauauuuuagaucuuuuaaaccuuuuguaccuaaauaaggaaguuggugaacagaauauuauaacuguaauucaaacuuugaucugagaaauugauaaugcccuaaaauaacagguugcaaaauguauacugugaaggucauuacauaaaaguuuuaaguucccugaguuaaaauuaaaauucuacucucaauaguaccuacguccauuuccuauaaagcuuuuugaagaacuagacauuacaagagaaugauauaaggagguaauuauuacauuuaguauauucuaaacuuugauuugggauuuuacucauucuuuuaaugcugaccaauuaaacauuuucuuuucuagauacaguacaaaauuguuuucuuuagcauaaucaaacagcuuucauuuuacaugaaguaauacguauuuucauacauaaugcauacaaauaucaagcagucaguuuaggaaagucauaugguuuggcuguguccccacccaaaucucaucuugaauuuuaacucccacaauucucacaugucguggaaggaagauggugggaggugacugaauuauggggcuggucucuccuguacuguucucaugagagugaaugagucucacaagaucugaugguuuaaaacaugggaguuucccuguacaagcucucccuuugccugcugccauccauguaagaugugacuugcuccuccuggccuucugucaugauugugaggccuccccagccaucuggaacuguaaauccauuaaaccucuuuuucuucccagucuuggguaugucuuuaucagaaaugugaaaaugggcuaauacagaaauaaagaaaaaugaggcuggaauuacaaaagaagcaauguuauauuagagaugacccaaugaaguuaggccuucagaauggccuccauuuuaaagcuaugagguuauaacuagcauguuguuauucagguuaaauggggugaaguacacauaaagaacaccacaagccccaauacacagcaauaaauuuaagccccacuaauuuuuaacuauuauuuuaaugaagauauuaucuaagaaaaaugcauuuuucuuuuguaucuuuuuacuuuuuaugacuuugaucuagucuuuaauucaugaugaguugauguauuuuguguaaauaacuaagcauuggauacauugaguuuccauuaucaaugauauucuguauuuacaggcacacaaucauaugcucacuaccaguaaguauucagauuacacacaauccuuucuuaucaagccuaaaguaaaauuaguaacucuaagucaacauauuugaucauaguauacggugguguuucaacuuccauuuugaagcaugcugggcuccacucacuaaauuuuuuagauuucuguuuuauuuauagguacccauaaaucaacccucucagaacagaaugauagauacaagcguaagaaccugauuugcaaaccaauagauuuuuuaaaauucaauaccauuaauuaagcaacugaaugccuuaacaaaaacauuugcauagaauuagggugaaauaccauuuugcuuuaauauauaacugaacauuuuuagaaaaguaaacauuauuguuaauguguuucauuguaauaucuauugccuuuagauaugguaguucacuuguuuugugcuuugugugugugcaaaugugagucuaauccuucauuuagauaaguaucacaaguuugaagcucugaaauugaaauuugagcaaaagcacaauguaugucuuucagaagaaaugagaaaugauucauccauuuccaaacuaguguaugaagauaaauaaccucugaucauuuaauauguaacucaugagguauguauuaugagugaggcauuguagcuaauaagauaggguucuuuuacagcuucaaguuccugguaacaucccagcuugugugaguacacugggaauaaauuauuccuuuguaggagaauucauuaccgguagcugauagcucaucgcugaauuacuuaugagaauuacugaaaccguauuuuucugaaauuaaaaaaacauggucuuuugaaaaccaaccuuuuguuggcauguuaacaaccaaauaauuguuuggaauauuuguguccucauaugucuuugccagucuuuucuuucaauuacauuucagaauucuuaaaaugcgucuuuuauuaagaagaaaaucugccuucacucuguaaauggaacuuggucaaauguauagaauuuguaacucacagacaaauacuaguuuguuaauuugaaaauaaauuuugagauucaaauaauaagccuguguuuuauuuuuaaaacauaugauauuuugauuauuauuuuucaaguauaauuuguggguagaagaggaugccuuucuaagccauucauuucuggucucauaacucaaaacucucauuuuuuucaaaguagucuuuucuaauaccccaguccuuuuaugcaucucuaucccuucaaaacagauucagguuauuucuugucucauguccuuaauuuuuucuccagagagucuuauguuuauccucccccaucuucuaauuaauaaugugcugcucccugagucuccuuuccucucugaccauaugugucaaucuucugcacaaugaauuuuaauuucuaugccaucuauaauauuaaagcagccuuauaauuaauauauaucaaaauguguuccaguaaauuucuuguaugaaugcacuugaaaaccuaauuggcaagacccagauacuuguauaucuauuuaaucuuaaucuaugcuguuuguuggauggagauuauuuuucuuuuuugucuucuggaccuacauaauuuauaagacauauuuaaugaggaaaacauguuaaaaauaucacuauuuuguuauuucucaggguaaaaagaagaggguguuggaaauaucuuccagguuuaugacuuggaagacucaauacuucuaaaugucaauucuuucuacacugaccuauagauucaacacaaucccaaucaaacucucagcaagcuaucuuacugauauuaacaaaccaugucuaaaacuuauauggcaaggaaagagacaugaaauagcuacaauacugaaaaaagaacaaacugaaggacucaugcuacuguauuccaagacaaauaaagcuacagucaucaaaacuaugagggauuggcagaggaauagaaaauggaagagaguagaaaaccaguaaaauaaacccacacaaacaaaauuaauauuuaacaaaggcauuugaaaugaagagaggauaaucuuucugcuuuguugaaauguugauaaaaaaaguaauaaugcugagcauucacauauuaaaauaaaaauaacagacaccaacuauaugucuugugcaagaauuaacucaaaauggaucauaguucuaaauguaaaauuuaaaaaacuauacuuagaauaaaauggauuuucucuuggauuuagagaaaaguuuuuagguacacacaagccuuuauccauaaaaaauugaucuuggacguuauuaaaguuuaaaauauuugcucuucaaaagacacuuaaaagaauuaacagacaaagcauggccugggagaaaauauuugcaagacauauucuauaagguacauauauccaaauuaaauaaagaacucuugaaacccagccuuaagaaaauagcccaauuacuaaauugggcuauuuauuaaauaaucaaaaagacacgguaucaaaaaugauauagagaugacaaguaaacauauauuaacaauacacaacauauuugccauuaaguuagagcacauuaaaacaacuaugugguggcacuacggaacuacuagaauggcgaacauccacaaaacuaagaauauuauucucagugagaacacaaaguaacaagaacuuacauucaauuugucuuauaaaguagcugugccguuuugcauucccacaaccaccuugcaagacaauuuagcaguuucuuaaaaaguuaaauauggucucacuauaagacccacaauuaaaaugcuagguauuuacucaacugaauugaaaacuuauguacacacacacagcccaugaacauuaauaacagcuucauuuguaauuugcaaaaacuggaaacaaccaaaaugucaguaggugaauggauaaacugugauacaacuauauaaugaacuuaaaaauauaagcuaaaagccaugcaaagacaagaaugaauguuaaauacauauuacuaagugaaagaagccuaucugugaaaguuaaguauuuuaucauuauauuuauaugacauucuggaacagacaaaacuacagagaggguacaccuauuaguugcaggguuuucuguagagagaguugagugggcaaagcacagggcauuuuuuuagggcauuggaacuauucuauaugauaccauaauggugaauauauauuaugcaauugucaaaacccauagaacuauacagaagagaaaaccuuaauauaugaaaaacgcuuuaaaacguaugcaggaagucaggaucacaugucagaaggcagaaugugaaaaaaauaaucuaaccauaugaaaauguaacaaaaccucacuuaugugguggcaggggagaggggugaugcuaaccuaggcaacuuuggaaauagaguuugcaagacuagagucauugcacauaaauccuguucucuguuugacaaaguuauucuccagggggcuaccacuaacaauucugaaacucccauacaugauaacaagaauuuaacaaguaauuaaauugauggcaaugguaggauacagguuuuuuuuuuucuuuuuucuuuuuucuuuuuuuuuuuugagauggagucucgcucuguuguccaggcuagagugcaauggcaugaucucagcucacugcaaccuccgcuggccgaguucaagcaauucuccugucucagccuccugaguagcugggacuacagguacaggccaccaugcccggcuaauuuuuguaauuuuaguagagacaggguuucaccauauuggucaggcuggucucgaacuccugaccucaggugauccgccugccucggccucccaaagugcuaggauuacaggcaugagccacugcgcccagccugggauccacguuuauuacuauuggggugggaaguuacaaauagcaaggggagaagguuagaaugauugacaugguaauugauuauaguugauuauaguuggauacaucaauaugaacacacauuaaguuaaauauacauacagaugaauauacauacaaacagauaugaagacacagauauagaaauuuauagauaugcauauauacauggcuuaguagaaacacauauauccccuugcacaauuauauuccacuaucaaugagcauacauagcauccagauacugguuucugguaaguaccauuacccaacaacaacaaaaaccaggauuccuuagaagguugauucuaagacuggagcaaaaaauauacaagcuaaaacauauauauauauagauagauagauagauagauagauagauagauagauauacacacacauauauauauacacacacacguguauauguguguauauauauguauauauguguauauauauacguguguguauauauauauacguguguguauauauauauauacacauacauaacagugaugcaaguuguaaugccagaaaauaaagaaaugcuuuucaaaaacucuguagugaugcaggugugucaaaggacacagggcaacugaaagaguuuccaguggccagagcugaaauuauuugauuaaaaagagaaacaagguacuauuagaauauaauccaaauuaugauaaaaucaaauuucauguguccauaauaauguaaaugauugaauaaauggggaggaauaauaaaauuuuauacauggcccauguagaauaauuuaugucaacacugugcccucaaagaggcagacauaauagccuuacaugugaacugcacauagggacuuccuucccaauacuacaguauggaaagagucugcacugcaguagagaaaacuaacaaauccuacuuuagccagguaaucaagaucaacaucaacagugacaagucguguugcuaguguguauccuagauagaauguggugagaaugacacaucugugaucuucuucucuaaaaccuauaaugccagucuaaucaugagaaaaacauuaggucaaucccaguugaugaacauucugcaaaauaccugacuaguacuccucaaaacugucaaagucauuauaaguaaguaaagucugagaaacagucauagccaagagaauccuaaggaggcauaaugaccaaauguaauauggugagcuagauuggauucuggaaccaaaaaagaaagccaaggacuaaagguaaaaccuaagaaaaucucaaugaacauuaggcuuaauauaugcauauuggcucacuaauuaugacaaauguuagcacauuaagguaaaaaguuaauaggggaaacugguugucggugauaacgggaaugugaacucuauauucucuccccaacuuuucuguaaaucuaaauguauucuaaaauaaaaauguuuauuuaaaaaugaggcagcaagaccuuauguuagcauauaacaaaauggggguagggauacgguuccuuaucacuaugccuucuuaaauuucgcucuagcucggcauuugcuaagaaaauucggcuaaaguugagaucgauauauggauaugucccgguucaauguagcuaaaugaggaaagcucuauaagaaagaaaaccauaagaugauauaauuaauggagaagauaaauauuacaaauuuuauaauucccaauuguuaaaaggucacuuuauuuccucuucucuugccacaugauauuuagaauuacuugguuucaaaauauuuuuaaaauuauucaauuuaauuacaagaaagaaaguaaaaaagcagaaaggacuuggagggggugagcacacauagcaacaacauuaauaauaaugaacaguccuaccauuuucaaaauucucucauauguacucucacuggaucaucaaacauuguuuucuguuaugucaagucuaauaucuccugcauauucacagcuaaauguugcauaauacaugugggauauaagggauccaacuuuaaggacuuaaaaaaggcuaaagguguuauauaucuaaaaaacauucucuguauuuuaugaacuggagauaagagucauagcagaaacuuccaccauuagucuccuuggcaauacugauuaaccucccucagucacaauuuugcacaaaaagaauagaaauguuaaagaaaugcuuugggauuucaaggcuaucauuaacauuuaugggaagagaggugaaagagcuagcuaguaauuaucaauguacugcauugcucuacaucucuggcaggaacccaacuuuuuggaucaacuagcaggcagcaccguuagccaugagcuuccauggucacgaugagauuguaugucuuggcaugauucggcaggugucauuuauaugcaaugucaucugcaggaaaaaugcagggaguaucauucucccugcuuaaguucuuuuauggagacaacucaaagucuucgcuaaaugauuacucuugaucauuuucaguuacaacaaugacuuaagaguauuguggaaaagcaucccagugaacagaacuguuaagaugaauaaaaaugucuaaauucuaaauauauauuuucaacuauuugcaaggcuauaugaacauuuuugaaauacuaguuacucuguugugagaacguaaguuuacauuuaauuuuuaaauaaguuuuauuuuuauacaucuuuaacacguagaauucuccagcacuguguggauccaauuauaaaaaugaaacauauuuuacuaaaaauacaucuacauaguauucgaauacucaaauggauguuggcagugaauggagaaaaccuaucaaaacugaacaaaucuagaauaaaauuacuacaaaauuagcaaaacagucaguuuuagaagaaaacuuuugaggacauauaaaaugcaaaugccgugaaugaugugaucucuccuuacauacccacuuguuucacacgcuugaggucagaagucuaaaacugaauagacaccuggauuuauaauuuauuauagucacagauccuuaucaaauuaugucauauaaaauucuuauauuacuauuuucagagggaagaauuaggaauucaaauacucuaguuuauaacauaauagaauugcauacaauuaaugauugaauagacuacuuuuacuugaauaauuaaauucaacaaaguuaaaggaacacaaaacucauauaggcaguuaauauuaauaacaaauuuuaacccucucccaccucucuuuaguaaaguaaguuuucaacuacucugaauguuacagaaaauggauagugauaaugaagauggaauauuuuucuucauguagugucuugaguuugaguuuaauucaccauuuggguuuaauauaccuuauauuuaacaaauguuguaaagaauauuaaaaaauuagggaaagaauuuaaauauuacacacuauucucugcuuacauauaaaaaugaacaacacuucuauaaauuucaugucauuuucauauuuuaagauuuuuuaaagugacuuuuuuauuauuuuagaaauuucacuuuuuuuuuuuuuugagaugaagucucacucuuguccuccaggcuggagugcaaugucacaaucuuggcucacugcaaccucugccucccuccuggguucaagcgauucuccuaccucagccucccgaguagcugggauuauaggcccccaccaccacgcccggcuaauuuuuguaucuuuaguagggacaggguuucaccauguuggccaggcuggucuugaacuccugaccucagguuauccgccugucucggccucccaaagugcugggauuacaggcgugagccaccaugcccagccauauuuaucuuuuuauaugguguuugacacaacuaccuuucccuucuuugguuucaguuauuuuccauuaacguuuaugcauuauuuucaacaaaacaagauuaaagucaaauauauauacucauuaaaugaacuaacauucugcucuuauaauuuaaaacaaauaugcaaugcuuauaagugcagaguuucuuuguuacccuaggauugaauuuuagaaaucagucaauuguccuuuggauuuugaaaaauacacucauucaucaucauaggaacagucuuccccaaaauuauggcaauauuccucucuuagacaugauuguaguguaauacagauagguuguaaauaauuugaaagcauccuaaaaauaaaacguauuguaaucgcuaauuucauuaaucucaugaaauaauacccuaaaauguacaauuaaugagucucaacuuaacuggugaguaguuugagauaaauaacaugcuuauguaaaucaacaauaauuuuguaauuuuacuaugagauucaaagguauugaaccuccacacaauaucauccuuuucaagcuucucucaacaagcagcuuaugaaaaaggugauucgccuucugagcuguagcccauaaaguaauugaacguucagugaggcaggaugucuaccccacgcugagcagugaauuugaagauucaaggaaugaugaauaucuaacaaacuacuuccuaaaggguuuuuauuacuccaauuuucuuuauuuuucuuuacuuuuuuuaaaaaauuaacccuaaggauuauacaagaaaagcaaaccaaauaaaaccaucacaccaauaaaauccaaauauauauuauuuuaaaucaggcauauacauaugaauugaggcaguacacucacaaaagacaacauccauuuuuugaguauuuuaucauagucauuuuauauuugcugcuuuuauuaagccguuuuacauuaugcaggaccugagaaauuuuacguuucagacuugacuuuuaugagauauuuuaaaaaaauauuuuguuucacuuuagucacuauuacuguuucaaaauucuacauuucuugaaauuuuauuguguaauucagcccacaguuucaguuuuuucuaacauuugauguaucaauuuuaauuggccaaaaacguaaacgguucuuuuagaugugaaauacuucauggcuagauaaaccauuauuuuaagaucaguguaacuuugauauuuauuuaaggaagaaguuuauuuccuagaaauggcuauucgaaauugccaaagagguaaugagucauagaauuaugaaucaaaguauuucagaaaaaguaagaucuucaagguaguacaauucagcauuucuuaaaauguuucaaauaacagucugagaauuugauuaaaacuauguucccucucgcagaaaaaugcacaggcucacaaauuuuugcauucaguuccaacacauuugaaucacaucuuuguagucuauucaugaaccaaagguaguggaauuuggagauuuuguucaagcucauguuauagacaaagaaacuuugguccuccagagcuagaugacuuuccaagguuaaccuguuagguauaguucaagauaagacaaaaauacagguuuccaucccagcuacucgggaggcugaggcaggagaauggcgugaacccgggaggcagaacuugcagcgagcggagaucgcgccacugcacuccagccugggcgacagagcgagacuccgucucaaaacaaacaaacaaacaaaaaaaccagguuuccuggaauacacacuuuuucuauuacauccaaucacguaauuauaaccaacuagaaaggauucacaauaacuaaacacauuuuacagcaacuuuagguuuuuuuucuauggaauaaacuguaucuaaucucaucaaugcauguuucauuauaagagauaauuguguagagaucucgacuccucucagugagauugagcaaacccgauacagaaaaggaaugcuacaaaugucucuuaaauuuugaaugaaugggccugcguuggcagugcagugggaaaguugacauuagaagagacgcuagucugggaaacuagguguuuucagacaaaaucauguuacaggguauuaagcagguaugcagauacuagcugaucauuaagcaaugucugcccaccaucagcuuuuuuuugacuauaaauucacagguuuauuggauaaugaguaauaaaccaaaucucagaaacaccaaccaucugaacaacuucauugaagcugggguuaagugacgaagagguagcuuuacccuagaagaugguuucgguuagaaaggccauccucauauugaacaaucaucauccucacugcaaauuucacuuauuuguccagauucuuccgccugaacaaauaaauauuuuuuauuuauucauucaucucucucuuucaaagagcuauaguauuugacauuacuguugcucauuuuccaaauuuccagcaagucguuucaaaagaauccucuggaaaauguuccccucaccgugauccuuugcuuugcucacauuuuacucauuucugcucccgaguugugauucccuccuuuucucaacucccguuucauuucucuuuccuguuucucucucauccccucuuauuuuuauagacuuugugcucuuccuucuagauucucuuucuauauuuuacugcaauaggaaaaaaacaaauggagcagugguguuuugugaaaguuuaaaggauuaccauugucauacuaaaauucuaacuuccagcacuggaauuacagauuacauuaaauucucccagaagaacuugagcaaauacgugaguauuaauauuauguggggagagauguuccaagggaagcacugguaugaucccaaggggacaaggaaucaguacgauguugagauguugagcagacuaccaccguagcacaugaagaucuuuggaacccaacaccacugcucaacuuugagaagcaauguauacugugucucagguuucuccccaccaaggaacaaaggaacuaggauauugauccacaaagcugccagucauugauucagggcugcucccaggugauaugaaugcaugcauuuccauuugcccuucaguugagccagacaccuuggccagaaaagccuucagaaagagucucaggugcuuccaguuggaaugcacaagagugauguguguugaugagauaugggugagucaccaacagcaccugcaaccaauuauuucauugcuacauuuuuguauguauuuaauaucugagcaugacuuuuccucugaaacacagaagauauuuaauaucuuguuuccauauuuauuucacaggaagaaaugucuuggcccuucugaagggcucuaauaagcacauugguuaaucuagugauucacaagggaguccaaugggucaaauuccuguuuggggacauaacuggcaagacucagaacugaauuuucuagacuuucaaguaacuuguaaacaaugugagcuuugcaguuagauagaucuagcuuuuuaguuuaaugauuguguacugugcaacuuaauuuuuuucaggcucaggguccuuauaagagaaaauauuaauagcacacagcugugcugacuaaaagagaucaaguaagcuaggcagaggauacaauuucauuauuuagcaaagggucaacuuuuguuggucauuuccaucagcucuccuucccccaaaucaccaagauuaguauuuuacaauuuacagaauuaaaauuacauuucccaguauauuuucuuuuuucaaaagcuuuuuuuugccuucuuuuauuauauguauucuugcagucugugaaauauggauauaugcaggauagauauacgcagauaacugaauagaauauuuaaaauaaauaauccacuuuuguauccauacgguaaugacacgauucacugguuuauauaaugcuaccaucuugaacuucaauuuuucuaggucacucaaguuagugguacuauauaacuucaaaauuguuacaguacauugcaacugagccuaguuuucuucuccaguauacauuaguuguguaguugucuuugacuuuauugccuucuugucagcaugcagagaaacagauugcaagcacaacauuugacaagacuaccuuaaccauuuucccugcagguuugcauucagcuggauggugauauaauuacagggugaauccccagcagacaugauuguggcccuuuuccccaaacacugcagcaccgcuucaugcucauaaccaaagaaucauauucucuguauuuggcuuuuucuugugucucuggauuuguuauauucaagguggacacauguuauaugccagguugaaaaauuuucuaaauuuuuuaacuuugucuaauucauguauaguaucaguauaauugauaguuuacuaacauuuauauguauuuccuuaacugcuuauuuaggaagaccauaaacacgauuuauaaaaauaaagcuuacacauaaaauauugugcauaacuuaaucaguuauuagucaauuucccuuuuguacacgugagcauuuaaauacauuucuaagaggaguuuuaagucauuagcagaaaauaaaagguuaacucuaguaaaaccagaggaauucuacaaaugcauugcuuaaaaauuaaauaggacucacgggucauaauaaaagcuuaauaauguauuuaaauguaucaaagagauaguaguaaccaagaaauaaguaguauuccuugaugauaauaugauaaagggucuacuuagugaauuccuucccaaaacagucaaugauaagaaauaauaaauuacuuauuuuuauuuacugcuaaauauuucaaggauauauucacuuucuacuuguuucuuggaacacguaguuuagagguauagaaaucacucaacagaaaacugugaaagaaaagcugaaagaacacuuaaagaucauguaauuuauacuuuuuauuuuggaauugauucccacgguguccaauaugguagucauaggucacuguuacuaucaagcauuugaaauguagcuaguucaaacuaagcuguguugcaaguauaaaauacacuucacacuggaaucguuaauuuaaaaaauauguccaacauccuaccuauaguucucauauugaacagauguaaaaaucauauuuuuggauuaaauaaaauaaauuaauuuuaucuuuuuuuacucuuucgacacacuggauuaaauaaaauguauuuaucuuuguuuacucaauaauguagaugguagaauauuuuagaacacauguuaauugaauuauauuucuauaggaauguuggauuuuacuauaaucaaaaaucaccaugaaagucaaaugaacaaaauguuauguaugaugaauaaaucaugaagacuuaauuuucuuaaaauuuggagauaagaaauuaaaggacuguuagccaaaauguaagcuucauucuuauagauugucuaucagaguucuuuagugccagagccuuuguguggccacaaugaugaccuguguucauaaaaagacuuccaguagugacucuagaaauuacagacaagucucccugugacauuggagguuuuaacagugguggaugcaaccaagacaauuugucucugcaaaugccugacacuucucauagagcuccuugaguaaacaaaucuauagauagggaaaauauaaggaagacaauuagcuugcuacaauucucuuaaauugucaucauauugagagcaauugguagugagugggaggacaaaaagcauggauagcuacuaaacacagaaacaaaagaguuuguggcaaaaaaaaaaaaaaaagacagauguuagagcuauaagugaaacaaagugguccuaagauuaaacaacauugaacaagaucauauaguaguuuuuaaaugagcugauggagcaacaucacaaaaauacucaguuuuauaaaaaaauuuuucagauuaaggaaaggccaaaguaaugaguacauaccuaaguauuuuucucuguguauaugaacagguuugggaaugacauaugauuuuuuaaugggaaauuuaagcuguacccgucuuaauaauccgugccaaguuuuaaaaauaaaugcuuuuucagaaaauaaaaaugacaucuuaaagaaaaacuucuaaucaacgucugucucuuggaguucuacaucuuuugcucacugccuuuaaaauaagcaaauaaggucugccaacaagaauggauacucauaaucucuggcuugauuuccugaaaaauacuccuuuuuguucuuauauuaaaccauuggcagaaucucuuuuaaauacuuuuaaaguaaguaacaauuuagaauuuucauuuuuaaaaaaauuaugucuugaaaugcuagcuuuuuaaagaaagggaaagcugaaauaaucuuucacaucuucuugucauucucaccuguaaacuaguuuugcuguuaacauauugcauggaacaagaaaaaagguccaugugaguaugagagaguaugcuauuuuacauuacuaauauaaaucacauaucuguuaacaguaauaacuauuuuuauuaaauguuugucguaucuacuagggauuauucuaggcucuuuuuacuuuuuagauucuaaaucuaauuuaauccucacgacacuauuacaugaguccuauuguugucaauuuaaauaaagcuuggggcuguaaucugauguaacaaaaauauuuuuauuguagauaguguuaguuacacauuuauccccuugacucaucgauggacaaggauaaccuuuuauauguuauguauauaucaucagagaacuggaaguuugaacaaauccuuucaauauugaaaagucugcaugugauuuugcaaaagaagacuuucuguuuggccuguggacaauccauauuuccacuggauuuccaggcuaagcugaucuacuugaauaucaagauagucugaaggcacaauacaugugaaaagcauuacuacuauaaagcuugccuaaaguuauaccaaaauauguaauuuaaauuauauauucccuugcagaguuuuaauaaggguaccucucacugaagagacagagaacaaaauagaaaauuuuacugcuaaagugucuacaacauauacaagaaauguucuuuguagauacagucucuuaagauuccuguuucaaugaccaugaaucuuugccuuuuugcccucagauauaccugauuuuagaccucaaauacuuucacaugugaaaaggcagcaaauuuuauauaauauuauguauuuuuuucuucuacagcauuucuacaaauaacaugagagaauuuuuuuuccaacuaaaacacuaguaguuuauuaacuuuaaaagcaaaauagaccaggugcgguggcucgcgccuauaaucccagcacuuugggaagcugaagggggaagauuccuugagcccaggggcuugagaauagacugggcaacauagugagacucuguaucgacaaaaaaauaaagcaaaaauuagcugggccuaaugggguucgccuguagcccuagcuacucaggaagcugagcaagggaagcagaggcugagugagcugugauugcaccacugcaccccagccuuggcgacagagcgaggccuuaucucaaaaaugaaauaaguaaaagcaaaauacauaaacggcuuugcuuauaaauacacaacuaucauuuuaaugcuuccugaaaucauuaaaucauaaauguuauugguaauccugcuuccauuucugaugcucuuuuagcuuguuuuaaauuucagauucaaaucccagagguugggacuuucucauuugcauucauauacuuucuucuuaagcauauaagagacuaaauuaauguauaaacagcauuggggcaccaggggcucaaggcaagaacaaaauuacucuggggauggaacauuuucaaaacauauuccaauucaggauagguuuacguguuaaagugcuaacagaugacuagcacuguuucuaaaucuagaauaacuacuugaguucagagaccagauuacauguuuaaaacaaccggaaccauuagaagucuagauuugcauagauauaaaucaagauuauuagaggaggagcuauuaagaagaaagugcaaucaugucucaaaaaugggauuuaaaauauugucauauuuugagaugauaguagaauauuaaauuaacuacuuucacuaaugcugaauucccuauauuuuuccuuuauucugaccuuaauauuaucuaccuacauuaugcucuaguauuuucauucuugccacauuuuuagcauuaucccauugcacuccaaauuugcacacacaaacacaaagucaacaaagccaguaauauuuagguuccgaacaugcagguucuccuuaccugucaaaugugcaccuuuuuccugccaugucaagucuuccaaaacuacucuguuugggugcugcucauguuucaagccuuuccuaucacccagggcucugcucucuccuaggagacgacuacacgagaauaauccuaauaaaugugugacuggcuaggcaaaucccacagguuuacauguuuguaaauuuaccaaguaccaccugaaaaugaugauuauuauuauucggugauucucaagcuuucucaauuuuggcaguguauaugacucaccugaagauuguauuuuaauugguuaaaaacaaugguucucgccgaguuucagccuuuaguguucauggaacucaccugggagacuuguucaaucacagcuugcagagcucugcccucagaguuucugauucgcugugucuggggugcagaccauuauuuacuuaucuaccauguacucaggugaugauguuucuggucuuauaagcaugcuuugugaaccacuggucuggaguuagaccuaagaaaucuccagcugauuccuauacuaucuagaauuaugauaacuuuuucuaaucaaauguaggaaggccuauaauggacaucucacaacaaugccaugcaaagugcauuuuguauuauugaguagaauaaaacuuaccuagaaauaauucuguuuacuuguauauauuucuuaaccaauuacuuuuuucuauuuuuggacaaacaccucuaccauggcccaaaaucucucagcaguaguaucugaguguuuuuagguauaugauaaaaauucauguaccaagaccuucaaaaagcucaaguguuuuaaguuugucacaaaaugaacagcaaacagacugauguuucaauuuucaaauguagauauagugaauuaguagucacaguauucacagcagaauacuauaacagugcaguauuggggugacacaugagaaauccuguuuucagaaugacccuuggacuauguggaagaaaaauauaaaauccuauuuguuugugauggaaaaaaauuccacaauccuaaaauuagaaaugugaauaaauacuacugcagcuauggggugggugcaaauaccgauaaugcucacuacagaagaagacaaaacaauaccaccugaucaucagaauaagaugcaugugagugcaacacuaggugcuuuuugaugaaacucuaaccaaagaaugcaaaacuuagaugaucaaugugaagaaacuugggucauuugaaguaggaaauaguaaaugagauuuuugagaccuaguaauaaaauggacugacaaaugccauaauccuugagugucuccaaguaugcauggucuugggaaagcaguucuauaguacuacuuauuuaguauggcuggauuucugucuuuauuucccuaacuuggaaauaauuuuauuuauaaagaggaaaaacuuugaauuauuucugcaaaaaauaggaugcaaucugacuaguuuaggagaaaguaagagguauguacacuacauguugcugagacagugaaauuugaaauuuaaaauuauacacagaaaaaagggagaucaucccccaaaaaagaugaaauuguuagagauagaacauauaaaaugaaauggaauaucaacaaugaauaccaaaagccuuaaaaauauacaauugaucagaagaagugcugggaagacaaaugaaaauaaguaguggaaauuuuaguagcacaaaaagacaauucuuuauacuuacaucaauuauuuugaaugguacauucuguaagagagaaauaugaggagaaauacauuuucuuaugacucugcaauugugaacccaacaauguauuguacuuuauacaaaggaauuugcuucacugaagcauguaaucuguauugucauuauuaacugaauaaaaaauuucacuuccuccuaaccagcuuacucacacauauuuucauucuauagaagagaauuaaacuuguuuauucacggugauaauucaaauagaucugaauuauuaagcauauucauucaacaaauauugaauuaacauuauacacuguaccagaucugucuuaaacaaagaaauguauaagcaugugccuuggccuuaaagaguuuuaaaccuggaaaaaggaacaauauauuugcacgaauaucuucaauaggacuguauaugccacucaagugauauugacaggcagcaagaaaaagagaaugcauccugcugccaugaucaagaaauacuuuauaaaguauuuguuuaguuuaacauuaaaagauggagaacaugaaguuuagcuccaaauauuaauaaugcuuaaauauagauaacauugcaagggguuuuuauguccuuuuaaucuuucugcauuuucugcuuccuuuaaaugaauguguccuuuuuacaaaaugaagaaaggaauaaauaccauuaaagcaaguaaagggacugaggcaugguaaacuugaaggagaauauuaagagaauauguaaauucagaagauuuuggaagcacaugagggaaaauuuuagguuuggaugauaaaauugugacaaaucccaaguuaauaagugauuuaagaagaaagauggugaaggccaggcccgguggcucauguuuguaaucacagcacuuugggcggcagaggcaggaggaucgcuugagcccaggcauucgagaccagccuagguaacauagugagacccccaacucuauaaaaauuuuaaaaaauuagcgagauaugaugcaugcaccuguaaucccagcuacuuggcaggcuuaggugggagaaaugcuugagcccaggagauugagaaugcagugagccaugauugcaccacuguacuccagucugggugacagaaaaagacccugucucaaaaaauaauaauaaaaacauaaauuuuaaaaagaaaaacaaaagauggcccaucuaguuuuaggcucguugaguuuggguuauggcagccuaaaugcccauucgugugugaaguggaagcaacuccagguagaggagcaagggcuggggcuggaagucaagcagaagugugaucauuggacacaugggacauauccaacaucugaugaagauaaauucagagauaucuugaagauuaaacauuggggaaugcuuccauagaagauucaaacguuacccaaucuguuugaaauuagcucgaaacuuugacagacuaucacuguuucuacauauuuuguuuuccuguaguacugacugacccaucaguacuaaucuaauaauaauguuagaaauauuuugaauuagaaggaggaaaauaugccuuggucuccuccuuccuuagaauaaauaagauaaauaguauuguguauuuauugauuucucauaauagcaaaauaaaaagccugaccuuagcccugggacaaacuguucugcuguauacuuuaugacuauacaaaagaguugucagcaggaucacagugaauuucuguaaugccaaacagagcuaacuccauggaaauuaugacagcuccuugacaucagggacacucaccgacugcuuauucacuuguugagaguaaaugagugucagcugccagaaaauggagugaacaauguugaaaccauacaagacacuuugcuuuaaaugauaauuucaaguacugaaucucaggcaccugcugguuuuguuuuauaauuucucaagcaaaauaaguggguuuugucaagugaaaagguuauauuucugcuuguugaauuaaauauuggaggucaaaguaauagcaucgauuccacauaaccauacaaaagagacaaaacauaaaaaugaauguuauagacuuauggcuaggcuuaaucaaucaacagacuaugacaauaugacugaaauuuuucaaucuucuaaauaacaaauaacaauauucaauuaucuuucuucauagaaguugacauuguacaauuugaaagggucacucuugguuugccuaucaaaaaugucauaauaucaauuccuucaauguaguaaaauucuacgacuacuaaaauaaucuacaugaaaaugucuugauguaauacuuguauuauauuccauguagaacucaugucacuuuuuacaucuauaaugcucaagcauacauacaauauaauucaaaguuggacagaggauuuauaauaugacucauucuaauuauucugauaucacacucauucacauucauaggcagaauaauaguaaguauauuaauaauuaugccaaaacaguaaaugguuggaugccaacaaugcauuuaggacuuuagcaaauuuaugacugcaaucaaaucugcuucuaaaaauguauacauacauauuaauguucuauguaaaucagagguuuacauuuaaguugaccuuagggaauaacaacagcugauauuccugccuuauagauuauguuuuacuuuucucaagucaauggaaaucuuauucucaacaugauaaauguugagcacuauacuaaauuccauagauucauaacacuuggaagaaguuagcucagcacuuuuagacuuuucaacagcauucgagacagauaaucaucuacuaucugccuagucaccagcaguaaagaugaaucauaucagucguaucacuaugccaguuauucaacuaugcucacuauugaauuaaaauguguuacaucuaccacacuucauucuaucuucuuuuuguggauucaaaugcuaauaauuaaaauaauaauacuaacagaaauaauacuucagcaugauuauuaucauccaugauauggcaaaccucaaauauucaugagaguuuacauaccucucuuauuucuuccugaauuuacauugaauaucuguaguucauuagugacauaacuuggcucugagacccuccaccaucuuagaguccuuuuuucugcauaacaugacuauacuaagugcauuaauacaguugagguacuagggcaacaccaugagguggcuaagaauuuggcuuccagaguaagaguuauguuugauccagagcaagguguuuaaucucugaauccauuuccucauugguaaaaugaaaacaaugaugauaauaauaucaaucaucugauaauaugagauauggaacaaguacaauaauacacaaaauggccagcccuaguuucuagccauacagugaaaugaauacaauaaagaaacaagacauagucucuauguccauggaacuuucaguuuagaaaggauauaaaauaauuauuaaaaaacaguguaaaaggcgggaagauauugcaguauuuuuuuuucuuuuuuuuuuuguuguuuuuuuuuauuauacuuuaaguuuuaggguacaugugcacauugugcagguuaguuacauauguauacaugugccaugcuggugcacugcacccacuaacucgucaucuagcauuagguauaucucccaaugcuaucccuccccccuccccccaccccacaacaguccccagagugugauaguccccuuccuguguccaugugaucucauuguucaauucccaccuaugagugagaauaugagguguuugguuuuuugucccugcgauaguuuacugagaaugaugauuuccaauuucauccaugucccuacaaaggacaugaacucaucauuuuuuauggcugcauaguauuccaugguguauaugugccacauuuucuucauccagucuaucauuguuggacauuuggguugguuccaagucuuugcuauugugaauaaugccacaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacugcugugagaugguaucucauagugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugggaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaaaucuuuaauccaucuugaauugauuuuuguauaagguguaagggagggauccaguuucagcuuccuacauauggcuagccaguuuucccagcaccauuuauuaaauagggaauccuuuccccauugcuuguuuuucucagguuugucaaagaucagauaguuguaguuauguggcauuauuucugagggcuguguucuguuccauugaucuauaucucuguuuugguaccaguaccaugcuguuuugguuacuguagccuuguaguauaguuugaagucagguagugugauuccuccagcuuuguucuuuuggcuuaggguugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguaucuuuuuuuuuuuugagacagagucucacucugucccccaggcuggagugcaguggcgcggucucggcucacugcaaguuccgccuccuggguucacaccauucuccugccucagccuuucgaguagcugggacuacaggcgcccgccaccacgcccggcuaauguuuuguauuuuuaguagagacgggguuucacccuguuagccaggauggucucgaucuccugaccucaugauccgcccgccuuggucucccaaagugcugggauuacaggcgugagccaccucgcccagcuaucgcaauauuuuaaauuuacauguacuaaauauauuuuaguaaauuagauuuacuuguacauuucuguaagugcagagcccuaugcuugcuugaauaggucuuacuagcauuuaaguuacacacucuaauuguaucuugccacacuucuaaugcaucuggaaauugaagacaauggcaaaaucaugcuguuaucugggaauaacggaagagauggaacauggauuccuaagagaccuccaagauagaaugacccuggugaauuuuaauaguauuuggucucccccauccuauacaaucuuugguguuucaaacuugaaaguuuucguucuccacucugucuuaauuuggaacacaccaaauauuugaaacacauugaaggagacuccuagcacaacugauucuuaauagacuuuaguauaauauuuuuuacccucugaaauaaaucacuauguguauuuuccaaucaguaaaaaauuuaauuuuaacuaguaucaagggcaacguaguuaugucauauuuaacacugacaugugacaaaaguuuugaaaugaugacucauuaaaauacaaaggaaauaagagaugccuacaauuaauuuccuuuuaaauaucaaguaaacauucuuuguggaaauggaaauugaagaucauugaaagucauaguggaaaacuuagaagcaauaucccugcauguucuuuccuuugcugucuuucuaucucuuaucuuacucuguaugaauaaacaccuauugcaacauuagaugcuguugaucaccuaauaaauucuucaaacuaccucuucccuugaggucuugacaugccuagucuaugcacucaaguuacucuccuacuuuuuacaucuuuucaguggaugccgccaaaaacucauccuuaagaucauagccacauuucccucuauagccgcauauaaucuuaagggucuccgugcaaauuaacauacaucuuucccuaacaucaaacccaguuuucauacugagcauaugacauccucagguuuccacaacuucaaauugauuauuuaacucaagucaauuuugauaccauuuucugcauuauucccaaaauaaaacauuugucuuuaccuacaaguuuuuguggauucuuguuuugaaugcuuuguacauccauuuggguucaaucuuuauuuauuuauuuuuuuuacuuucuuuaaaauuauauucacucuucuaauugcuaccacuuuaguucauuuagaucuuuuauuuucuuggaauuuugccuguauaagaaaugguauauggagucaacuuaauucuucuacuuuuuuugcauucauaccauuuccuauguauaauaauuuuuccuauguauuugcacauauuccuguuuuguuucuuugaaccaguaucauacuguucuauuuauugagacuuuauauguuuuaauaucuuauagagcuagcucucccauguuguuuuucuucaacauaauuucgcagauuuuuuugcauacuucuuuuaucauauaaacucuaaaauaagcuuauuuuguucaaacacacuguuggcuuauuuuuuacuuuuauauuaacauaaauauggauugauauaggaagaauugacauauuuauaguaucgagucuuccuaucugcaaccauaggauaacuuacaaguaaacauaauuacauuauuucauacugagacuacaguaagcaguagaauuuuaaggacuuucacauuuccaaguucucccugacuguuuaggugacaaaauagccauuuucacuguaggcacagcaauuauaaaaauucuucacacauuuaagucaaaauuccucaaauuucuuacuauacuuuuucauauauauaaguuaucugccacaugagauagcaauuucucagaaaaguacaguacccauuucuggaauugaacucgguuugcaaaguucauuaaugucauuaucaaccuagaucuaugccaaacaauauucuagucacucuguaaguauuuaucauaaugcaaucugcuucuaaaauuaagauaucaggggagauauauuuaaaaaaggaaaugggaaaauuaguuguuuauaucuuaagcaguguuaaaacgauugccuuuuguugguaauuuuuaguuucuuagagaguauaauuauguuaaugaacauuacagcaucccaagagggaguucauuauucagauuauucuguaugugaaacccuagaauauuauuacucacauauugcagaauuacuauaucucucauaacaauuugugaaaaucuggcuuagagcaauauauuucaguauaaaauaaagcaaauuuacugaccagcuauuauaugucaaguacuaagcuagguuuuggaaaugcauagaugaauaagggaauaugccacauguuuucucauggaggucaaaugggucauaaaaaggauaaguaaaaauuauauuguguauucagcgaugcaacaauacaaguacuaaaaagguacagaauacauacgcaugccuggauacaaacacacauauaugcauauauguaaacguguacacacccaaagcacaaguauaaucaaaacauuacaaacagauauuuuaggaccaguaacucuuuccaccucaccuuuuagaauaugauuaugugugcaaaaaauggagaaaaaaugcaucggaaaugaaaguagugcuuugugagcgauuuuaaaguguuuauuuuuauuuauuuuaaaacgucuuuuuaaaguauuuauuauuaacuauuuuguaaguauuuuuaaguuggguacuaaugagaacaaaaauaagauuauuuaaacauauuuuauguggcaauauaauuuaaugucaaaaugcagauaacauauuugcaguacgugaguuguaaugaaaagaaaaugcccguaauuuugcuacuuagcacagccagguaucaugggugcccuaggauuagccuucauuuuccugcuccugaaaacugacuauuauggaguguugcuuacgaaugguugaggaucgcuagccacugaaauaccucuuuaaccaguauugugugggaaaaauuaaugugucuagguggccagcuuccgaagagaaaaugcucucaaagauaaauguuagacuaacccuuaaguauguuuaaggucauuucacuccccagagaaacauguuucagaaagcauaacggaaauuaacgggaaauauaaaucucuauaaaucaacauuuuacacauaguuuuacagaaugccaucaaaagcauagaguacauaauuaauuucuuaaguauuucauucaaaaaauuuagugucuuauauucuaggcauuguaagcacaaacgaugcaguaguacauaaaacuagagaucuaucuaucuaucuaucuaucuaucuaucuaucuaucucugucugucgucuuucuggcucucugucucuauagcuaucuaaacuuugugugagagggcucacacaagcaaccaaaaagcugaugguaagccaaguguugugagcgcuggaauacauuaaagcauaauauaaggaggagaagaauuaugggcggcggggaaaaagggaguucagauuuuuaucuauaagaugaucagggaaauggccugauugguggauauauuuagguauagacauaaaaggaggaaggaaaguggauaguucuaggcacagguagaauaugccuagcaagaagaagaguagaacacaaugagaucagagaggaaauacgggaucccagaccauguuagacuuauaggaggcauuguauaaccuguggcuuuuauuaugagugagacagaaaauaauuggagggcuuugacagaaaacaauuagagggcuuugaguagagaagagacacaaugugucucuaauauugaaugauuauuuuagcuaguagauugagcauagauuauucauggguucaaggcagaagaagagaaaacagguagcaaguuauugcaauaauuuagguaagagaaaauggcuugcccaauggugguagugcaaaaguaauuagauucuagacauaucuugaaggcagagacaacauauauuuugauuaguuauuuuuuauaugacagggaaaguaaggagugaagggaaaaaaaugacugacuccaauauuuuugaccaaagcuaaaagguuggaauugucaguuaaugagauggggaacuggaacaaagaggcuuuuggggaauuggaaggauuuucauuuuuagugcauuuagugcauucuccauuugagaauuuacaucacugaaguggagaaaaugaagucuggauuugaaaauguggaguuugggaaacaguucugaguaaagguaucuauguauuuuuuuccucagaauauaaauaauauuuagagccaugaugcugagugagaucaccuaaagagugauuuacauagagaaguuugagaaagaaaaucugaggcgcucuaauuuuuagaggaaaagaaguuccagccaaugagacaguaaagaaguggauagggaagggguuccagaggccaagcaaaaguauuccagaaaaaaaggacaacuguguuaaauguuucugauagguccauaaaugaggaaugugaauugacuguuggacugagccaugugaaaaccauugguaacacugacaagacauauuuugauagaguagugagcacaaaagcuaaacuugagguguucaaaacauaauugcagcaggaaacaguacagacagugaguauaaaaaauaacucuccaggagaucuaccaaaagacgugcagagaaauaggcaggaacucaacuagccugucagaucgagauuccuuuuuuuuauucuuauuugaaaggaaaaauaacagcauguuauuaugacgauggaagugauagaguagaaagguaaaaucgagaaacagaaaaaagaagagacaauugcuguguugacaucuggaguuuaugaaugggauggugcccagacagcagaaacagcccauuuaauucaauggucgugaaacacagugagacaagucaucaaaguugcauguuuuucuccagccugacuuaguugccuccaugauuaaacagaguaggcagggacuggauuuggugugagcugagguuuauccaagugagugugacugaagagaggagcaugcguaugccuggaaguuuaaaggaggugaaacaguuaugaccuuguaaggcugcaguguucuucagaggagaaacaggagccaaaagaugcaugugacucuaggagaagagguucggaguagagaggauuuugcugauuguuauaauuuuagcaauuuugugagaugcuauuucauaguuuaauuaaugcugucauguuuauuauuuuauuguacccacauuaauaaaaauaacaacguaaaauuuaaauuauaguauauuuucuccacaauguugaucuaauuauuuauguccaacuuuagaacucaauccaaaaagcaguauccccagaaauguccauaaugucggagucaaaauaaguuguguuucuuuuguaaauugugaaauaacauugcuaaauauaacuaagguucugggaagacaaaggauuagugaaacagugcaugaguauuauguaaagcaccaagaaagggcaaauauuacauuuauauauacuucuauauauaaaacuuauacaugugccuguguaugugugugcgugucaaaauaauuaagccauauaauuuaugcuugugguuaugcucaauguauucauuuuuuuaaaauugccauuauggacucucagguauuuauuuuauuucuaaagccaacaaugagauuauucucuguggauacgugaccagaggugacaugcucacggauauuauagcagaugaucguauuauaguaaagcacacuaaauaaccuuuacacucucauccaaaucuacaauucuaugauuuugauuuaugccaacaacggccaccaaacuauaaugauaaugaugauaaaagaccagugaugaucaaugccaugccuccuaugaaguucuauccagaacauaaacuccuuaauaagaauacagugcucucccgugcugcaauaacauuuuucuucaucuuccucuaaagggauguaugccuuuuuuccugguuauuuuugaaaguaucuuggaugguaaugugaauucauucaaccucaacauuuauuuacgguuacugacacccuacauauuaggcaguggggaugaaaauaauagcugacuuuuuggaacaguuucaucacaguaggcagugccaagggcuuucuuugcauuauuccauuuaacccucacaauguccuuaugaaauaugauaucauuucaaucagcauuucacaaaugaggaaacagagauauaaagaguuuaagucacuugccuaaggucacaaaagaaaugauauugcucacuuucgaauccaugcugucuggccccugaaccuguagucucuaaacuacuguuauagugaugaauaaaaccaccauggcucacauuagccccucaacaauuucucucucucucucucucucucucucucucucucucucucucucugucucccuucuaucucucucuuucuuggaggcugggggggugaauguggccaaaaauucuuugaaagaacucuuuuuggguaauaauguaggcacauuuauuaaaaaguggugguguuuagggcuuagccucaucagcucauaaccuaugcacucuucuaaucacgauguuucugauugcuaauuauuuccucuucuccuauuacuguuuccucucauuauuacacagccuuuucaucaccugacauugugcuucuggguguccuuguaccaauucacuccaccucagcuugucauaaagcaguugguuuccucuuaucacucauccauuugauaugucuugcagaauuaucuaaccaaguuuccacaugauauuguuacauucuauuuacugaauguaacagugacugaaaaucuauguggauagacugacuauagacauauauagcagaauuuauaugauuauuaguuauagaugucugcuccggagcaugcugcuauauugacacaugaucucaagcaaaauauauuggccuacuacuaauuuauccacagcuucuaaucaucuuagauaauccauugacaacuuucagugcuacaauaucaguaaaaugauuuucuuucauguaucagugauaguaaauuugcuuuauauaaaggccucagcaacuaccauuuacaccuggacaaguuaaaaagugugacuauaacucaacaucaaauagaacacuaaagaucaacuauaccucaggaauagcuguugaaaaccagguucgagcccuagcuguccagaaacaacuuugauuuauguauaugaaauuaagauacugcucuaccaucaagcagcauuauaggaaaauuauauauacuuagggagacuagauuuaguaagcaaguauuuuggaugucuuugauguuaugguaacaggugguaauuuagggaaugcuugcuuggcagguguccugaauauaggcaauuuugcagcuuaaugaguauauuuccaccuacuguuucaagaauugcuccugccagaggcuaugagaaauuguauaagauauugaaauuuaucauguucugucauuuuagacugugaauuagugggccacuggagguauaagcuuuaaguucuucaaaucuuucugaaaauauaauauuccucuuaaggaauaauggucaugaucaacauaauuccauguauucauacuauuauauauuuuucccacguaccuuccuuauacauuuauauaacucaauaacuagauuauuaguaucuuuggaggaugauuugaggcaugugacaauguuagaaccuuguaaaauucaguuucaaggaacacuagugaugaaauaauauauagaguauguuucuugauaacacgggucuauaaucaauuuaugaaauuuuuaugccaaguaauauccuuguuaugcuacugagagugauuauauaaucugaauaugcugcaauccauuuuucugaugugcuggagccaacccacacagugguugagagcuuauaauuaaauaucaggaaguuucaagccagugguuaaacauauccaucauuaaaaauuggauuuuacuaugacuuauguccucgaguuuauucacagcuaucauauauggaugguaaagauaugaugaugugucacuacacaccucuuccuaacuccagggucagcguugucauguugguaauuaggcaucugucaugguggguguauuuauaucauaaaaaucagcaaacacuacaaauugguauuuuuaauauuuuuugagagccagucauuaaauauuuaucaguauaugauugccugugaggcaugacauaucuucucuucauuuauuaugaguaggugagaugagaggacgcaaaauuacagaggauugguaauuuauuuuuaaagcaucucggaaccaccauggcuccugaaaagguuggcguaagauuuucucaacaguuaacaccaugaaagaaauucacuuuuuauguaauuuguguacaaaucaccuccuaaaagccagaugauuuguaaguuuuugagacaaaaaagaaaacaaaaaguuuaauguauuuacucaaugauccaaauauaccaaaauguauauuggguuauagggagucacauuuaugaaaaguguguguguguguguguguguguaaacacuaguaagaaaaucaguuauagaauaaaguaauagacgugcaaacaccaaauagagcuguaagauccuagaagagauaaugauuaccaagccaggcucaucuggaaaagccuggaaggcuacauauggaacaugacaagauggauuauuguaucaaauaacauuagaacuggacgguaguuaaggcaauagaaacagauucuauucaguauuauugcaauaggguaaaagggaccucagaacagaacuggguucaauuccugauacagcaugaaugagggggaauuacagccaaaaagcacgaugugagucaguggauggaaaauuacuuagaagaaacauuagaaguaaggaggaauucuguuuaaacuaaccuaugaggauucuugcugaagacaggccagggucaucagauaucauucccuucacaucaccuggaggauaguggaggguggggaacccaauuagauauugauggugaucagauaugaagcaugggagaaccuggcuaaacuaacucugcaagagucuugcuaaaauuaaaccaacucugcaagauucuuacugcaauuagacaaugcacacaaacacaggcgucuaaaagucaggccuaguugaaaaagaguucagggaagccugauuggaguuuggucaagaagaaaaccuuuuuucaguugagauuaauaaaacuucaaaggagaaauaaggagggaugagcauugcaaaugagaaauagcaugagcagagauacagaggugggggagcauuaauagagagguaccaauugauugugacuguuuugcacaauccaaaacauuuaaugaguacuugccacauuccaaguacugaucuuuguucugugaagaaaccaggaagcuucagggcugagauggcagugguggagggagugacgcugaggacugacagguuuaaaagcacaaaaauagaguucugaauuuaagaacggggcuaagauucuuuucucagaugcauguuuuuacauuuauacguguuucucuucuucauucaacccucuuuccugaucccuucuccauccccuuagugggagcuccaggaacaugaagggcugguucaacaugaaccauauaugcaagccaacugcccccuucuucacuggaaucuggucacuaacggacuggucuagcuuagggguucacccgggguuggaagcaauaaccaagcucucaggugggaagacuuucaggguaucaccagucagggauaaauaauaauaauaauauuaauaauaauaauaauaaacauaguaaacaggguaacuauaccccugcaagggacagagaaagaugaaguuggagguuuuggccuguggaagggagcagucuuggucuggauuacuaugguuuaugagagauguaccugacagcaauaacuuaagcauaccccgagaacgacccuguauggcagacauaccugaaagcaauaacaacuuaagaaaugaauuguuaaccuggagguugcuaaggagagggugcuaagugaaaaugcuacauaaacugcaugcaguuugcaagcuguagcgguucuguccagccugccaccacuggacugucccguauguccccaucaaauaaaccccauguuucauucacuggcugugggucucuucuccucacucuugaaccugggaccauccuuauugaaguuaauaggugucugguacaauauauggauauuuuugccuugaaugguaaauugcagucuuuccucauuuugaucuagaagaugauuuuuuugaacuugagguugaauuccuacauugguucugaucuguucacaauaauauuucuuuaucagaaaguaggaaucuggaggauuuucauguaugaggaguaaucucuggaaugacuggauucuuaggaauuggagcgacacauggcuuauaacuacagugcagagacugugucacauacauccacaaauaauacagcuucucaguagacucuggagcaggcaggaaagcaggcaggcauacagugcaguguguaguaacuuugggaccaucugguccacaggcaguaaugccagcacuaaccaaauaucuaaaggggacacuuccaccacugccuuguccagaucuucuuugcauuucucauuuuucugguuuagggagacucuuuucucauagauauucuccuccugaagaccauaugccacagagauccucaucucagaaugaaccuucucuguaggaaccugggaggcuaccaagccacagagauuuuccauccuacugaacagagcuggcacuggcuuuguuuuuuccauccagguuucaugacagccggauuuggauuggcauaauuggcaaaaacagacauccuaggcucaggagcugaagcucuuucuucucuuggucauggcaaaugggucagaggaaaugaaaaaugacucuuuuggcuuugauaacugauggauggugauacucugaauuaacacagagaauacuggaggagaaggauauugaaaaggagaagucuuauccuaaauuuaauuugaggcagguuaaguuucagaggaauucagagcaucuuugaguaaagaucagcaaagaaaaugcagaaacaggacucaggcaggacuggaauuauagauccagagcauuuuaugauaggugaugcugucagaguaguggacaucacccacaaagaauuagauggacacaaagaagauaaaagcauaacuuggggaacacuucaucacaaauauugcauugggaaaaagaagccaauaaaauagauagugacauugcauucagaaugaauguugacaauggaugcaggguuucuucuaccuaauaaacugaauguaaaaaucaugcuaacugcucuacagucuccucauugacacucauauauggcagcugaauaagugguguuugaucaagauuuuauugauagacugcuaaaauuucacaucuauuuucauacucagguauucuuggcuauuuucucaauuauuuuacauuucucaauuauuauuccacauuuaccacccauuuugacccuuuaaaugucacaaccaauuucuuugaagaaccuauuguuuucuucugugguuaaggccucauuguaugggaguacaggcugaguaucccucauccgaaaugcuugggacaaaaaguguuucagauuuuggaauauuuguauauacauaauuaaauaucuuggggauugaauucaaguauaaacauagaaaucauuuaugcuuuauauauaccauauacacacagccugaagguaauuuuauguaacacuuuaaauaauuugugcaugaaacaaagcuuguauacauugcaccaucagaaagcagaggcaucacuaucucagccacaccuguggacuguuuucucugugguuguuuucucucacuaucauuccugacucugaauuuauaugcuaccaauaagcaagcauuuucuuaugcuuagucacaugucagaacuuaacaguaaaaaaaucuaacauaccauuaauauaagaaaaaacaauguguccaggauaacugacuaacacaguagcaucaccagaauaccuguaucagcuguuaaagaacagcaacaaucaagaauggcaagcuuucagucucugccuaccaugcugugugauaccauuugugggcgugauugcauggggaaaccugggcaugcacagaaacauaucacagcucagggaggcugagagaaucucuuugucuuuggggaugcugaauaaaugguguguugugcaucuguguuuuaacuucggccuaucacacaagguccaguguggaauuuuccacuugugaugucaugguggcacucaaauaguuuuggauuuggaagcauuuugaauuucagauuuuuggauuagguaugcucaaccuguacugucauuaagaguuggaggguggaguuuucuuucauuaauuaaaaacauaauuucauauucuauugacuuugauaggagcuguguaauaauggaggguggacaggcaugaucauugucauuaaaaacuugcagucuacuucgggagauaaacauucaucaaaaaaauucucacugauguugaaauuguguguuaugaauaauaauauguaucauauuagagcagacauuccugauaacuaaauauuugaauugaguuuuaaaugaaaaauagaagucagcuggguaaccugcauaaagugggaagcauuccgcauuccuuguagaagaaacaacuuguggcaugacccuguagugccuucuggaaacaaaacaaaacaaacgaacaaacagaaaagucaauguggugggaacaaaaugugagaagacaacgaagccggaaagcuaauaugaaccuguucuucuuuccuccuggcacacagcuaaaauucauuccuccguagacagagucagaagacugaguucuggccaaaguaaugugagugaaaggggcucaggcuuuuucuacaaaagcucaugaaaaucucuuuugugcucuauucuauucuuucucuuccugguauacuauguggaugcagaggaaccaaaggaaaacucugcuuccucuaucauguggagggugccuucugcaaaccaggaacacacauuuuuaaucucacuugaauaacacauaaacuuacauugcaacauuccauuauauauuugggggcuuuuuuuuuuauacucuacauucugggauacaugugcagaacgugcagguuuguuacauaaguauacacgugccauggugguuugcugcacucaucaauccaucaucugcauuagguauuucuccuaauacuaucccuccccuaucccccaaaccccaacaggccccaaugugugauguuccccucccuguguccauguguucucacuguucaacucccaguuaugagugagaacaugcaguguuuaguuuucuguuccuguguuaguuugcugagaaugauaguuugcagcuucuuccaugucccugcaaaggacaugaacucauccuuuuuuauggcugcauaguauuccaugguguacacgugccacauuuucuuuauccagucuauuacugaugggcauuuggguugguuccaagucuuugcuauugugaauagugcugcaauaaacguacaugugcaugugucuuugaggcuuguuuuuuauagcagugaguguuuuaguauaccuuguuuuuuauaguaagccuaccuacacuccacuuuguauaguaagccuaccuacacuccacuuucaauagcauucuuacagcaauaaugcucauacuguuuuauaaaacauuccaaaagcuuucuagaaauggaaugggggaacuugugaguaugugaaauaaguaacaagaaauguuuaaggaaauguucuguggcuaucuaaggaugcuaaggaaaaggaaagacagugaaugaggugaccuguaauaauuauagugacaugaaauuuuaacuuuuuuuuuauaacugaaauguaaagcaguuuaauauugcagauccuuuccaaauauuauagacagcagcuaaaauauaucagaucacuaaauaauugugaucuuacaucaauuucuauaaaaagagcucagaagauuguugguucaaaauuucauaugugggccaggcacaguggcucacaccuguaaccccagcauuuugggaggcacaggccggccgauagcuugagcccacaaguuggaaaccagccugggcaacagggcaaaauccuaccucuaccaacauuuuuaaaaaauagccaggugugguggcauacacucguagucccagcuacucaggaggcuaagguacgaagaucaccugagcuuggggaggucgagacugcaaugagcagugauaaugccacugcaccucagccugauugacagaguaaauuuaaaaaaaaaaaaauacauauaauaagcuguaauuucacaccugugguauauuuuguuuuguuuaaagacuguauuuuaauuuaauaaauauauuuugaaaugacagaaaaauauuuuaaaaaguuguaucucagucuacacaugaagauuuaguuuucaguauuccaaagaucauguaauggaauuaauuacaauuuccaaauuuauaaacuaaagaagaagugcugcucucuuaugaauucccacucuaaauucauuaauuuaagauauaugugggcuuuguacuuuaaaguugaagaaaauucagaauacuuaaccucauccuuaaucaaaguguaauaaauuacaaaccacaccaaaaucucuaccuacugaaaacuucugaaggugggagagaguauagagccuacagcugacucccuacaauauucuauauggcaacgugaauccauagcaggcuuaauguaaagcaucuauuuucuaauaccauugacauuuacacacacacacacacacacacacacauacacacacgguuuguuugaaaauuaaucaucaggccgggcgcaguggcucacaccuguaaucccagcacuuuaggaggcugaggugggcagaucaccugaggucaggaguucaagacuagccuggccaacauggugaaacccccaucucuacuaaacauaaaaauuagccaggcaugguggcgugcaccuguaauccggaggcuacucaggaggcugaggcaggagaaucgcuugaacaugggagguggagguugcagugagcugagaucaugacauugcacucuagccuggcugauuagggcaaaauuccgucucaaaaaaaaaugaaaaagaaaauuaaucaccagauguauauuaaucaaacacacacaaacuugcagacauauauauuaccaucauacgugcauauaaauaacaaugacauuuguauguguguguuuguggugguauuccaaauaugugcuuauaaaucacacuaaaaugugauuaaaaggugaugacguggagauacuucgguguuuggaaucauacacagcugagagccaagcugcagcccuacaccuagucuuuaaaaauuagacuuauguccuucuuaggggaccccacuccucaguuccucacugagcuaucaggauuacaugaaguugauaaaagauaucggagaggcuguacaaaugagaaaaauaaguuuuguaccuccaaggagcugacagucuaguagaaaauauguacagcuaauaauuaauggccauauauuauaauaggugcuaauaaaaaggcaggcccauguauacacaggccccaagaaaggaacggccuggcaauaucaucacaggcaugcacccagacaccuuuugugguaucaagucugguggcagcagaaagcaaacuggaagaaauaguucucaucauaugacuuuaaaauguaaaacuauaaaugaagagcaaugaguuuguuaaaaaaaaaaaaauaaaacaaugcucauguuuggugguaccauaauauuuaauaagaaauauuuaagaaugaucgugucauucuuauuguugcuuuaaaaaagucuagcacauuucaaaauaagauuuuguucauagcaaaaaugacccugacaauuauuuuuugaagagacugugcucuugcuggcaaaacagugcacacucauuaacaguuaggcuggcuaagauccagccgggucaaaugcugauuaauuagcucaucugauugucagaggaaaaacccuuccucauaugaacugucaccaacuuugaaauuucucaucaaagguccuuaaaguuaccaaacugcacuuauaaugguuuucugucuacuauuuuguuguaaauguguguguguuaguuaauacauaugugugcauguuuaugugugugugauuaauauacaucugaugguuaauuaccuuuggugaacccuaacaaacucuauaugugugggggaguguguguguauguguguguaaaugucaaugguagaaaacagaugcuuuauguuaagccuaauauuaauucacuuugcuauguagaauauuguagggagucagcuguaggcucuauacucucuccuaccuuuagaaguuuucaguagguagagauuuuggugggguuuguaauuuauuacacuuugauuaaggaugaggcuaaguauucugaauuuuccuuaaauauuaaaguuacaaagaaaggccacauguaucuuaaauuaaugaauuuagagugggaauucauaagaaagcagcacuucuuuaguuuauaaauuuggaaauuuuauuuaauuccauuaaaugauguuuggaauacugcaaacuaaaucuuaauguguagacccagauacauuuuaaaauauuauuuuucugucauuucaauauauauuuauuaaagcauauuguuuaagcaaaauaaaauauaccacaggugugaaauuacagcuuguaauuuugcuuuguuuucuuuuguuuguuuuguuuuguuguuguuguuuuuuugagacagggccucacuuugucacccaggcuggaguucaguggcaucaucaugguucacugcaaccuccaccucucaagcacaaguaauccuccuacuucagccuccugaguagcugggacuauaggugcacacgaccaccccaauucuuuguuuuucucucuucuuucucucucucucucauuccuucccucccucccuccuuccuuccuucccuccccuucuuucccuuucuuucuuuccuuucuuucuuuccuucuuucuuuuucuuucuuucuucuuucuuuccuuccuuccuuccuucuuucguacagaugaguuuuagccauguucuaaauuucuaggccuauuuugauaacucgucaauuuuauuuuuaauagguaacucugaauucuuaaaauaacuugacacucauaggagaauaauguaacaaagucauauauaggaaauuaguuuaucuuuucagauaaacuuaccuaacuauguuguaaagcauuugcacaaguuuuucauuuuauuccauuaccuuauuuaaggcucgggugcugaaaaugggaaugauagagagcaaagauacucagguuuaggccgggugcgguagcucacaccuguaaucccagcacuuugggaggcggagguggguggaucacgaggucaggagaucgaaacccuccuggacaacauggugaaaccuggucucuacuaaaaauacaaaaauuagccaggugugguggcaugugccuguaaucccagcuacucgggagacugaggcaggaaaauggcuugaaccagggagucagagguugcagugagccgagaucgugccacugcacuccagucuggcgauagagugggacuccgaaaaaacaaaacaaaacaaaacaaaacaaaacaaaacaaaacaccaagauacucaacuuugggccaauaauuuuaggaccaccaacauauugugauucaacgcaugaacugaauuggcucagaugggacuuaugcuuugguuuccuucuuuggugugaaggaauagggccccaaacagguuaaauauaggugucacuuugaugccucaucagugcccuacuauuauucaaaauuuaacucuaauauuuuugaguaucauucccuucuucauacagugauacauaagaaucugacccagccuacaaccccaaaagugacccuaaggauaaucccauaaccuuugcaauaauugguuuaagaacauuggccaauaggcccuuggcuuucuccuagccauuaggauugcuucagaagugagcacggucaggccacugagacacaggggaaauguaggggcagggccggcuucuggaagaaaaagcuuccuuacuacaacaagagagcuuauggaaauaaugcacucucuucugaugaaugauguagugcgaggaugugaauguagauuucuguaacuagccaacauaaaagggguaccccaaagacaacaagcaaauaaaggaaugcaccacuguggaaaggaaaguggacuccuuaaaucaaucaugacuguuuccccagcucauguuccaaauuaugucagcaaauaaauuuccuaguuguuuaagcuagacuuaagugggguuuccauuacuugcagcuaaagguacccuucugacaguuuuccuaugcgcuaggcacucuauuagcauugacugaauucuuucggugcaaugaugauuguccacauuauacagauaagaaaacugaagcucggggugucauaugguaguaucaguguaacauggaagaacccauaauuuuaaacaauguuuguuguuuguuuguuuguuuuccugacucuaaagccuaggagugaaauuguuuuacuuugaaaaauaacauuuaacaaauuauuucagucuccuuauguuaguacuuuucaugauuuauuaguaauguugaaauauuuugucuugaagaaauagauaugaaaacuugggcugcuaggccuaaugaugccuuauaaaucuagauuuauaaucuacaucagggacaaauauacaauacccauacacuugccuacaagagaaguggcauucaaaaaugcauucauaaaaaaggaacucaaucccaaaucguuauguaaaaccagcucuaguacaaggagaguguuauacaacuguguauaaauauggcucacaauaucuuuaggguauuuuucuaaauugaauuucaaaggguuauaucauuuauaugaaauagcauauaugaauaaagcauagagcuaaggucaugcaaaaguaaugcuaaaggaaacugauauuuauauaaauugcauuacacuuaacaauggaaaaauaaaaauguaacaagaccuauauuaaucuugucaccucaauguuuuauaagaacugauuuaaacuauguauuuuuucaauuauuuuauaagcgaucucuuguucugaguuucuuacauuugucuuaaaaauagcugcaaugguguguuaaaaagcuaagcccaaaccuucccugauccaccuccccuccuuuggugaugaggaaucugugagccgucguugccuuccuucucccuucagauucucaugcucaacuucauucccuccucaacccacagacaucucagguuuucccucacugggguuugaaaacugauugaacuacaaucaaguaauucaagugguguuuccaacagcugccuccauccacugugccucgcuucccuuucuuucaugagacguucucuuuccuucacuuccaggacccuacacuccucccaguauuucuccuggauauuuuuggucacuuucucagauugcugucuucuccauccuucaauacaagauccucaaagcuauguucuaaguuuucuuuucuuucuauuagacauuucccaccuaagcagugacucugucggcucccacacuaugguugucaucacauuccaaaggcucucauggggauaacgcauuucugcaacauacuacaagauaaccaucuccaagauauuaaaacauagggaacaaaaugccauaguguugccucguuaucuauuaaugaguauuauauauuaaauauuauagauauauuaauacggcuauauuuaauauuuauacuuaauaucauaaauauauuaauauuauauuuauauuuauagaucagagugaggauacuaacgagcugcucaguauuuagaaaagugauaaugaaagcaaaaaaaauuucuuuuccuuuuuagagauagggaagguucauugugccuuauucuuuaaccuaaauauacuaggugaaaucuaugaaaauagaaacacauucagagugaucuggucucugcauugcuuggguuaauuuuugccaauauucuaguaguaccuuugugcuguuacucacucugcauaaggcuuucuagaguuguccaugugaaaaaccucuugaucacaaaucaacaccugcaauuccaagugucugaccuugugacuuucaaaucagggcuugcguuauaaaucacuguuuauuuucccucccgguagcaucuuaauaucuauggcacgucccuuauuaucagcaguuauagcauucucuaggaugauagccuaugucuuuggggugucuucuaaggcugcccaaagugaauuuaaaugaugauauaaccucuauuuuaacucaggucaccccaaaauauccucuugagaaaacccaaccaguuguuuuuguguaauauagcacaguaacagaaagagauaaaugugugauucuauaugcaugcaaacgacaaaaacagaugugaaaauauaaucucaaagccuuuggaaaguuacacuugauuuugcuauggggaaaccuuuucuugaagucacccacuccagacuagacuuuuucugugaugguagauugauuacccauuaacuugugaugguagauugauuacccauuaacuuucacuagaguucuagaaagggcuucuuuagagggaacagaaaucuuauuuuuucuuauugccagaucacucuuuuguucuucacuguugccauagucauuauuguauuacagcuauuuaugcauaugaccacauuucuagauuguaaacuccucguggucagaauauccuuaucuuaucaauucucacugcaucauuuugggcaauaagaaaaaaaagcauugacaaaauuucuaguugaguuuagacaaugcuacuauuauuuggcaaucaacuuggaagcaugauuuccucuguaccuuagcauccuguucaacaacaaaaauguaugauuaaaguagcuuaaaacauaaauuucauucuaauuuuauaugaaaaaugucucuaaguaaaauaaaauuggauuauucaaauaauccuuuuuuuuuuugcuaaaaauggccaucauuuucuuguuuauuauaauacauuacauugaguguugaccuuugauaaccauuuuacaaaauuauguuggauuaaugcaucugauauuuuuguaaccuaaauuuucuccuuuuucucucagcauaggucacuuucaauauucuauccgcaguuaaaauauuauuguuuucauaaaauuucaauucuaaaccuaauuuguauaaucuuggaaagcucagcuacugcuauuauaauuuaucauuuuauuucauugguauaacacugaagcauugcauauuauugcaauauaacaaaauaaaauaaaguaucuuaggagauggcugauucugaccuuucuaucaccuguuggagaaaggcauuucuugcauauaauaaccuguaggaaaaugcuaaaucuuucuggaaacauacauuuuagucacuuaggcaauggaggccuuauaacucaagaauaauuuaccauucugaagaugagucuagauuuccaccaauucuuggguccguauguuuuguggcauugauuaaacacagaagguguguuugucaaucagccuuuccuugaaagguuuaaaguugcuuaagacccagaauuuuagccuucaucaugauucagucauauuguucugaauuauguaauauuugacaagugguucuaucagcugaauuaauuuuucaauugucucuaauugccuuuuauuucuuggggugauuuuucacacaaauuugaggugagagugucgcuuggccaaauguaucuaaacaucccauuuauucagcauuuauuaacuacccacugcuauuuuccaggcacagacugaccuagguaauggggauaaagcuuugaugaaaacguacaaaauauccagcuuaccuugagcuuacauuuuaauaauauuuaucacaaaacaaaucagcaauucuaacauuuccuaaauaugaucucaauugacaagcauucuucauuacaagcacuuaauaaagcaaacaucauauauuaagacgaaacauacacuuacaggagugugggccaggaaagaagaaauaaugaaauaggcagaaaauaguuugggcuuugagcucagaaaaaugugguuuguuucuaauuugcuuccauauauuuagaucuugccgaaguacuuacuaaaucucuugaaucuuuuuuuuuuuuuuaauuggggauaauaccucauuuguuuucagaguuguucugaggauucuguaauuguagaaaauauuuucuuuuacaauguagcaauuaaucaagguaauaauaguuauauaaagguguggucacugcccuacuuucacuaacaaaaacuuuaaauuaucauuugagaugcaaacuucaauaaaaaacaaacaagucauacaacgcauguuacuuucaacaaacaagucacauaauucugguuaucuagguaaaguaugaaauugauaguuauggauaaaauuccccuguuaaauuucuaccacugcagaauuauucuauacauuaauaaaccagaaaagcuauauaugauuauuuaggguuuaauaaaaaagucaugcugucuuuuuaacugcuuacugaaaauacaugccuuaagcauaggaaauauaauugguuaggugaggggaaagaguguguuugggggugaauuuugagcuugcugccuugguuggaucuaaaauuguagaaucaugagcuucuacaagcagcaaguaagagucaggaaauaggaucagaaagagguuuaagagaacguggguuaaaagugaaagggguuauucucugcaauauuauguacacuaagaaacuucaaggcaagcuguuauuuucacauaaauaccuuuacauuauaugacacugaggcaccaaaacuuacaucuuauuuucuacucaaugucguuuguauuuuugguuguuuguuagauucaugugaggggguggaaauuaaacagcuugugccuaggguaauuuuuagucuuuuccuggaaccaaauuugugaaaugaugaaugaugaacuacauaucuuucaaugagugagucucuagcgggcagucagcagcaaacagagcacccguuagacugaugugaaagcuuaagugaagguuaacagucuguucaauuuacggagcuuucuggaggguugcaaacacuauugaccauaacguuaacuucucagugggcuggcauuuuggcacacaaagaggucugaggcacuuccuauuauaacauucucauuagucaauggagcgugguguauaggugucuauauuaucaucaauacaauccaucuuuaagauuucuaauggcuguuugcuuauuuagguuuauagauccuaucauaucuuuccucuauagagcucagaaaggaauggaauuuugagaaguagcuguuugagacuuaauuaaaaaaauacuuguuuagaaaauauuuaacaacaacaaaaaaaauugagagggaaucagauauuggcuauguaccuucccaagugaaauguaucaagacccgaaauuucucuguuggaucaaauauguaaugaaaucaucuagggagagugauuuuauaucacuauggacagaccuuuuuucccagcaaaaacauauuuaguagacaaauaaauaaacacaaaguaaaauacgucagcuacaauuuuggagacccaagucucaaggaauugcccaucuguuuuacauuguuaaaaaauauuuaaaggacuuuuucaucuggaaaauaauaggaagcauacuauugaaaauagaaauaauugaaaggggaguuaauggagcagggauuuaaaaaaaaucugacuuaauucacauuuacuaacugucuacagcgaguaacaaacccacaguuauaagugcauaacaugugguaaggaguauaaguuuugaaguucauauccuggagcuuagaacuuacagguuagaugauguugaacagauucacuucuuugaaucuuuaauuuucucauuuauaaagcagagauaaaaugaaguuugggagauauuuauaaaagacagcacauagaaaaugccaacuuauaguaauuauucaagaaaauauaguagaaauaaauuuuaaguacucugaauguacuguaaccucuuacggaaucccuucuuuucaaaauagcacaaucuaacuuaaaacaauuaacuaccucauuugaaaaauaaacagcauauaauauucuuauguauguuaguuaagguuguguuuuucuggagcugaggaugaacaacaugcaugugucuaagacgcagguacaagauucuagcaacagacauuguauaauaagaaauuaaauauugagugcuucaaauguucucugagcaaaauugaauacagacucacuaauuaacacuuggagaaguacagauuuacuaguggcuccaggcaaaacuaccaucucacucaauuaagauuacacaguuuaauuucacguuguuggguuuacuuucugguacuuggaaaauauauuauaacuuagaaauauuauuuaaugggcaaaaauaacuuagcgauacuuuaaaacugugaaaaguagucaguauuaaagaaauuaggaacaaauaacuaauuuuauuagaauaauuaauaaccaggcauagaaaauuaaaaugauugucuauggagacuaguuggaugaugacuucuaugcugcaacaacuuugaccuggguuucuacucccacuacuuaccauacccaggucucuguaucuauacacauguccuuaucucucccaagcaauccugagucaaaaaaugaaaacaaaaugacugacuuuucaaacucuucacuuuuuuucacuuucuuuuuuucaaacucuucacuuuucaaaagccaucaaaaaugaacaugcuugauuuuuacuuguauucuuuauaauuaaaaaugaaauuaaauauuaauguguuuaaauuugugcauuuuuaaugagcaaaggaaauugcuuuacaaauauugaucuuguuuauggccuuuauguagauauucaagaguuuuauuuuuauacuaagcuuuuuuuguauguuauucacagagaaauccacuuuuuuuaaguugaaaauuuucuugauucccugaauacguauuuuaaaauuaaucacgaaacaaaaaaaauuuaaaagucuaauuagaugaaaacugugauagcuuguuuaaaucuacauguuggauucuugauaauuauuaccacuauuuuguucuacagucacaguagaagugcuuuaaauuuugaacuucuuaaaaaauaaaaauuagauuuuugaggaaaugcagcacauauuuuuaaaggaauguguauguuuguaaacguaggcaaaucucuguagaaggaagcucuaaaucuagucucagcacuuaggcaaaaacuuaacugccaauaaaagagaagucacagauaccuaccucuuuaccccugugcagaacaauauuuuuguuuuuaucuuuauuaacuaaauacuguuuuuaacuagcaaaagcauuacuaaauuccuuccauagucuucacuuuaaauauuaaauaaaaauaauguaauaagaauuuauuauauuaggcuaaucuaauucagcaaucuaaguuagauacaaaauuucaaauuugcaaaaaugaaugauggcaggugauaagauuaucaaauaauagguaauauuucuuaaauuuagaaauucugaaugaaagccugauuguaaugauguaucauguguaguuauuaugguggagcccucaccacucuuaggaguuaggcauuuuaucaaucaucuacauauaguguuacaccuaaaaauaauuacaacagagaauucauucacugaauccgugaaacuagaaaaauggucaugauccaucgagauagauaugaauguacuauuuuacaaaaucaucucuagaacuuuccugauuaugaggaaaugguaaagagaaauucuaaggccucaguuccucauuucccucaacagaaauguaggaaagucuuccccaauuuucugaccugggaguuuaccaacuugaucagcacuuguaucagaggaaaggugacaaaacggugaguuacugccuaaaauaucacaauuggagccauaaucaagaagcacaagaacuccagcguuuuuagagacaggggaggaggacuccugaaguaccccucugaccugccuugaggcucaaagccaaccccacugugacuccugcucacacucuggguucuucuccaugggcucucccaagggcacuggggguuacauaaauuugagcuguuguacaauguccauaucuaccccaauaaaacacauauccccuaaaaguguggaagauguaagcugguugggaaaauucucuuuuaaaauaagcuuuccucuagaaagcacuuuccaacguuuaaagucuauuaaauaaugguucaggauaaaacucuaauggcaaccuuuaaagaaaacccaacaaaucuuaucaccguaucacaugggagucacaugucccaaauuauccauucaugaucucacuucuggauccuuuuaguauguuaacaaggccauauauucagugacaguauacaguucuucacugucaugggcucccacugaaaauuacaaacagauguugguugcuuucaggccagaugccagcacaucagcagguguugaagccuauuuauuuguacacagaauaugcugcagccuugaaucaccauuaagguguaucuucaccuccucccauauucacucccucucuccuuucuuuuccuuuuucguaagccuuucgguagacaagauuuaagccauuucaguuauuauugauauuuguggguuacaauggcccaaaacagauugccaaaauuaacugccauguggcugcuaggaaguugcauucuuauauuuuucuaccaaguuuagaaagauuuuaucgccuuagagacauugguaauaaaauuguguuacauuucuuucaaacuuuguucccacugacaacauauuucaguuuuaaaaguuggcaaucuggccuuuuccaccaguauuaaaauucccucaaagaaaagucaccacuccuguuucacuugcuuuaauaacuuuaauauaguaauagacaaguuuaaaugggauguacuuaaauauacaaauguaaugauuggaucagcccuaaguauuuaauuuuuaaaaaucuauuccccaauaauuacaauuaauuacaaguaaauauuuacuaaaaaguguuagcuuuuuaaaaaauuccucuaggcugggcaugguggcucaagccuguaaucccagcacuuugggaggcugaggcggguggaucacaaggucaagaguuugagaccagccuggccaauaugaugaaacccugucucuacuaagaauacaaaaauuagccgggcgugguggugcacgccuguaaucucagcuacucaggaggcugaggcaggagaauugcuugaacccaggaggcagagguugcagugagcugagaucacaccacugcacuccacccugggcgacagaaaaaaaaguucuucugacauaccaggguguaaauguaucacuagagcuuaaaugaacaguuauuguauaggcuaaggcuuuugggguucuaacuuuuuaauguaagccacuagccuuuugucaaaacuuaucaaucucugacacaaaaauguaugaggggaaacaagagggggaaaaaggaagaaagaaaggcagugugcaaacuugcuuggcaaccugaugcuucagaauaggauuuggagcccacggguagccaccucugguaguggggauaaaagucuagcaauugugucaaucaguaggucauuaucuacuguucccacuccuuucaaaaaaugaagaagaaaguaagaaagaaaaagagagacaaaauuagauucuguuuucacauacauuuuauaagaaacuguguuguauuuuuggguuugcuuguuuguuuguuuguuuuuugagauggagucucgcucugucaccaggcuggagugcaguggugcgaucuuggcucacagcaaccuccgccucccagguucaagcaauucuccugccucagccucccgaguagcuaggacuacaggcacgcacgagaacucccagcuaauuguugcauuuuuaguagagacggagucucaccauguuggccagaauggucuugaucucuugaccucauuauucacccaccucagccucccaaagugcugggauuauaggcuugagccaccacaccuggccuaauuguuuuguauguaugaaccaguugguauuaauuaauauugcaugccugacuuaaaacaauuuaacuuuaugucaaaaauggaauuguuagauaauuuugcucuaugugugcgugaacguguguguaugguaauaaaacaaaacaaaaaccaauacaacucaucacagaauucuaugaagaaaaaugcguguuauuuuuguuuuguuuuguuuuguuuuaaagaacagagaagugaagggauuaaggagaaauacucuaaaaucauggaaucccaggauuggaaugacauuuagacauggucuuuaucuccagacucgaauccugucaagcacgccucauaggacagguaucucuuccuuccucuuagcauguuccagugagccucuauuucuuguuaaauggcguauccagaaacaaaguuuccagauacaaacaauuaagacaacauaauaacaucuaauguuauugaaauaaaccacauuuuuuaugugccagauaauauaacaugcauuuuuuuacaccuaucucauuuaauccacuuaacaauccuauuuaacaaaauaagaaaaacccuaugaagaaaagauuuaauugacaaacacuuacuuaggaaacugaccaagaacacauagcuaaugucagagccuggauuuacacacaaaaaauuugacacuaaaggcucaggaacgcaaaauccucacacugugcuguugcaagcuugauaaguaaaaauaacugacuccucuuugugugcacugccgcuaaaucauucuuaggucuuuaugcagguguccuuuuccaaucaaauguaggacagcacauuuaaacacuauucaauaugauauuuuaaaauuucucagagcgcuugauaugcuugaguugugcuuugggucauaauucugucaggcaauguuucugucaucccuccagcucuccagaguucuuuguccaaucaccaaaaccaaaaacaacaaaaggccaggcgcaguggcucccaccuguaaugcuagcacuuuggaaggucgaggcaggcagaucacgaggucaggagaucaagaccauccuggccaacguggugaaacccugucucuacuaaaaauacaaaacuuagcuaggcaugguggcgugcacugguagucccagcuacuugggaggcugaggcaggagaaucacuugaaccugggaggcagaggcugcagugagccgagauugugccacugcacuccagccuggagacagagcgagacucugucucaaaaaauaaaaaggaccaaccaaacaaaaaacuuaggagagcacaucugugugucuuuuucuaaagcacuguacgaaauggagaaaucgaaggacccaaagagacgcauaacacuugauauuuaccccuaaguugacauuauauauuaauauuuguugggugcuccuccaucauucaucuuuuuccagcuuaucuacacaaguuucacagaaacccauaucaccaguuuguuaaacaauccuuucuuucuuuuccauacauaguucuuuuucugcuuguuccaacuuucauuuuaccccugacacuaacuccaguuauacaaaccacauuuuuauagaauaucguuacuuuuguccaaggucacaaggaaaaaaacaaauguacuauaucuuggggaauucaacacauaaaaucaugccauccuuuaucuacuuuuuuaugauauugcuuuucauacuguuuuaucuaacauagugccauuauaguuuugacaaccauaauggcaacauauuacuuuaaaaauguuauugaaacuccccuggcuuuggagaauauguucauguccuccuuguccccugcccgcugggaacauugggauguccauaguaugggcaaauaugcgcacuuuccuguuacuugacugaugguuuucucagcuuuauucauguuucauaguuuugguuaauagcaauguaacccauuaugaaagaucaaguaaagaaaaugaaggaaguaaauaguuuauccaaagaaagacaucccuaagucugagacuguaaagaaaaaagauaggagacccagucuucaaacucaggaggcauugcuuucuuucccagggauuuucaauguccuuuccuuggauguuuuuagggauuacaaaaaaaaaaaaaaaaaaaagacaacagaaauauagagaaaacagauuuucugcucaaauacguuuuggcagcucuagguuaagaggucuagacuaaauaauccucuggacuuuuugacuuuucauaaaccuuaaaaugugaaugugaauuugaguuuuaauauucaagacugcaauagaguacuuagugucuuuaaauucaaagaacccuagaauauauuuuuccaagcaacccacagaacucacguuuuauugaaaagauuuuuggccaggugcgguggcucacaccuguaaucccggcacuucgggaggccgagguggggggaucaucugaggucgggauggccaaaacggugaaacccugucucuacuaaaaauacaaaaaauuagcugggugugguggcgggcgccuguaaucccagcuacucgggaaccugagaugggagaaucacuugaaccugggagucggagguugcagugagccgaggucaugccacugcauuccagccugggccacagauugagacugcgucucaaaaaaaaaaaaaaagaaagaaaagaaaaguuuuuaaauguuuaaaugccuaugcaacaacacuaucgccugcagaacucgauguagaauggacauuuagaaauauuucaaugcaucuuuguuuuguuucaaaauuaauagguugacauaugaaaauugcaugggauggagaggcugguauagagcucagagcuagacaaaaaucauaacuuuuugaaaacuaccucccaaauaaaaguccuauaaacuauuaaugauaugcaagguaauuuucuaguaccugaaaugaaagcaaaacaaaaauguuuauucaauuuuuugguggcguuaaaguugaccucugauaaaaauauuuucacauaaaauauuuuuaucugaaaacauagcauuauacuagauaauaauuauguaaaauaaucauucauucaagaaauauuuuaucaaauguucccuguaucugagcagaguggagauccccuauuauaauacuucccauuacaguuugcaauccuuuccacagcucauauacagucugccaacaguauuauuuugaguacaccaugaauuauaucuucuuaaaaacagacacuuaacuaaaaagucuaauagagccgaugagucaaaacagauuccagaauauucagaagacaucuuuuucagguuuauaagaaaauaucuccuugcauucuuuauuacaacacagaaauguaucuaucucuuaauuaaagaaaaugauuuucuaaacaucuggaaacaucacuagauuuauuuuuagguaaguggaaccuaaguauuuucuuauuauuuggcuaaaugcuaauaaguuagcuaaaauauuacuucaguauuuugugacuaaauucucauuuauuaccuaaguguuucauuucuuauuucaaaguuuuggcuauauucaaaauguuuaauuauuaauauauuuuauuauuaaauacuaaucauugcugauaggaaauuacauuuuguucuaauaucauuauuauuacucuucauacaacaucaguucuuacaugucaugucaacauacagaaucuaaaaugauaaucuggauuuauaaccuauagcauauauagacaauuucauauaggauuucaccuucacuuuccaaccuuuagaauuugaagaggaaaauguuaaaugugcacauuuauuaugaaaaucaucaaccauuauuaguuuacuuagagauauaccugcuucaauuuuuagaugucacauaaaaaugucuaaggccuaauauucauuuuguccuuaguacaggaaaaaauucuggauuaaaaaaugauauuuaaugagcacagaugcagauagcaauuauuugauaccagauuaagcauuaccuccgcacaagcauccccaaaauuuagaauagugggaccaaaauaucaaaacagaccguucaaaaaugccuacucacuguauucuguucuguuagagaaaguuauauauuacauuauccaguguuugcuggugagcaaauuacuccuugauaaucaaagguaaagagaaaaaaaaaaaugggcugugucuacagaccagugcauuaaagcacuucagguuucaucauggaauuuuuuucuguaguaauaagguguauuuauguacaaacagugcugaaauagggcaaagagaacuccaauagcuaauaucagaaugaauuagagaaaaagcacauuucuuguccuugcaaaucaguagagugacuugcacaccuucaucugucuuuggaaggaaaaagauauauacacguagccccugaaauaggccuugggagcucaugcauuuaacuacugucagauccauagaaagcuacaauggcuuuucauaaaauauuuaaauauacacuugugaggccaucucauuaacaaaucuugacacugucuugucagguagggaaguuauaacaauguagauaaaauugcacgugacacugucuuguaggaaacucuuuugaccaucuaccuaccugaauaggaauuuugccuuuuuuuccuguaguauuauucacaaggagcagcacacaugcuuuuugcccuugucugugagcuuugaaguugucagucagcuuugggcuacccuaccuggagcaacucaguuuccacugaauuuaugaaaaugaaaauuauugcaguauuuuucaaaaagaacuauaauaccauagaggugcugagcuaauaaucagagcguuggaaaggauuaacuuacuuuacuggaaaagaaacacucaaauuuuuaugagaauauccaugaggaauauaucaggagcuaguccuucuuucuuuucacucaagauaaaguuugaaaugugaaauauauguaauugggcauggaauaaacagaaagauucccauggugaagauagcacaaagaauuucacugugaugacuuccaacauuagaaguaaccacagagaggccgggcgcggcggcucacgccuguaaucccaacacuuugggaggccgaggagggcggaucacgaagucaggaggagaucgagaccauccuggcuaacgcggugaaaccccgucuguacuaaaaauacaaaaaauuagccgggcgugguggugggcgccuguagucccagcuacuugggaggcugaggcaggagaauggcgugaacccgggaggcagcccuugcggugagccaagauugcgccacugcacuccagccugggcgacagagcgagacuccuucucaaaaaguaaauaaauaaauaaauaauuaaaaauaaaaaaaauaaaaagaaguaaccacagagaaaaaacaagaugggaacuugugauuugcgugacuuugggacacccauagauaaucucauuuaauccaaacagucacaccuugggauaaauauuaauacgauauuacuccauuaaguuuaggaaguaaauugcuauugucauacagcuggaaacaugggaaccagguuucaaacacaagucuguuuggcuucaaagcccaacaucuuuccucuacaguauuuggaaagaguuuuuccaaguaguacacugguuaaaaguugguuucugucuaccaaaaaucaguagaaucuguaaaaccucuccugaggaagagguacagaaaccaugauuuuuugaaucaagaaucuguaugcagacuucacaagaaugcagcaaaauaagagaaagauuuuaaaccugcauaauuuagaguagaacauaggaacaaauauuguuagagcaauagaagcaagcauaguuuaugaaaaaguguuuuuaaaauuugaacauuaagcaaugaaagagguugauaauccuauacgaucaguaaauuaacgacaauauaaagaaacugcuccuuuguauuaacaaaauagguggacuaaaaugucuaccucucugcaggaaauuaagagaauaacagaaaaaggaugaggagaaacagacaagaacacagccagagauacugccuuauccagaucugacuaaaguuuuuguugcuacccuaauuaggaacuuuuaauaguagauuacguaugcuguucauagugugguuucagccuuucaucaauccuucuguuaucucuacuguaucuuuuggaaagcccgaagucaaaagaaaacauuugggucugcuugacauggguggaucuauccaaucaccucuguaaucaagaugcuggugcccuggcugaucauacuaugugccaacauaggucagaaucuaggugcuaauuggauuaagguauacacauuucuugaaauaaaauauuauaguuuucuacauugucaaauuugaaaaacacuuuaauauauaaaaaauguuuuucgagacaccauccuggcuaacacagugaaaccccgucucuacuaaaaauacaaaauauuagccaggcgugguggcgggcgccuguagucccagcuacucaggaggcugaggcaggagaauggccugaacccgggaggcggagcuugcagugagccgagaucgcgccacugcacuccagccugggagacugagcgagacuccgucccccaaaaaaaguuuuaaguuaaaauuauaucuguuugaauuaagcuaaguuuuaaaccacauggcacuaauaagacuguuuuuaaaaguuaaaguaccaauuuaguggguuuucugauaugugcuugacacuacuuagaauaaccaggaaagaaaauauagcuugauaauuuagugcaacaacaaauuuaaguaaaacuaaauuauaucaaaguauaauucuacuuuaaaguuuuucaucaaaugcaaugaagauagguaaacuauaaucuaauaauuaagacuauauagauuuuuacuaucauaauuucaaauauaauuaaauugauugauuuucaaaucugacuacauuuauuguuuuagaaaauugcuuugaagguauucauauagucuacuaauuguuccuuuuauuuaacaugugauccuuuaagauuaaaaaaagggacaacauauauuauuauuaugugacauuuuaaaaauaacuuuuguugauaaagaaugcaguaugccaaggcagacaaaaaaugaauuccuguauugggcuauuccugacacauucuuaucauucuagugucuaguguuguuccuauacuguuuauuacagaaggguggcagaagucuguucucaauuucauuuuugucaugcaauuuuauuaucuauucacaacuauacaguaugauuacaucccaucacuuaaaccaggaaauaacuaagguugcugucuauaguuuccuguguaguucuagucaguugcuaugaaaguagaagccauaaguucauuaaaaaauaaaaaauaaauaaguaaauaaauacaaugagguauguaugugugucagaggauggauauuuuucuuuuagcuguuaucuccaacacaaaaguccaaaagaauccuuauacuaugaagaccuuucuaggaucauagaaaaauaaauuugcaggaggaaggguuauaauccaacuagguuacuuguaaaucuuguaaauagucuacuuuuccuuuuuuuuaauuuuaauuuuaauuuuuauuuuuauuuuuauuuuugagacggagucuugcucugucgcccaggcuggagugcaguggugcgaucucggcccacugcaaccuccgccucccggguucaagcaauucuccugccucagccuccccaguagcugggacuacaggcgccugccaccacgcccagcuaauuuguuuuguaauuuuaguagagacgggguuucaccaugcuggucagccugaccucgugauccgcccgccucagccucccaaagugguaaauauucuacuuuuuuaguggaaucuuccaagauaaaagcgcuuccacuaaaagucuaaaaauuugagaaauaauuuucaaagaaaaaauuacuaugagaugccuuuuauuuucguaugaaauaacaaaauaccuagccacuugcuucauggaaauugaaagauaaaucuucauuaaaaauaugaaaggucaucuccccuuaggagaauuccaguugugacuuggauagcauuuauugcuaugcauucacucucauuaaaacgacgaugcuaucuuaaggaagacuaaagcugcuaguucaaggacugcagcacccagcuggaauaacaaagcugauguucaccucccagagccuacaccagcaacaggcaaccugccuggugggggucuggcccacugugccucaauugcaaagaggcugcagccauuacagagucacugugugaucugccggugaauaugcaugagaagcuaauuuggaggauucagugaaaaguaaguguuuugaugaggaagacugaaauaacaagaagggaggagugaggaaaugggauaaauauaccauaauccuugauuacucugcaaauauagcaggcaugagaguuuaucuuuuccuuaaagcuugcaguuuuauuuccuuucauauuugaaguauggcaugggccacugggagaaaggagucaaaaccacucacaucguuuauucuaaauagaaaaugaacagcucaugugcagacuucuucuaacaacuuuaaaaaucauuguguaugccuacauuucgaagggauguuuuuuguagcaacaaacuuucuaauuuaccuguagaacacaagugguuuucugcaucuaaucagucuuauucacuagcuuuccacugauuuucaauuuuucaaaaagcaaaucacuucaaacagaauaaaaaagcguagcaaugugaguuccuuacccccauauauuuauuaucucugaaacugugguacuauuucauuaacucuaacauggacugcacuuaacggaucccuggaaaggaucccuggaaagggaucuguuauuuaacauuaacaaaaaaaaaauggcuaugaauauacuuucaggugaacagaauaaaugccuaaagaggaguacuuauuuuuuucuuuuuaauugaauuucucuaaauuauaccaauagucaaaauugaaaauguguacucagcacaugaauaaguagaucuauacaauuucuuacaaaagauuuuccuuguauaagcuguaccucucagaaaccuuggaaguauauaucuugcccuuaaugucguguguguguguguguauguguguguguguuuaacuuuacaaaugucuaacucuaguauuuaacaaagcagaaaaggcaauuugaauuuagugaaaauaauaagccuuagagugaaaggaaaaagcagacugaaauauuauaguaggagaaacacuagauuagaaaucagaagaccuaaguuuaggcuuuggguaaacuccuagccacgugaucuugagcagucacuuaacuucuagaugcucaguuucuuaucuauagaauauguauaauaagagaucauacuuugcuuaugggguucuuaggaguaucaaauucaaugauauauguaaacauauuuuguaaacuacuaaguacuauaaacugaauaaaguuagaaaugagaaggaaagaaagaagaucuaaaucuaauaaaagacaaucagacugugaaaaucuaccaauaauccauuacuccuuauguuguggacagccaaaaaaugaguuccucaaauaaaauugaaguaagcuauucuaaauauauguuuauacauauuuuuaauuuuuaaauaauaugcuacauuuauauauuauauauacuauauaauauuacauguugcauuauauaauauuuauuugcaaacuacauuauauaauguauauuuguuauauaauauacaacucuaauauauaauuauauaugauauaugaaacauauauaaaauuuguauauuaaguacuuacucugugccagaaaauaucuaguuuaauggucauagcuacccucucuguaacucaaccgacagagauauagauacagauaaggaaauaaagguguagagaaauuaauuauuugccuaagguaauauugagaguacagaguugaacaggacuucaaccacaggucuugacucuuaugcacuaagcaauguugccucucuaaaauaucaagagguaacauaucauuauuagccccuacuuuuguccauguagauggucucuguguucccaagauacuuuucuucugggaaauuguacauuuacuucuaugaaauguuaacagaacuucuaaauaucagccagaacuuccuuucugauuaguugauuaaauaauaagaacuuggaucuccagccuugccuacugguagauguguagaauuuacagaauauggguauuugacuuauacauuaaugcuggacaugagaggggaaauacaagaaucucagcaauaucucugggcccaagauguuguaaggcaagaucaccagguaguaucuccaugggcaaacaucucugaaugaauuagggagacaauguuccauuuauugguugacuguuacuaucuuuccugacaagucauccacagcuuauaaagggaauugauaauguggguuuguggcugaaaugaaagauucugugaagggcaaagugguguaaccucuauaagcuuuucucaaaacuaauuccuuuuaacuggucuuaagauauugcauugccuguucucaugaugcuagcagacaccguaagaucaagaaguuuacuuaaauucugugaaccaaacaggucucuggcuguacuauacuauauuaggacuccaggaaaaccaagacuacuaagaauguuuccagguaccagcaacugguaguaaauaaauauugacuagaucauuucuaugugucaauuucuauaacaugcucucuggaggauacugagaaaguagacagcauguuuugucucuggggucugaggauaggcaguauuaauaauaccauaaguugagucucuaaguucccaaacgagaaagguaaaagcugggauaguucaauaguguaaugguuuggaagucuucuuugaauauguggcucucaguuagccuuaaaggaugauuaauaucuaaaggacagaaaaaaaaaugagaccuuccagccaugaggaaaugcaagaauauaguugcagaauugacagcauuggucauauuuaaggaacaacaacgaaacaaaacauuuggcugugacagagggucuguguugcccaggguauuccugcaaacuuaacugcaaaguuaaucaguucacuuccguauuuucuuuuagagucacauaagaaugauuuaaaauucugugugugcaacuagcuauguaaccuuggacaaguugauuucucuaaacuuuaaucugugucuguaauauuagagcacuuucucacaaacuaggggaguaugugugugugauucuauauauacaaaaccuaauagagugucugcuguguaguuuaggcgucugcauguuauauuuaaauaauaauaaauacaauagcaggcuugaauuaaauccucccuaauuugaaguuuuaguuucaaucaauugauugaauuguaaaauuccuuuuugauuaaauaaaaaaaccuagaaauuuaaauucaauuuuagccauagauuuagugaaaaauauauuuuggaaacuguauuuuuuguuucauuaucauaaaaaugaaagcuaaugaccauauaauuugacugagguuucaaggacaugcacaguagcguuaaacauaauuuaauuaauuuuaaaucauaguugccauuaaguguugagacaaagcccagucuuaauaaauuuaaucaauauuucuuuaaagccagaauauugcuacaacauuuuagcauuuauuauguauuugccuuaaaaugcgucauguuguuccuugcucaauuuaaguuugguuuaucaaguacacauucuguaaauuaacauguauguuuucuauauuugguauuuaaaauugaaaggcuaaccuuuuuaauuuuuuagcacaaguuuuaauuaauggaagacuagaaucuuauuuuuaaaacauacccuaucaauaaaaugagaaauuuuuuuaaaaauauaaguaaaauuuauuuuaauaucauuuucccaaaaagaaaaacucauaucuaaaacaaaucuauuauaauguaaaaguauuuuauaucaaaucuauuaaacagccagagcaguuuuauaacuaauucaagucaucuguuuaaguggucaguggaaauaagaguggugauuuagaaacaaguuaaggagauucaaaaauguuuuugggccgggugcagcggcucaugcuguaaucccagcaguuugggaggccaaggcaggaggauugcuugagcccaggaauuugagaccagccugggcaacauugugaaaccccaucucuaaaaaaauauaaaaaauagcugaauaugguggugugugacugugguuccagcuacucaggaggcugaagugagaggaucacuugagcccggggagguugaugcugcagugagccaugauugcaucacuguauuaugaccugggcaacauagccagaaacugucucaaaaacaauaaacaacgacaacaaaaauuuguaggaauaaauuuuauuuuuaaaaguugccggaauuucauaucauuuucaccacuaguaucauugacuguggaggaggaggucauugugauuuuguggaguuucuucauuuuuuguuuugagacaagguuuggcucugucacccagucugagugcagugguucaaucacugcucacuucagcauggaacucccuaggucaagcgacgcucccgccucagccucccaaguagguaggacuauaggugugugccaccacgcccugcuaauuuuuuuuucuaaaaaauggagagacagggucucauuauguugccuaggcuggucuggaacuccugggcucaagugauucaccugcacuggcuuuccaaaguguugggauuacaggugugagccacuguacccgaccuuauuguaauuuguuucagaagaauaucucuauucugaccugugugccauacuuuuguaauggccccuuuuauauaugcuggccagucagguaaauucugguuguacaauuuagauauuaccuuugggggugguugaaaagucuuauugaccuagaggggguaguuccucuucuauugucuucuacacaauuuucuaucauuaaagaaaauauggaagggaaauguagaaggcacucuuaaggauggucaagacaaccuggacgaugaugggcaauuucuuucuaccuuugacauuauaaugcagacauguuuuuaaaaauguuugugauuguguguuuauaauauauaauugacacuagaguugugagcuuaaggaagguuucacugaauuccuuauguaaugaaggcuggaauuguuccagcauucaguaaauuaauuucaucaggaacuguucugauaagacaaccaugagaaauaagucaaggucccuugaauugaaaugaaagaggaagaccaauagaugaucagauaaugacagaagaguauguugaagcuuuggaauagagagaaguacuagaugcggcuggagauaggcaauggaaguggcugacauuuucuugguuagaaaaagacaaagggaaggucaggaacuucucuuuaaagaugucaaacgucacucuauaaauaugaaaacugacauauucucacucuacucacuugacacaaaaguaucaucucuuucuccuacucuaauauggcaggauucugaagggaauuuagggaugaucagcuagaguagggcuuagguugauagcugugcauaguaaagcuggagaaauaauuagccauguaugaaaugcuuauaagaaacucuuagccaaauauauauauauacacacacacauacacacauauauauacacauauaacacacauauuuauauauacacacacguguauacacacacauauacacauacauauauacacacauauauauguauauaaacauauauguauauacaccaucauaauaaauaaccuggcuuuuuuaaaccucuaaugauugacaguaauuuauauaauuuuauuuguacuggcacaaacucaucggcauuaaaaagaacccaucaagcaggacacuuauuuaacacacuuuccaccugccugcaccuugacuugguggacucaagauagaaucagauagcaaucuaauuacccugcaaaggaauucagugaugggaagugagauuaauauaauaaccaaauucuggcuagaauuuacugcagugucugcuacuauuuuauuagaaaaugauuacguuucugcaagcaaauaaaaguguuuuaacuggugaaagauaauuauucauuuuaaauacagaaaaaauggcuaaaauuauaauuugugggaagagaugacaugacaaagguauagauauguaaauguguguggguguguaggaaggagacgggcauuuaauuuccauguauuuaauguaauugugucauuuuuuuuguauguaauuuaaaugacaacagcauucaucaaauaaaacuuauuuauccaaagcaaaaugaaguggucuuugacauugcauaaaacaaggagaauggaugauuagcaaugggcugaaaucuauccaaaauaugauugaaauaaauaucaaacuuaugauauucaaaaaauauucuguuauacaggcacuuuccacaauaauuuauaaaugccuuauucauaggaaauaaaauaauucgauuuuucuguuucuuuuuauuuuuauuuuauuuauuuauuuauuugagacagaguguugcucuguugccaggcuggagugcaguggcgugaucucggcucccugcauccuccgcacucccggguucaagugauucuccugccucagccucccgaguagcugggacuacagccacacgccaacacacccaguuaauuuuuauauuuuuaguacagacgagguuucaccacguuagccaggauagucucuaucucuugaauucgugagcugcccaccucggccucucaaggugcugggauuacaggcaugagccaccacaccuggccaaauuaauauuauuuuaauugauaaauuauauacauuuaugggguacaaugugauauauauguguguguguguguauguauauauacauaucacacaaugugaaaugauggucagguauuugaaaccuacucucuuaguuauuuugaaauacucaauauguuauuauugacuauagucauccugcugugcaguagaucucaaaauauauuccuccugcccaacucaaacuuuguuguuuguuauauuuuuaaaaacuuuauuuuaaaugcauauuaguuuuaugggacaguuggcaaaucuuugaaaaacucguacaauaaacauacugcagaaauugucaggauuugagaugccaaucaaaaucccacacucaggcaacagagaugaaucuuguagacauugugcuaagugaaauaagccagacacggaacaaauacuacaugguaccacuuaggugaugaaucugaaguaguuaauagaagcagagaguggaaugguaguugccaggggugggaucaggagagauaugggagaagauaguguuaguuaaagaauacaaaguuugguuuuccaagaugaauaagucuuagagauacaguauccaccuugaguuaacaauacggugcugugugcuuaaaaauuugcuaagaauguaccucuuauauuaaauguucuuauuucccccccaaaaaaaucauaauaauaauaaauaaauaaaaaggaagaaggaaacuuuugaaguugauggauaggguuaugacagauuguggugauggcuucaaggguccauacuuaucuccaacuuuguugaguuggauacauuaaauauguaaaguuuuuauaugucaaucauacccaaauaaagugguuaaaaaaaaaguacaugccagaugucguucuuauaauccaucagcuaugcugauuccuaauaaccuucaaaauuuucauuaucaucaugcagaggggcaaugauuucucauuacugaaauguuucaugagugacauaaaacauguggacuugcuaagauaccacguggggccucugucaugugcacaacaugucccagcaccuagagugucacuuccacucuucaccccggugccucaggcuaugaauguccacaaguccuaugagcaaccucuuccagaagaugcuuuggccugauuccagcuacaagguaaccagguccugcuaacagaaaacugucaugucugucuaagugaaacugucaugcccggaguuugucacaguacuaaaaaacacaaagguugagacuuaauuaaacuuacaggguagauuguauuacauuuucuguuucauugcuaauaaguguuugaaaauguuguagaauuugauuguuguguuuuuacccucauuuuaacaugagaugauagugugaucaggaaauaaaacuauaacucucaccucuaacaaaaggcuaccaaaggauaucaaaaauaaauguaucaauuguaaacaacaaaauuaaauuagcucaauuugcaaccuagacaaucacacacagggagcauacaaauauucugguuugccuaauuagugaguuagaaaaugguuaaucagucaauaaagaagcacuggguacuggcaagucuccuagacugaauauuaagacacguaggaucaaguuuuauucucaucugauuugagccaauggaaauuucucauaaggcuuuuaacuuucugagaauucuaaccuguaugacuuacugggccucuuaucagcccugaaagucuuuaauucuauacauuuuaccaaagaaguuugguauaugcacuuaacuguauacucuaauagacaauagaauuaauuauaaaggcacaacuuuucuggaaagaccuuagagaauacagugagguucaccugcuauguuuccuuccauugguucuaauaacgaacaccaaaaaaaugaucauuagcgguuuauaauaguuuuccacaccuccagccugggaggguaacaauauaguacauacugccccugucuucuuaguccucuccuuuuaaaaauuccugucuuauccucuccauaguuucuuugccuucauaaucuaaauaucgggagugaguuuaguccacaauccuucccuuacagcugauggcacuguugggagaagagucagaaagcauguauaccaaucaaauagaucauuuggaaaauaaucauuauuacguacaacugcauuaauuuaaauuguauguugcuuggaaaucuguuuugucgguuguaaggugaugcuuauaugccuacuccaauucuuaauauauguacaacuuuaaaaggguuauuucucuguguguuuaaucaaccagaauaaucugaaaagaaccugggcuuauagagcaauaucccucagggcuaaagcuccuauauuucucuuccauguggaauuaacuguacuggaagccaaucccuuucaccaaggcaagggagauuuacuaaauagugccagcucaccaaaggucagauuucacuaacucuuuucauucuuaugcuguccucucugccccuguaaauauuacacuuuguuuccuaaauaaaccauggcagccauucuuauggguaauguuuguuucaaggaaacaucaguuucagugaaaugauuagaauuuucaauaaucuugucuucucuauaugaguuuuucucacuggaucuucuuaacuguccuaguauuucugucuuucuucuuuuguuccuggagguguuaugaucagaauauuagggacagaaaaguagaagaaaguaaaacaaagagaagaaggggaauuaacaguuauuaggcaccuaucauaauacgcuguucugcaugauuuacaugcguuauguuauuaccccuccuaucagaacugugagguaaauauuauuuuccccauuuuaucucacuuaaaacaaggugagauuaagcaauucauccaaagucacacagcuaccaagaggcagauccagaagccaagaccaugucugucugggaugcaauccccuauacuuccugugguguuuugcugcccucuccuuauucuaaguacuuuuaaggaauacaguaguuuuagguuacacuaguauuuuucaaagcaaguuuuaauuacuacuugagaaaaaaaaagacugacauuauacaauagaaaaaaguauaaccaugaaauauuccauuucuuuguguauuuguugaaagaauauuuguuggaauccaauaaacguugcugauaaaauauugcuauguaacaaaauaauuagacauugcuauuuaaugaaguuuauuaagaauuacagguguggaaaccugcucucuuuuuugagaguggauuguaugcuaggcacugagcuucagcuuuacagacauuaaucacuuaaucuuuguaacacuucuguuagaagagucuauaaccaucacuuuuacaagaaaaaaaauguguauguuggagaaguuagacauguucuuccaggucacccaauauuaauuggcagagccaagguuuguacucaguccuucugaugccaaaggcucuguuuuucuaccacacaaucaacuuucccucagaugugguaccacuugcucacccaaacacguuuuuuggaugguaauuucauuaaacauaauauuguuuuguagucuuuuauuguucucuaaauguuuacauauauaaguguaccucuccuacagucuacaaucucccucauggcuucuuuuuugugaauuagguguugaaaagugauagauaucgcauagauagauagauagauagauagauagauagauagauagauagacagacagaugauacagaguagauuacauauagauggauaaaucgauaaauagaugagauagaagauuagauauauaauucaguaaauagaugauacauaauagaugguagauagauggauagaauaaaagauuagauuagauagauaauagauaaagucuuauguuagucuaaugcaugacuuaauuaauguuaaucuaaagcaaagguuucuuuucaagguaggggugagauggugugggaaggugggucuggaauugcugauguagcaguugucacacugcaucuuuagcuuuucaggugacuguaccagugcucuuugaaggagaaagaaaaugggaaagagggacuuaugaauggagaggucugugccauucacuccacaaugccugcugagcaauagaggaggcugagcugcugagggaagaguaagaaaccuguaguaagaggaucaagauuucauccacuaucucuuauuuggcaaauaaguuaaccucucuuuaccccauuuucuuuauuuggaaaaugggacaaauaauacguaaguagaucucaggaugauuaugagguucagugagaaaaaaggaggugaaaugcaacuuauggacacucaagugcuauauaugugcaauuuccccauuuucacccuggcuaacgccuauuuuguuaaaaaggucuugcuggcucuuacgcugccuuaccucggagacucugugcagugcacaccaccugccugggcagcugucuguggucgguacccugcacaccgaguuuacagugaauaauagcaagagcugguagcacggccagccugugagcuguguccacugcucugcagaaaagcaaauaagucaaacaaacacuccucagaaagccaaaaaucuuuuaaacauuauaccauccuucaucuccauguacaauauaacacaacaaacuaagagagaauagaggagauuucagaaaaaaauaugugggacuuuugaggaauuuguagaggaaagacauacaaauggcuaagcauauaauuuuuuaaaaaaaguauuacaauucucuuaauaugaaggauugcaaaaaaauaguuaccaaaaauguguugauauggguuuuaauuauuauggagcaaaauauuuuuaagacaacuuauuuugaaauccacaugaacccaaucuaaggguuugaggcugaaaaaugauuuccacacaaaagacaaauacugucguuagaagcuauaaaaaugaguauuuuuuuaggggcuucagaucucacuaguucaaguuaaagcacuggcagagcuauaugccgagacaggaggucagaaggcggccucaaaugguuccagcaaggcuccaguuguuuguagauacuuuuuggccuuagauucaacguuaguuacacugcauucucaucagcuugagggauaugaaucgguguuaauacagauaucugaccaacaaauggaaugcccaaaagaacaacuuuuuaacuguuuuauauggggcuguguguguguucaaacauuucaaguauuuauuucaaccaaaggcacaauaauaauguucaugucaguaaaaaagaaaaaaucacaucauuuuauauucaccuauuaaagccagcacuuguggaaaacuaugccggucaugaguacgcagacagcauaauucucacuucuauuauggaagugagaagagcucacacuuacguaugaauguauuuuuuuuuuaagaaacaaaaccucaacauuuuuagaauguuccauugaaauguucacuaugugauauagcaacuuuuaaaaauauauuugcauaguaaucuuuguauaauauccuacauuggauuaauuuuaauuuucuuucaaauguaaaugaaauuguuaguccaacuuuuaugaauaccaauuauuuccuugaagagaaugcaaauuggccuuuccuaucuaaaaauagauaaaaagugcaucuaauaaagucccuucuaaauuuuaaaugugaauaauuaggaugaauuauaggaaaaacacuuaucuauuuuauuuaauuuugucuugguauauaucuaacacuaaacaucaagugagaaacauucagaacaaauaaagguaccgauagaaacuaauuaguauuuacuucaguacuuuuaauuugauauucucagagcucaaaagaacaauccaauauauagauuauauaagaaauaaaagaauggaguuuucuauagacuucuucuauguuaugauucaagaauagacauaaauauauguucuagcauuucaaauauaauuagaauuauuucaaauauugucauaauuucauauauucauguauuugacaaauguuuacugaguaccuauuauguaucagauacugacauaucaggggauauaacagugaacagaagagacuaaaauacaugucucaaagagcuuucucuccaguagagagaaaguaauauucacaauuauuaucaaaaaccacaaauacuuugcaccaaauuaauaacauaguacaauugggaauaugaaaaaguuuuggagagaagggguaaaauuuuagacagugcggcaaaguaagccuuuacuggaaaguggccuuuggaaugaagauaggaagggagugaagggaauuagggagucagacaugcauuuaucugaggaaagacuuuucaggcugagugcauugcauguauguacaaugucgggagaaugccaggauguucauaaagcaaggggaccaugugacuaaaggagagagcagaggggaagagucaaaacagaugaaggcagggagauaaugggggcacaaaccaagaggggucucauacauuacaauaagugcauuugauuuuaacucuaagagagaaggaaagucguuagggggaggaaagaaagaaggaaagucguuagaggagggaagugcuguaaucugacuuaaauuaacaggaucuuucuggcuaccauauuguggguaggagcaaaaacaggaauuuaaaggugugccguaauaauccaggugagaaaaauccaaugguagcuuaaauuugguugguuagaagugaucgaacccagaauauauuuugaaaguagugugaaguuaaugcguuaggucuaagagagaaacugagaagagacaaugauagcaccaagauuuuugagcugcaaaacgaaaagaaugaaauuguauugagucagagaaaacugaggaaggaacuguugcagguggggaauuuucucuaggauucauuugucagaagaauaacuuuauuauaauauuuuucagaaucuuauuguuucugacgugugggaagaaaacuuuauacaauaguauuuaggcaugauaaagcuauaaugaauauauaauaauaguugcaacuuugcuuaaaauacuucaguauuucuucauggcuguuagaauggugugaauuccacagaguauuauaggacccuucaugagcccagcuuauaucaguugcauuuuuuaucuauuuccagugacauauauaaauauauuuuuuucauuaugucagcaaucuguaguugaaauugaggagauuguaucuuacucaucacauacauuaaaaugauuacaucauaugagcugaauaacucagaacuaaucaaugcagucucguucucugaaaagguggggagaaauggaaggagaaggaaaagagggaagaaaagagaugggaagaaggagaaaaauaagcuuuguuuauggucauaugcugcccaccacaaaagcuugcucaggagcuggacucuguacaaaugugguccugcgguauaaaucauacauagaccagaaaauaaauaacacuacuuauauaacaagagauaaggcauggguuucuuucauucauuuuuuuagugucuuuuggccucuuauucuuuuuuuuaauuauacuuuaaguuuuaggguacguucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaccaucauucucagcaaacuaucgcaaggacaaaaaaccaaacaccacauguucucacucauaggugggaauugaacaauaagaacacauggacacaggaaggggaacaucacacacuggggccuguugugggguggagggagggggaagggacagcauuaggagauauaccuaauguuaaaugacgaguuggugggugcagcacaccaacauggcacauuuugaaacugaaaucauuugacucugagcaggacguucguacuauaugguguaaacauccaccagaauuuccuuauaccagcuucucuugacuccaaacauauucauuaugaucacaugugccuuacuaagacucuacugccaucuuauugccccuuggugaagaaucuaaaauauuuacguuaccaaaucacacuuuccaccaucuacaaauuuucccgcaaucaugccugucaacaugguauuauucuuauuuuuucccuccugcuuauaaaccucuccucccugucugggccuuaguguauuccagauucucuucaggugucacuucauucaugaagcauccccugaauauuucucuucaauguccuguggaacagguuuaaaaaucugaaugguuccaagugucuugucuuauuaauuagcuuauuuauggaauaccuucuauauacaggcucuaugcugaucauugcaaacagaaaaagagaggaauaaguucuuaaauaaguucuuggucuaguauauaaaacgucuuaauacuuaauuagaaucaacugugauacauacaaacauuguaauugcacaagcuauagucauaauacacagggggaaauaauuguuggcauuuuggaaaaaggaaagggaaaaauagacaccacacaugugugcacauauacacauauuuuauuuaagcagcaagauuuccaaaucaggaacucuauguuuuucggaggagaguuucccaagcacccauauuaucaaaaccaucucggguacuuuauaaaaaaaaaaaaaaaaaaaaaaaaaaaacagauuaauggaccucacugcuauaagguuagacucuguaacucugaauugcugcccauaggaucuauauuuuaaaagcucuccuuuuaaugucaaugaugaguugaguuuggucaccggaagagucucaggcaaaucaggucacccuacuuguagguugcagaucggugacccuuagguacaugggggcacaacucauuucuauuggccaugaagguuugugcaaaaauucaguugaucuucaaauaacacaauuaucaaaucuacuagucccguuccccuaaguuuaaucaauccaaguuuaaucccuuuaauuuuuauguuugaaaaccuggaagugauugcuuuugacuggagcuuuuuagguuccacgcuuuucuuuuugauacuuacuuuauguggaucaaauucauugaaccuuagaauaucagacuaauaacaacauggagacuaaaucaauagcacaacacuaaggucauccucaaccuguuacaguguugauucuacugcaggugugauguccuugacagggagguugauauaugguuguguuggacuuugacaggcuucugcuucucagggcaaagaguuuucagcaaaugaugguuuuaccuauugauguccuuucaaucuuuuacucuuucuugggaaauaucagugugcugugucccuagauuaacaggauaaauugauauuaauaacauuuguuugaaucuacuucaaagucacauaaacaugaauuuauagaaauuauagccuccuucugugaaacucaaaauaguuuuuaaauaauaauuuuugucauagcccuuaugacagagaggcugcaaauagauauauguguauuccacaaucugacaggcaccaucagggguucaagugacuuagccuaaacuauuaaucaaaauaaugacuaauguuuccuaauaauacccaugguuuucaauaacuuuuaagauauaaaagcauuuuccuuacaguacagauauuuaaaauauaugaucauauuuuuguguaaauauuuccuuaauauugauucaauauaaacaaauaagauacauuuugcucuggcagaauuaaaucaaaauuagaauguaucuguacuugaaauauuaaaaauaucaaagaauuacaguaaagacauaacagaacuuaaucuggcaugugcuaucaauuuaguaauuuaaacuguucauccuaagcauaugcaucucucagaaaauguauaguguuaaaauucuuguuaaaauggcuugauaccaaagauaggaaauuggguaaagauagucucuuuaacaaauguuguugacaaaacugaacauccacaugcaaaaaaaaaaaaaggaaauuggacucuuauacuacacauacaaaaaucaauucaaaaugaauuaaagucccaaauuaagaccugaaacuagaaaacuccuagaugaaaacauaugggaaaacuuuuaugacauucgucuuggcaauaauuucaugacucugacaccuaaagcacagacaacauaaccaaagauagacaacugggaauauaucacacuaaaaagcuucuguacagcaaaggaaacaauuaacaaaacgaaaaaaaaaaaaaaaaccuagagaaugggaaaauauuuccaaaucuuauaucugauaagggauuaauuuccaaaauauauaagaaacuccaacucacuaacaaaaacaacaaugauaacagaacuuuauaauaacaucaacaaaaaugagcuauggacuugaccagacuuucauccaaagaagacacacaagggcccaaaggccuaugaagauugcuuagcgucacuagucaucagggaaaugcacaucaaaaccacaaugagacaccaccucauuucucucaggauggugauuaugaaaaaagcaaaagacaugugucuuaauaauggaaugauuuauguuccuuuggguauauacccaguaaugggauuguugagucaaaaguguauauucuuugcagcacuauucacaaaagcaaagaccuggaaucaaccuaaaugcccaucugcgauagaccagauaaagaaaaugugguacacauacaccaaggaauacuaugcauccauaaaaaagaacaaaaucauacccuuuucagggauguggauggagacguuggccauuauccuuagcaaauuaacacagaaauggaaaaccaaauaccacauguucucacuuaugaaugggagugaaaugaugaaaacacguggacacauagagggaaauaacacacacuggggccuuucaaaagagaguggagggugggaggagggagagucagggaaaauaacuaaugaguaccagguuuaauaccugagugaugaaauaaucuguaugacaaacccccaugacaaaaguuuaccuguguaacaaaccuacacauguaccccugaacuuaaaauaaaaguugaaaaaaaugcaguaggcagcaagugucugugaggauauggagcccaugcaugguauugguaggaaugcaaaauggugcagcugcuacggaaaccguauuaagguuccuuuaaaaaaaaaaaaccaugauaaaguaauuccaccgugagcauuuauccaaaauaauuaaaaccaggaucuugaagagauauuagcacuuccacguuuaucacagcaacauucccaauacccaagguaugaaaacaaccuaaguguucauuaauggaugagcgcacacagacaguggaauacuauccggauuuaaaauaaagaaaauucugcaauaugcaauguggaugaaucuugaggauauuauacuaaaugaaauaagccagucacagaaagacaaauccugcaugauuucucugggaggagguaccuaaaauagccaaaucaaagaccauaauggugguuuccaggagcugagggaagagggaugguaaguuauaaauaaacaggcaugaaauuucaguugugcaaaaucagggaggucuggaguaacauugugccuguagucagcacuacugcauuauauauuuaaacauuuaagaggauagaucuuaaggguucuuaccacaauaaaauaaaaucaaaaaauaaaaauuaaaaaacaaaauggcuuccaauguguaaauuaagaagaaacauaauaaaaauuacaguuucaggucacaugaauuuacaguuacacucuauggcuuaauuaaagucucaaaauaauagaaaagaaaagaauuauaagaauaccagacucuuaugcaaaacaaagaugccauugggaguagaauaaguccugguaaaccuacacauucuguacaccugugaaauuugggcuuucagaccuuuggacacacucgaacuuacaccguggcugaaaagucacacuaagugcuuacgaccuaaacgacuccccugccugucucccucucuucuucagguggauacaucaacagagauaccuauuacuguuagaaugaucucauaugguuuggcugugucuccacccaaauuucaucuugaauuguaguucccauaaucaugggagggacccagugggagguaauugaaucacgggugcaguuaccccagugccgcuguucuugugauagugagugaguucuuacgaggucugaugguuuuauaagagacuuacacucagcacuucugcuugcugccaccauguaagaugugcuuuugcuccuccuucaccuucuaccaugauugugaggccuccccucauguggaacugugaguccauuacaucucuuuccuuuauaaaugacccacuauugggugugcccuuacagcagugugagaauggaguaauacaaccuguuaugauaauuucugagaccaaguauaacuuagaugguaccaaguagaaagaauagaaggggaggcagcucuauuacaaggaaaacugauuuccucacuccuccuacagggaaagugauuuggagaccugagcuucagguuucaacucuggaaacauuguuuacacugguguuuuguaccuucaaauuuucuaaauuauuuauuugguaguguaucuugcuauccauccaacagcucuugcuaauaccaaucuuugcauucuagaaaacuugaaugccacacgcaauaauccaaacauuauuuucauuaggccacucuccugcuuaagaagagucagaaauuuucuaccaagucaauuucaaaauuauuagcuaucagucacauuucagaaucucccaacaucagucuucccucuaagcuacacacacaaauacacauaccauggccucaaacuuuucaacuugaaauguuuuacccccaaucucacuguaguucaacacccauguuuccuuuaggaggauguuccauuucuuauauaaagccuucucugaaugccacaagcccccugaagcccauuucuaaaugaauucugaucauaugagguggaauauaucaugauccauuguuuucauuuuuaaaaucuauuugcuauauuuguuuaccaauauuaccauaaaaccucugaauauuguaaauagugcugcaauaaccguacaugugcaugugucuuuauaguagaaugauuuauaauccuuuggguauauacccaguaaugggauugcugggucaaaugguauuucugguucuagguccuugaggaauugccacacugucuuuccacaauggcugaacuaauuuacacucccagcaguguaaaagcauuccuauuucuccacauccuuuccagcaucuguuguuuccugacuuuuuaaugaucacagggacauggaugaagcuggcaaccaucauucucagcaaacuaacacaggaacagaaaaccaaacaccgcguguucucacucauaagugggaguuggacaauaagaacacauggacagacggaggggaacaucacacaguagggcauguuggggggugagggucuaggggagguauagcauuaggagaaauaccuaauguagaugauggguugaugggugcagccaaccaccgugacaaguguauaccuauguaacaaaccugcacguucugcacauguaucccagaauuuaaaguauuuuuaaaaaauaaacuaugaauaaaucaguuuuuguuuuuuuguguuacaaagagaacuucgaacaguucacgguagcugauauuacaauucugucauccuacacuucuccaaaaaauauuuugauaacucccacucccucaggaaagaaggaaaauuacacugaauaaaaugcaagggcuaaugauuucauccucuaccucuguuccacucaauuuuucuccaaauccccuaaucauugacuuuccauacucccuccuaccugagcuucucugugacuaugguaaacuaccccaaagauaccuugaauuggugagcuauccauuuaucuuugagauuuccccugccuaaacaccuuuuugcuuugcuuacucauauauguacuagcucuucaggccuaaguuucagacacuuagaaauaacuuccucuaguccagauggcagguccucuaguauauacuacucccuccuaugcuacaagaguacccugugaugauuccuauacugucaacacuaucuagugacuuauccgucucugagacugguuugcaaucuuccuuagcaagaaccacauuuucacuauuggucuacuagagcccggcucagcaggcaaaagaaacacaaccugcuuaauaucaacuccuucaaggcacucugcuucuugugauaaaggcccugcuuuucuuguucuuuaaauauagacucuaauuuccuauuaacuuuaaagccuaaucaacugagauccuaguuaucuuuccucaugggggugaggaugccaucccaagaaguaagggaaaauacaacuauuccuuauuucuaugggggaaaaaagagaagaaaagcaaaauuguuagauuuccaaucaaaauaguguuaucauucauauuuuguuacucagggaagaacaacuguuuuaggcuggauauaauucaguaagauguagcggaaagugugcuguuaaaggcaaaggccucacuugccuggacaaagaauuuagacuucaucucagaaaacuagggugaaaauguaaaaugccuaaauagguaagaaggugacagauaaaugaaguguggcugcauguggccacauugucagaaacacagugagucacuuguugcagcuguaauaaacuaaagaacauauucacuccucaguuuccagugauuacagaagaaaagugagaacucuguguuauuagacauucuuauguuucaagaaaacucaggguacuaaauuaucacucagaauugucccaguuuuaauuauuagcaaguaauuuaauuuuuaaacuaauuuuaugagaaggaaaaaucagcucuguggauugccuuuagucagcagcccacauauuuguaacccugauaauuaaaaccaaugaagacuucauaaucagaucuguguaauaaagucaggaguggacugcaaaaugagguucauuagacuaugaauucccaaggagugguuuuuuaaugaaugaauaaauaaguaagaaucuaaagacagagaccagucuggaaguuugucuggaaaguuuaguuaaguaguucaucaggccugaacuaaaggagaagcaguaaaaauugagguuuuagauauauuuugaaguuuauaguuuaguugcuacuuaucaacauguugaugaaugacagaaggaauaucaguaaagaggguuuaggaaacaaugaauuuguucacaacuaugccaucaacuagcugugugaucuuguugaucucaaguggaaaauuaggguauuacagugaaauguaucugaagagcuucucaaagcugaagcccuuucauucuagguugacauuuuuggaucucaugucagucaucuuuaacaaccgcucuggugugugauuucacucacaugaaggucaagaacaggcaaaacuaaucuauggugcuagaaaaacaauccuuacuuaugggagggggcugaauggaaaggggaaugagggaauguucuuggguaugggguauaccuugacugagguuuauguaugucaaagucacucaccauggaccuauccauuuuauauauguaauucaucauguaauuuaaaaaauguuuuauugaaagguguuaauauuuuaacuuauacuuucucauauuugguugaacauuagaaucaccuggagaguuuuucuuaaaaaauuauuuacuuauuuaaauaaaaaaaauuuauuaagugcaauaugauguuuauauauguauauguauagugcaaugguugcauuuggguaauuaacauugcauuaucugacauaguuuuaucauuuuuuguggcaagaacauuuaaaaucuacucaaccauuuucaagaauacuacauuauuauuaacuauagucaucaugugguacaauacauuucuugaauuuauucuucuuauuugacugaaauuuuguauccuuugaccaacaucuccccaacucccauccccucuucccagccuuugguaaucaccauucuacucucugcuucuauagagaagcuuuaaaagauaucauuaacuucacuccaaauuggagaaaguuugacuuaauacauguuuagagaaaaauccuagaaacaagucauguaauucaacagcuuauuuaucauaaccuagaugauuuuuacuuauaguuaucucucuaaucuuccugguauuuuaaguuaaagccuuccagcuaagagcaaccaacaccauuacaguuaaagucagacuuauuaaaaugcuugacagggagaaugcauaucacaggaaguaagggggggucucuaaaggagagagucagggaaggauaccuuuagaguuuaggggccaaaauuaccugauaagauggccuuagcagggauuggucugaauuuucaaauaaagaggauuuacuggaacaguugucuuuagaacacaagucuagaugguuucugccagauuaguuuauuuguguucuuaccuuggaacauguagaucuaaaugagcugguguuaaagaguauauucuuagaucaucugugauucuugugugguuugcuauaauuuauguguuuuacaagucuuauugcagucguuuuauaaauugugguuucuguuucaaaucucagcacuccccuuauagccuagcugccagccagaauguuuuuuccucuaucacauuaaacuaacggaacacaaacauuugccagagcuccccaucaaaacugauuuuuagaagaacuaaacaagaagacaguagaaaaaagaagcuggauguguuuaauuuccuugaacacccugccugacuuucccuggcuugccgacacuuugugguagacacacuucaccucauuuuuaaggacuugaguuuccugaaaaaaaauguuuauuuucauggcuagauuaaaauaauaauuucugcccugaggugacuggaauuuucuguuauaucaaucccacgguuaguuuuuguuacuaagaacauuaaauuaacaauaugggaaauucaagaauauuuuggcaauaaaucauucaagaacaguacaugcaaggcagggcaaaugagagguuuucuggugaaaagguuacuugcaagauuccuauugccuuuaugacauaaugugcuucuugucuccuugucuucuucagugaugagaaggaagccucagcuuguauggcuggcagugggagagcagcaucuucccuggauauauaucuuuuacaaaugccuauugcucuguguuuugcuguuuaauaaccucacucuuaaaggucugacauuugcaguaaugaagcagaauaacaacaaaaauaggaaaacaucaggccuauggaagcccaugaauguaaagaauauuucuacagaggcaaaauguaggggcagagacuaucuacaguugccuacugucauaugacucaucuucauuuaauuggggacuuucuugagucauguuaaugacuucaaaauauaaugaagcuucuccaaagaucuuuguccaaaguaaauuaucuuagaguguuaaauccauagaccagauaggucucuccuuauuagaccucaaggaggaaauguaggaugagguauauuuuauucaguagggagagcaacauacuguuuaggaaauccuuuaugagacuugcauuauauugugauuuuagaauacuucucucaccaaaacccuugacauggcaauuacuggaucaauuguuucacucuccugagagaauaaauucuguauucauuccuuagcucugaaguacaaggaggaagaagaaaagcagguggaggcagaggugacagacuauuucuguuucaguauguucugaaaaaaugagacuaaaaggauuaauaguggagauauuuuagaacaauuaugcuuuauagguuucuuagagucagaaaaauugcuaucaaaaauaaaaaugauagagacaaguuaucugcuugauggcaauuuggggauauaaagcuugacaaucaaacacuccuuaggucaaaugaggauuugcaaauuauucaccaauaggauaugcauaaugaaacacgcauucuguaaugacaacauuuccccucaaaaauuuaguuaacauuuuucuaacaguaaguuaaaaauaaaagaaacagaaguaugcaaguucccuuaauuggcacuagcccucaaagagcaguacugcaugccguauuguuugaggcauuuuuaugcuauaccaggaguauugguaauggccagcuucuaaccaauggggguagauuuuaaucacuuccucucuuuggagucaauaucuaugccacauuuugggacucauaggccagaaaagaaauaaaaugauauguauggaagccaagaaauuagagguaguaacuucugcagucuugcauagccuuuuuauuggaucuucugaagaagacagggucauuguaauacuucuuucuguuaucagccuuuuauggauuauaauguaauuccaguuucagcuucuguuauuucuugaugugaugucuggcagagaaugauaccagaguaaucucccuuaucugggaaguuugggacauggagcagauaucucuaaacuugguugaaguuuucucccaaaacuucacaagauagguaaacucucaacagaacauugaaacggacaccauucucugacccuauauuaaacaauacugaauccaauaaagauaauuuaacugcuugcuucuggaauauaaggccaugaaccaaguaaacagcuuagcugucaagauuaagaccuugcucauguaaucacuuuaacacucuugccacacugugcucaccaauccaaagcuauuaaguucuaaacucugccuggccuuauccagugcucugucuugcaagacgccuuaaaaaucacucagcccagaagcugcaccuguguaaacacccuccucugacuucccuuuucaaggcacuccuuuguccaggugugcucuucuuuaccaugacaggcuuaauaaacucagucuucccuuauucaacuauugcuguuguuuuguuuuucuuuuaggaaauuaacagucaauacaacaaacauuucuugacuuucaugauuggugacuuuguggaauauuuuacucucaagcaagaaaaagagaacacgucuauaauaaaaggaaauuuuaggcaaaaauucaaugcaaaaagaaaaaagagugucccuuuuaaaccaggaguuggagagaugaucccccucuucuuccucaucuuaucuaaaucuacaguucuucagcaucuugauagaaaucagguuaaaagaaaacaaacagcacugcuccauaagaugcacaauuuaguccuguuuucuuucccaccugcccauagucuauguauuuuuuuuuucauguuucuaccguagcuuuaugucucuggguaaucaugaaugaauauuuaaccauuuuaccaucauuugcagccuagcaaagguugaauuccauugaacuggcagauugcuuuuuaauuuucugcuuggauggguugguuuuuuguccuguaguuuccaaaauauuuuaugagucuugauggagaggcuaaaaugcuugcaaauuuugcugaucucugccaaaagcugauuaacccuuccucauucuucagaaacccauguaccagcagcuuaagugcuguaagaagcaugauauagcguugugaaaaaggacuuacacagggguugcagaauacuacaucuacacaagggauauauacguugauaaucauucugugucgauuugauacugguuugcuuuuucuauaguaaagggaaauauuuaugacacuuagagaugugaaauacaagacagcuugaauaucaccaucccuuaaauguagcugaugaucugugaauaauaauuauaugacuuuaaaaugggcuacguguaugaauacagguauuuucauuacccccuguuaauuguucugaauugggugguuauuucacuucaaaugaaaaugaccuaguaccuuauuucaugucacuuguacaacugaucagacuuuugauaacuuagauuuucuacauuuuauaauaaauuuuuaugauaauguuuaaaauaauuccaauaucacaucacaguuucauauuaucaucaauuuuuugucugcuuuuaaacuuauucuaccuguugucuuucccaucucgguggacagugacuucauuuuucuaguuuguuaggagaaaagccuugauuucuguugucugcaauguugaagauuguguugugcuugccaaaugcuugcucccuucucugucagauaaagagaccugagagaccucccguaggagaaguguuuguccccacccagccacaugggcuuggccacauugcuuggggcagcagaauguaaccaggugugacuuaugccuuaacuccacaggacuuuuaagaagauugcccacuguggcuauggcaccccucccugugccaugaauagagcauuuaugugauagaaacugcuccuacagccuggauucuaggaugcaugguaaacaugagcacaagucaagcagcuccaggcugaccuucaggugagcagagccagacccacagcugcuuuauguaacuugagcaagaaaucaaugcucauuguuguaaauuacugacauuuggggaaagacuugagguuguuugucauggccacauaaauuaaaguugauuaauauagcccauauccaagauacuggauaauccuauuagcucuuccuuccaaaccuuguaaauauuuccaaaaccagauuacuucucaucaccuuuguugcgauuacuguggcauaggcuaccauggucucucauaugauuacucuaauagccuccuaacuggcuuggauauuucuuccuuucuuuucugacucaccaucuauuuucaauauaguacuagaauaauccuuuucaaauguaaaucagauuauguuauuccuguguucaaaucccuuccauagcgucucacaucaaucacaugacagccaaaauucuuauaaagacuuaccuagccauuguaguuucauucaaucuaccuaccucuaugccugcucucuccccagugucaucugcugcuaauaucccccacguaacucaacccaagucuuacuggccuguuauagcucaaaccuggccaaugaaugccuaccucaggcacuuacuugcauuugcucuuccaacucugccugaaaugcucacugucccagggaacaauaaggcuuaguuuuucaguuguuuaguccuuuauuuaaauaccaucuacucagugacaucuucccauaccacccaacuuaaaaucgcaaggccuccccaccagaagagcuucccaccucccuuucuuguguugucuccuuggcguucaccaucugacgugacauauuuuacuaauuuacuuuccugacucuacuagacugugacucgcaugaugacaggcucuuuuuacaauuuuacuuuuuuuuaauugaaggcuuuaacauugauacaaacuuaguaaguaaauaaggauguugccagaauaaagaaagaaauuauauguuuaggagauuaaaauguagguauuuuaauguuuuaaaauaggcauuaauuucauuuuucucagauacuuauuuugaaaacuuuuuuuaauuuaacauuuauaauaauagacaguaauucugugucagauuuaucuccuaaauaccuuuucucccuccaaauaggacacauucauaaaguugauaggauacagauauugucauguauauuucagaauccaacaaaauuucuuaucuaucaaaacuuacuacuguaucauuguuggcuugccuagcacuauaaauuguugauuuucuccccaaauccaugccuuagguuaugaaacauuaggggacuugugguaauaauuuuaaccguucaaauauaaaugucuuucuaccuuacacaagauucacuauugaaaaacagcuaauuucauauuugggauuauuuuaaugguuaaguucuaguauaauuauuugauuaaaauaugcuuuugaacuauuugcaaauacagaguuuucucaaauuaaaaauauugaugauucucuuuugcauuuauuaauauuuuggggaaauauauuaucugugguacguuuucacaaucacagcgucuaaugaaugugacccuguguguccuugacccuucacgcaacgugacuagagaugucuuggaguguuuuaucacacagcaauaaacaagugauacaaguacauuauuuauuuuuuucugcucuagaugcauuaguuucuuuuccauaaagcuacaaaugaugagucuuuaaaaauggugguggggggggaacaugggggaggcagcagugagcagucaacagucaguacucugcuuuucucaucccuccuuacuucccuuccaccugcuucucugugucucuuauugccucacccucccccaaugcaucauuaaaaauguagagaaaagccugcccaaaaacuuuccuguuuuucuuccuuuggacuaaaauacugaauucucaaacauaaauccccauuuggaaaggguuuccuuuauuauuauuaauacucauauuaaugauguggaacuaaugcuuacucucagcugcucucuucuauguauauaaguaguggcagauauugcuucuaacaagugaacaauugcagaaagaaaaacgacuuagaaugaaagauacagauuccagugaauauuguguaauucugagugcaauuugcuguccuuugcuaaaugugguucaaaaauaacaaucuaccaucagguggcaaaacuuuaaauuggauuaggaaucacaugugucugcuuuuuucucauuauuguagaaugagggagaaaggagaaaauaaacguggauauuggaugauugcaugcuguugcagcacaauacuuaccuugcugaaguuccugaugaagaaaauuccuuucauauauuuucucuuuuaaccugaauuuucaucacauuucuuuguaagcauaauuaaaugccaccaucaaggaaacuccauccaucuacacugaaugaucauaaaguagggaauacagucaaugugagaugaaccguuuuuuaacacauacuuuuuggacauaaauacgggaacaauagacaaugggaacuacaaguggggacagcaagggagggggaaaggguuagaaaaguauccuuuggguaccauacucacuaccuggaugaaagguucaauuguaccccaaaccucagcaucacacgauauacucuuguaacaaacaugaauauguagcccuuguaucuaaaacaaaaguugaaaaaaaucacauugcaacccauaaauuuauacaauugucaauuacaauuaauuuaaaaaauacgaauuagaaaguuuaaaguuuaaauaaacaaauguugauugauuacuuaaaaagaaguaaaaauuauuuuaagagauuugagugucaugccugucgugaaaaccuaccaugaccauguauauaauauauauaucauauauuauaucauauauaauauauauaucauauauuauaucauauauaauauacauuauauaauaucauauauaauaugcauuauauaauauauaauauauaugauauaauaucauauauaauauacauuauauaauauaauauauaauauauaugauauaauaucauauauaugauauaugauauaauauauaugauauaauaucauauauaugauauaugauauaauaucauauauaugauauaugauauaauauaauauauuauauaugauauaauauaauauauuauauaugauauauaucauauauauauaauauauauauaaaauauacauguuagguaaaguacauuguaucauuuuuaaaaauuaaaacuacauuuuauuagaaaagauggacauggcacgccuaauuguguaugagcguguguguacauuaacuauagaauuuuaggaugcaugcaaaauauuucucuuauauuacaucucagcaauuuuaugccuaaucauuaagugauacuauuuuuguuuaugagcuauggaagaaaaccuuaauucuaauugccuaaaaucauaauggcaauaaauugcucagcuuggauuuagacucuaguccugaguguaaagcaugcaauagacagacaggagguauugacuucguaggaacuuuagaaaagaauucuacugguaaugucuaaauuguaggaaguuaagaguaggacugaaaacaaucuuuauuauuacuuuagauagcauguaacugcauuuuacaacauaugaagccccuuuucucaguggccaagaaagauuagaaaccuguuguucuuauuuccccguuagauuacugagcauacaguucagauaaacaaaacuuuucuacgcauagggucuuuuuaugugggucagacauauuucuacaacacucuuugacaaauugcuggcuguauacaccguacauuugcaauugauaaacgcagagacugucaaaaauaaaaggcacucauauuguaucacuguuauuccuacgucagccaaacccacuuucaugacagguguuccuaaagccucaggaguaugggagguuucuguugcugucuuuggcacucugcauauuuuacuuccuuucaaaauauuauaaagaaaauuaacccagaauacgagaaaguauccacagaaaaaaaucaaguucaauuuuauuuguaggcuugaauucuauauuuuuacucucaccaggaaguccuucuuucccccauuuuucuccuauacagacuguuuuaguaucagaaggcuuucaaaugcagcaagucagucauuugauuauccucugauaaaaugcaaacuuccauuauaaauuaacuuauaccaucuaaaaugacagaggacucauuuguagaacuuuguuuuaggccugauuuuccuaacaagauuggaauuuuacauagacuauuuuuaauucaaugcuuuucuaacuuaacuuuaauauuuauguuacucuuauguuauugccaauaacaucuaguauuuuaucuauaauuaauaaauaauuguuaagaaauacagcuugcaaucuuggguugaaacagaguagagagagagcaaacaaaacugaauauuacaugcaaacuugcccaacauaaagccaagaagauggucucccauccacuuggaaucauaacagcaaugggauccagagauggggucagggacagggaaaugacacagauggacugagaggacucugaaaaugaacuggaauuaucuuauuuuuauuucaagauugacucuggagcaagagugaauaugaagaaccaugaacacaaaucuuaucauguuccagcaaaggguaguguuuauaagacuguguacuuugcaauaaauuauuguucuaucaggaacaaucacuuuuucuuuaagacucuaguucucccuucagcaauacacaaguggacauauugacuaauguuaaaauaaaguuucuuuacaucucauaauguuuauauuuccaguguuuuucccuugguugcuuuaucuucaucuuuucuauaauaugguuaacuuuuuggauagucuuucuaaauucccuuauccacaaauagacauuagccuauagguagauuuaugugggcauauacaauguuugagcuucaaauuucccacuugcauagaccaccuuuaaaguccuggguaugaaacuagguguucacuuggucauuuguuuuucauaaaauuuuugcaaaauuucuagaaaagugcaacugauucagagggcuguaugauucagcuuuuuuuuuuuuuuuuuuuuuuuuuuuugagacagggucucccucucccucagucgccuaagcuggagugcaguggugcgaucucugcucacugcaaccucugccucccggguucaagcaauucuccucccucagccuccugaguagcugggauuacaggcacacaccaccauacuugucuaauuuauuuuuauuuuuauuuauuuuuauuuuuuaguagagaugggguuucagcacauuggucaggcuggucucgaacuccugaccuugugauccgcccgccucggccucccaaagugcugggauuacaggccugauccaccacgccuggccaauucugcucuuaauucccucuaugaccuuuuccuugugucaaguggugguggagugucugauaauauuucuagagucugaguaacaaaauguuaaguggggguacauuuaguuucgguuaguaagaggaaguuaaauuguuugcaguuacuuccauauagaauuaagcuauuguuagcuauuuugauauagaaaugaguuccaaauauacgcuuacagaauguugugccaacagaccccauguugugacauaagguugugaggcuagaugucauauucugagagucauaucacauaaaauuguguccuauacaauaacacuccaaguuucagaagaaagugggaaggaaagaaaaaaaaguuagaaauguucagagccugaagcuagucuguggauaaaucuaauaauaagcugcauaaaauuauaagcagagaacuuuagcaucccccaucaacacacuuuuccauauuuuuauaauaaucaugcaauauggaauuuauugaaaucccuguauuuugagagcauauucuguagaauacuacaaucauaaauucugaagaaccaugcaaaaaaagccuaaauuaccuauuuucucauuugaaaaucuugagauuuuguugucauguuaagaaggaaucaaaguauaauuuauuuucauuucucuccucauuguaaauauucacuuuuuugaauuguaaauauuguauuacuucuuuaaauuuuaaaaauauuuuucccuaguuccagcucuuuaucgccaagauuguaauuuuuauuuuucuuuuuuuaauggaaacugccaauacuuucucaacauaccucccccuaucuuguucaaguugauuccaagauauuucauuauuuuucacuucaguaacuaaauagugcucuuucugcuucuucauacguacuuucccccaugugcucaagaaguuuauguuguuuaaacaagcuauagggccggcaugguggcucaugccucuaaucccagcacuuugggaggcugaagcggguggaucaucugaggucaggaguucgaaaccagccuggccaacauggugaaaaccugucucuacuaaaaauacaaaaauuagcugggcgugggggugugugccuguaaucccgcuacuugggaggcugaggcaggagaaucacuugaaccugggaggcggagguugcagucagccuugaucaugccauugcacuccagccugggcaacugagcgagacuccgccucaauacaaaacaaaacaaaagcuauaaauuauuagcauuuuuauaacauucuaagccaaucuaugucuuccaggcauuuacugauuaucuuaacaugaauauuuagaagaccauauauuucauauaugcuuugccuuuguauagaacuuccauagguuuccuuuggaagacagcuuuauuuuuuaacuuuuauuuuagguucaggggaacauguacagguuuguuacauauguaaauuguuuguucgcagggguuugguguauagauuauuuugucaaucagguaauaagcauaguccuaaauagguaguuuuuaaauccuuaugcuccucccucccuccauccucaaguagcccccagucucugucauucccuuuuuugugcucauauguacucaauguuuagcucccacugacaagugagaacaugugguauuugguuuuguguuccugugucaauucgcuuaggacaauggccucuagcuuguugcuccaaaggacaugaucauuccuuuuugugaaugcacaguauuccacgguguauaaaauguguaccacauuuucuuuauccaguccacugcugaugggcauuuagguugauuccaugucuuugcuagugugaauaguggugugacgcacauaugugugcgugugccuuuaugguagaaugacuuauauuccuuuggguauacaugcaauaauggaauugcuggauggaacgguaauucuguuuugaaauuuuugagaaaccgucaaacuacuuucuacaguagcugaacuaauuugcauucccacuagcaguguauaagcauucccuuuucucuacaaccucaccagcaucuguuauuuuuugacuuuuuaauaauagccauucugacugaugugagaugguaucucauuguaguuuugauuugcauuucuuuaaugauuagugauguucagcauuuuucauuugccuuuuggccacguguaugccuucuuuggaaaauucuguucaugucuuuugcccacuuuuuaaugagguuguuuuuugccuguaaacuuguuuaagccccuuauagauuacggauauuagacugcuguuggaugcacaguuuguaacuauuuucucccauucuguagauugucuguuuacuuugcucuuuuuuuuuccccugaauaaaagaucuuuaguuuaauuagguccaauuuguccauuuuuguuuuugcugucauugcuuuugaugucaccaucaugaaaucuuugccagguccuauguccagaaugguaucuccuagguuaucuuccagggcuuuuauaguauuagauuuuacauuuacaucuuuaauccaucuugaguugauuuuuuaauaaggggaaaugaaagggucuaguuucaauuuucugcauauggcuagccaguuaucccagcaccauuuauugaauagggaguccuuuccccauugcuuauuuuggaagacaacuuucuuuaucugucacuuugccauauuuuuuaguacauuauaaaguuuccuuuuguuuuacaagaggaauuuccccuuuugcagagaaaugccuuuguaucugauuuguuguuguuguuguuguuguuguuguuguuuugagacggagucucauucugucaccaggcuagagugcaguggcacgaucucggcucacugcaaccucugccuccuggguucaagaaauucuccugccucagccuccugaguagcugggauuacaggcacgugcuacuaugcccagcuaguuuuuguauuuuuaguagagacgggguuucaccauguuggccaggauggucucaaucucuugaucucgugaacugcccgccucagacucccaaagugcugggauuacagacaugagccaccgcacccggcccuacauuuuaauauuagccaguucaguaugcugccugcuuuccugcccaugugagcuuagcacugcuuuccucuaaaccauuaccacuaaaagcuaauccauaaauacaaauggcaugccucauguaugcauuagucacauuuacuuaucuuucucccgaucgcuuguuucugagcuuuaaggaaagggaucaucaauguucuugagaaucagaugaaagcucugaauuaucacccuagaguaucaucucauacaccaaauauuuuaaucucaagaguauugaccucauguuaggaaccccugcucuggacacagagacugaaguuauauacugaccauuuuaucugcuucacagagagacaaaaaaucaucucccaauuuauguugaguaauuucuuuucuuccuuuuacuuucauauauuuuuucuuuguuaacauacaaaaaaauugaaaacauuuauauugaacaaauaaacacgaaguuucucauaagugggaccacaugcuauagacugugcugguccauauaaaaaaugcauaagaaaacaaacaaaaaauauacuucuaauuuucuguguaaauuuacuuucauauguauuuauuuagucuaugauuuuagcauuaucuuucuuuacaguguacaccaaaaugcauuuugucccagcccuuucaaaaauacacaauaucaagauacuucccuuuaaucuuuucuuagauuuuuguguuuuauuucacugaaccuugcuuccgcuuucuugauauauuauuuauauuuuaacuaaggccuuuucuuccuuuucuguaacugcagugugauaaagucagcauucgguguaacugagcucauccugcauaucacugucucucucucuuuuuuuaaucuucacccuccaguucucauauguugacaagaauguucuuaugaaacaauguggcuacucuaaacaccauugaugacuauguggccagucuuauuucauuuccucuccuacccacugacauauaauauccucacuaauuucaacagcuucugugacagccauagcuuucuaaggcuuugaagaguaaaacaaucucucuauuccugguuugucuaauuuauugcacuaaguauaauacaauuauaacucaucuuagucuuuaggccuauuucauuauuuguucuuaauauuaagugugagauuuccaggugcuugaauauuacuaaugguaacuucugagccuauaaaucucaauuguauuuguuggacuguaugcuaaauggucuucacgucuuauuucauuuaaccuucauagcaaucauagcgacuguguuacacugcuuugcaguugagaaaacuaacaauauaaaagaaagaacagugcacagaacaggaauugaacccaacaggcuuccuccagagcucacauuuuugccaaaacucuccaacccaucuuuacaaauuuuacaucaacuugucccauuuauaaguaauuauuuuucuguucaugucuucuccaggguggauuucucuaagccacuacccuacuuuuucauuuacuccuuuuaagaaaccucaaaccgaguaaaaaggacuuucagugcccuaagagaguuuuuaaugcccucuuugagaagacucugguaauuauaucaauagaaagaagacaauaaaaugacaauauuuuucuuucuauuuauucacauuuuaucauugacuauagugguagauaaaauuaaaacaaaagccguaaaauguaauauaaggaguuaaauuucucuaacgaggguuuugauuaagaaacucuguccuggacauugucacauuaaaugauucaguuuuacuccuguggaaauaaaacuuccaaauuucaauuuuaaaugauuugauaacauuuaaaauaauugaacauuuuguucaagcaucccagcaauaacauuauccacuugucgaauauuguauuuuuaugauuuaauauuaacauccaaauaaauagaugaucaacuuugaacuaugacuaauucacuauuuccuacauggauucugaugcauaggcugucaagagauuauuuauucuuaaaguaaaauccauuccucaaaugugacaugcagaaaauuaaugugaaaucaucaauuuccaagcucaccuuauuuuuggucuauauauacccuuacaaauaccaucuguguaaagauaaauuccagacauaugacauugagccugauauucaacugguccccuugccuugcugucucaugcauaguagcugaaauccucuaucuugcuuuccuuugcauucucaaaaaaugagaaaaugccuaauacaaaacagguauugaauaaaaauuuaucuuuaaauaaaaaacacuguuuuuggaguucacaauuuaguggaauacaaguaggugacuacugaauacuuacauaaaaucuaagcucucuucuugggguuccuuguguuauuuuaagccauuuaguuaauauuauuuauuaugugauuccaauuguggagcuuucuaacuuaauagggacuguguuagaaauuggacaaguaaaauaaaggcaaaucauuacauauuuuguaaagaagaggagggauuuuuuuuucuaaaaaaaaugugagagggauuuuuuauuauaagacuaucauaucauggcuaggcaggguggccuguaaucccagcacuuugggaggccgaggcgggagaacugacugagccuaggaauuugagaccagccugggcaauauaguaaaacuucaucucuacuaaagaaaaagaaauguaauaaaaaguuuuaaauccacuguaucauggucacaacguaaacugacauaacucuuuuaucauguaguuuguguauauauguaaugagucuuaaaauauuuaaauuuuaauaaacccaacuucugggaacuuaacuugaaauauggcaaaauguuugaacaauucagccuacacugucuucuauagaauuauuuaucagaucaaacaauuggaaugaacgaaacagacaauaguaggugacacaguuugaauguacauccccacucaaaucucauguugaauuguaauccucaguguuggagguggggccuggagggaggucacuggaucaugggggaggauuucucaggaaugguugagcaccauccccuuggugcuguccuugugacagugaguucucacaagaucuagucauugaaauguguguggcacguccucacucucacucuugcuccugcuucugccaugugacacaucugcccuuccuucaccuuccaccauaaauguaaacuuccugaguccucccuagaagccuagcagauaucagcaccacacuuccuguaaagcaugaagaacugugugcaaauuaaacauuuccuuauaaauuacucgaucuuaggaauuuccuauagcaaugcaagaauggccuaauguaccaggcaaaaguuuaaauaaaguacugcacaucaucaaauauguuguucauacacauauaugcacauuagaaagaguuacaugcaacccaaauuuuagcgauaguuuucuuugaguagugaagcugugggucccuuuauuaacuccaauuuuucuguuuuccuuuacaggcuugguuuuuuuacccuaacauauauuuauuuucaaaucagaaaaaaaagcuucacucaauuaaauguuucauguccacugucuguauaugcucucuuugucucuuaugaacaacuuccuccaguguccuugugcguuauucuaauccacuguguggcuccauuggcuaacauaagcagauacagcauggggacuggauuugugucacauuuaugacaaacauuaucaugggugagagcugcacugaugagguaagggagcugauaucccaaggggauacaguugaaagcauacuagcaagacuacaaccaguagugccgcagcugccaacucagcucauucgcaagcccaucaaugcccagaugcccaggaagcugcuauggaaggccucaaagcaacaccucuuggcaaaaacagugucacugaagcacauaucuuauuuuacauaauaagcucaugccuaccacaaucaaugaaucaauacaucaagaugauagauagaugauagauagagagauagauagauagauagauagauagauagauagauagauagauaaacugaaaagacagaaaaugcaaagaauaauuuuugacucuuuuacuaccauuucauuacauuuauuuagucaaacacucauuuccuuuucucaauuugguauuucuauuugaugcaaagucauguugaauuaugauuagaaacccauuuuuaauaguuaugccauuuguguuuuccaccaauaauucucagauguaaaugugacaacaugaaaauauguaaguggcguuguuucgaaaacaagucacuagaaaaaaacuucauuucuuucucugacaauuagugcuuuucaguuugguuaagugagaaccaggagcuuuaaucuauacacacaaauagccgaggauuaccagggcccaaacaauucaauuuuaccaaguaauaauaaaauuauaaucuaccuaaccaugaucaacuuauuccguuuuuuuuucagcuaaaacaauagcugugauccacugaccuucuauacuuuuuauucuagaaaauaguuaaaaauuucaguuguuuaaaaguuacuuugcuuuucccaugaaacuucacaauuuuauggcaggcucucauuuuuagaaacuccaggaaaauaguuuuuaacccuaggaaauauaaugaaucuuucaaaugcuugcucagguagccaggagagcccuugcacacucuccuuaacugaaauaauguuuguagaagaaacgauaauaauauuguaucaagaaagcacuauuucaugugauuugcuaugguuuacuuuaaaaaggugucauaauuacauacauuuugcaccuuguauuuauaauguucuuauaucuccuaaagaguccuauuguucaaauaacaugagaugagauauaagcugacuagugacacccugagcucucugcucccuucuaaggcauuguggugagaaaacaaggugauccuagagagcagucuggcaugacgacgauaguauuuuauguugagaaacauaaacuguuaggaaacaaacaaauaaaacagaagaaaagaucagauacaaucguggucaacuggaaccaaacaacauuuuuucacuucuaggacaugaaagaaaauggcagugaguaaugaagacucuucaauaugcugucaagcaacuaugcuacuaucacacaagggcacagacauagaaaaaaaaaugaaauauggucauuaugauuucuacccugagacuccuaugaaugaggaaugaugauccccgaugucucucacccauuucuaaacucucugguacgacuugagguaagauaaagagcagauauuuuaccagagauaaggaaaaauuaugggauuacagauucauagcaacuuuuuaagagcucugaauuuucuuuaugggccucauaugggccaucgacauagugagucuauguuucaacuaggcauuugacaaacucgcaugauacucuugugagcagaauggcaaaaaguuugguagaguuuuaacagguuuaauaguaugcccugggauauugauuaaugcuugaugcccaucuggaauuuagcuuacugggaaugugccacagaguuuugcucggacuuuucagauuagaguuuuuaucagcaacuugaauaaaggcacaggaacaaggaaaauuaaauguaauagaaaaagaaaacaacaaaguacuauauuucuauuagaaaaucaguugcacaaauaugaaaucaauuagacugguggcuggauaauaacucaaauuaaaaacaaauaauguuggugauuuaauugaaaauuaucggaauuagccaauaguucgacaggguugcuguugaaacuuuaauaaucugaagcuuuaacaauaggcauucaccauuuaggucaaaagacguauuagaaacaauuugccuuccugacacuauauuuguauuauucuauuuacuuuaugagcauuuuuaaagaaagaccuuauuuuuuaaauggugcacauccaaaacugcacugauaaaaggaaauaauaaaccuuauuguaaaaaaaaauagauuaaggagguuggaaagguuauuuuggacaugauaugauugaggguugguggcgguuaaaauuaguuuuauuuaaauauuuuaaagguuguccaugagaaggaaauggacacucuuuuauacaauaaggggauauuggauccagggagaaaaauuaaaaggagucauauuuugucuuaaaggaagauucuuaaaauuuuuaaucauaaaaguagagugcucucuaguaccaaaauuuuuagaaaugagaauuggaccgaaauuuuacugaugauauauaaauguuuagccaucuaaauuuauaucuggcuauucuaucuaagcuaugaggacaaaaaagcauaagaaugaaccaauggacuuuggggacuugggggaaagcgugggaagggagcaagggauaaaggacaacacagauggugcaguauauacugcucaggugaugggugcgccaggaucccacaaaccaccacuaaagaacuuacucauguaagcaaauacuaccgguaccccaauaaauuauggaaaaauuuuauaaaauaaaaauaaacacuacaaaauaaaauaauagauaucauucuauuaugauuucuuccuugagaugccuaugaaugaggaaagaugauuccaaguaucucucacucauuucuaaacuguauaauuugacuugagauaacauaaagagcagauauuuuaccagagauaagaaaaaauuaugggauuauaauuauaauagauauuauuuuauuuuuuaaaacauaauagauauuauuauauauuaauaauagauauuauuuugcauaacauuauuugcuagcacaaagucagauuggaaaucuugagcuaauuuucuuuccuuauauuuuccugauacuauaauaucuaaaaaugcuuuccuggaauuucaaacuuuaauuguggguaauaugaaaaucaucauggccuuuaccucaguauuucuauauauauuuuuucauucuuaggcuggacugcucaaaaaugguauuaucuuagacauagaagagugcuuucaaagaacauuucugcuauuuccuuuggaguuguaugauguaguuaucacaaacccuaguccuaugugccaaauaaugacaccugcugugguaaugaaauuuagaguucugacacauugcaguucacuauuucuauuuggaaauguaaagcuugacuugagauaacuaaguuuuaauaaaauuugauaguuuugucuccagcaugacagaguguuuuaugaacgacgggugcuucaaugaucccucuguauggaaauucacaaucucagacaacauuguucugugucaucucccagaaaauaaaacauggaaacaucaaauacggcaacuuuaucuacugcaaguaucucauuaaauugccuuuugcuuuuaaggaagaaugacgaucuuuaaaguauggugagagucuagcuauugaaauucaucagaaaauauuagaaaaaaacagggaguauagcucuuuuguuuuucaaugugcuccauuaagcaaaaugacugagaauugcauugauuuacucuuauuacuaaaaacagugaaagucaucauuuguguguuuuacaauuacugagaauugccuguuacaaaauuaucuggcacugaaaaacacuaggcggaauuaaagccuuugaauguauuuuagauuuuuuuaaaucuaauauuuuucuuaaccagcccaggauuuggaagcagaugaucaagguucagaucuuagauuugccacuuccuauuuaagaggucugcuuuaucuuucuaaaucuggauuuccaaaguuugaaaaaugguggaugauuauaaggauuagguuaaauauuuguugaauguaaaugcgaauaaugcuucaaaaaggucugauaguugggguguucucuauagaaauacaaaaauucugguguuuaacauagugacagaguguauuuauuuuaucagauauugccuguuuuguauuuguaguuucuuuuuguaacuuuucucacuauuucaagcaauuguaaaugcaguucaccuucuuccacagagauuacuguagaguaauuuaagggaaaaaaaaguaaauuauucaguugauuuuggaaauuucugguacaaaaaaaucggcugaaugauauuuuguaugcuauacucaaagauuaugcuauaaaccauggucagcaaacuauauccugcagaccaaauucagacuaccaccuguuuaguaaguaaaguuuuauggaaacacagccacauucauucauuuauguauugugugugucugcucuuaugauacauuagcagaguugaguaguugugacagagacuuuauauccuaaagagcuuaaaauauuuacucuuugguucuauauaggaaaggcuuggcaaccucuguuacagaccauauuauuuaagaaguaaucauuggguaagagucugguuugcauuucuuucccuuugaccccacccccaucuccacacuuguuccugaacucuuguuccucuacuaagaagagaugaagggucagaaaagucaagauuuuugaaggauaauuaaaaugccauauacauuuuggggaauauaaggauggaaaguguuggagucagaguucuaucugguacuuugaaagcuggaaacugcacaaaaacugcggagcucagcauugucuacuuuuuacauuaauguaggagggcgcuagaguaacacaacucauuucuggagacauccaggauagaauuucuuuuuuauuuaagaagcgcuuuccagauuccaccaguuaagaguugguugcuuaagaguucauaguuuguuagauuauaaauuuauucuuuuuguaauguacuauaucuuucuacuucauuauaaaaagaaacaauauaauuauagcuaccagaguggauuguggaauuaaaaggccauuuccuccauucuguaaaaagacgaccuaggaagaagcaguugcauuauagaaauuguucaguauaugucaucuauagaguaucuagcuuaggaaaugaacuuagaguccagaacaguuucaccaaccacuuagaggauccugcauucauucaauuuaauucagcacacauuuguugauuaacuacuauuacuaucuuuccccauggugaugagugucauuuuucucuucagagguguauaucuuaauuugaaauguuacauucauauuaucucaagauauauauauauauauauauauaugaauauaucuagauaucuagauauauauuuuauaauguauauauaacaaugcccgaauacuguaauauuuaaaaagacaaugaaaauuaguagauuuuuuugccuaauaaaguuauugucaacuauaauuauuuaauuaguuaggauauaucuuuuuuauucauuaaagguuuugggucauuguagaaauuggcaagaaaaaauauugugcuuaugcuuacuuguguaucaaggcuaauuauuggggaaaguggguucguauucauuuuauauucuaagucucuaagaaaagagcuuguauauuuaauauacuuuauucauucauucuguaugauuuuuauauaaauuuuaguugcuucaaguuuuaagguuuuuuuucccccauaaaauucccugaauuccucagagaggcuacagagguaaugauacaaaauauuaaugaagacauguacugcuauguugauacuaauucaugggguuucaugauuacugaauuuacagaccaaagaacugauuauauaugcacuauucaaaagccagcuucucaguuuuccagguaugcucagugagacgaugcgguaaauauccuccccugcgugucuguuugcuucuuggcuuugauuccuugucuuuaccauauuuccagauuucucauacauuucaguucacuucugaaagucaacaucagacaaucugcaacaaugaacuacaaaauggguucucaaaaagcaaagagaacuuuuuaaccucuuucugaguuauacugugaaaaauugacugaaugugaaugccucaguccaguacauucuguugugcuaagcugauuuuaugguuuuacuuuuagaccacaaaguaaugguuauauagguaauagagcuauuuuaaaauucaaacuuugaaauguagaaccaaagauuaguagaguugaaaaacucuugaagacuuccccaacccauccuuccucccucaucuguucccucuucucaagccucaaaugguucaggauuugcccugauuguaauucuaauaccaggauuagaggcccuggugaucuuguucucuugagagauacaaauuucccuaaacacuucucgauagaucuagacauuuagaauucacagcaaacugccuuauauuaucaauacucaauauuaaugaugguccaacacuguauaagacauuacaccaagcacuccggacaugacauagucauuuuccugaaggaacacacgcucguuuagagaugcagacaugugaauccaaaaaagcauaacaacgauuauuauaaacuguuuaauguagaaagaaaaccuucacagaugugauacugacagauugaaagauaauuagcaacuguguggccacgaaguuaaagaaagucauuccaugcagaaggaacagcaugcaaaaaucacaaaagcaccaacauguggucuugucuucccaacuagauuuuaaagccauauuauaaacaagaauugugcagugugucuuuaacauuacccacucucuucuacuuguaacucaacucagugaaugacugagaguugauugaauccuaacaagcauaugaguuggaaucauucauuccauuugaguugcaugcaucuaagguuuuauuccaacuguauaugauacacucuguuuaugcuccuacucaugaucaaaauguuugaauuuuuagggacauaaaaauuuuuugcuaauauuuuccucucucaaaaaaaaguuguauuaagaaguaagcaauuuccuccaaauaagcaucugccaaauuauuuucuacaugcagagcucauggaagauuuaggugacucaggauaaaguuuaacauuuuaaugaauagaaugaaacuuaauaauuagcauaaaaaugaacagccuacugaaaaauuuacuggaugcguaacuuuuuaaguugagcucugaauugcauagccaaacuuuauugguuuauuuaaguuauucuuauucuucggaguuuaauuuugaauuaaaaccaaagagcuguucaauuaucaaauaucaucugauuccuacagguauucuuauauuuuuuucaagccuguucuacucaaaacuaaaaacaaaaaucccaugaaaugauaacguucaauucuaugguaacuugaauauauauuggaacugcauacagaaugcuuuucauauauuauacuaauucuuacucaaaaauuaaaacugaacugaaaugggucauaguuuaaaaagcaagggugaauggaacuauuuauuauucuuuaguacagccaggguaccaccuuaugcguuuuaaauagauaguuacuggguaaauguaaaugaagacaauuugggaagcaggaaucuuaauaguagaucucagaauacacuugauugcuuaaauuugaaagcgccucuuccaauguuuaaauaagucauggcgcauucauauaaugggcuauuaugcagcugcuaaauaguaucaaaaucauuuuguaugucuccaaaauauccuaacucaggccaguucucuccaucugcauggcugcuaaccaccucucuguuguuuugugcuaucaauugaacuaauuccagaguuccuggaguggucucugcuuccauuaaugcccaucagacaauccuuucuuuacaaaccugccaaagugaucuuuuaaaauacaaauuaaauuauaucacucaacugccuauaucucccgauggcuuccaguuacuuucagaauuaaauccaaacaagucccugagucucuccaugaucugugcuaugucaaccuucuuaucccauucacuguccauuccacauucaagccacaucagacauuuucugaugcuaaacuuaccuccaccuucccacuuuauauuuuauugugcuagauuacucuucuccaacaucaauaccuaagugucauucaaguuucagcugaaaugucacuucuucaggggagucuccugacaauuaaaucucaugauccucuucaccaaguuuuuauuaccuaauaguggauuaauuuuaaugcaguagucaacuguuaucugugggggauacauaccaagacccccaguggaucugaaaccauggauaguagagaacccuauauauacuacguuccuuugaucugauaaccaagaugcuuaccaagugaaaacaggcagguggccuguacaguguggauacacugaacaaagggaugauuuauggucuguaugggacagagcaagaugacaccagaguucaucaccgugcuuagagcagcauaggauuuaaaacuuaugaauuguuuuuacuggaauuuuccauuuaauauauuugaacugcaguuggccauggguaacuaaaacucugagaaugaaaccguggauaagggaggacuacuguaauauguaucaauuuuugaagaagaggauuaaauuacugugcauacaguuauuuucacugcaagaaagauuuugcgaaggaguuucguuuuggggcacuguuugaauuucauuuauagccaauaaaauacugucagaaaagcaaagaagcguggcaagggaaaggggguucaggcaacagaggggagauucauaaaccuuguauuucaucuacauguucauaaucuacccuaaugcauucaggaguguuuugggauuuggccagaugacuuuuucucuucagggguuaguugcagagucaagagaaauauuagcuuuaauagucguauagauuacagacauagacuaauaaggagaugaacuuauacucccuccugacaugaugaacucacuugcuacauaacuauaacauaugaaaauucaauacugccgcaaaaugcccauucccagaccauccugcuguaaaacauucaacuuccauaugaggaaaauuuauuuuaaauaacuaaaauagauucuugcauuaccuuuuucauuuaacaaaaacagaccauuggaagcauuaaaauagcugccaauuucuagaguuauauucuggucuguaaauguguguaccaaugcaugaaucagaaaaacauagauaaauuucucuuucuuacaaugguuguacacaaugguuggcucaaucuggcaccaugugcuuuuuucccccauuacugaccauauugaccauugcacauuuaauugcuacccaugauaguaaagagucucuugaaacugcuuugucugcgccucuaaccagaacacagcuacucugucucauuacuuuuucucucauguugaaauugcaguggaaaugagaguugucauguauagaucaaugcauagaaaaaaaaugugguguuaagauuaugaugaucuacuucagcuaucguagaaggugauucaagcugucauuaguauauuauauacuuacauuugaauaauaguuuauauagucccaguacagcaauuuuacugacauauugagauaggaaucuauaaugauuaaugauaugucaauaaacagaauugucuaaaagugaucauaggauuucacucuggauuucuuggacaaugagccagcuacgauugcccccaccucacaccucaugauuuggagggaaucagcucauacuuaguuuuccauaggaccagugguuuucugacaauaagaacuacaaauucccauuggggucaagguauuuaguuauugggcauccaauaaaucuauauugccuagcaguuaacauugucuuuguuccucaauauucuagcgugcucuuaagauuccuuauuaauaggaagagcaacaaaagugggugauaucaccaaaaugauggagcagcaacaauuuggcaucacucuccuucacaaaauuaaaacugaaacaacuguuuggcaccaagacuaucaccaguaauaucccaaaacucaaaacuuaggcugugaaaauccauagggccacaaacaaaugauaaauugugaacagacacuaagauaaacacauuucuguaugcaugaugccaagcacuaugcagaaaaguuccccucacacauaugugucucacuggaaaaaugagaucagaguaggcagccagcuucucuauuaucuuggauuccucugcaguaaguuaauucuugucuuaaugcaagauguguugggaagcauuuugaaagccuguaggaggaaaaaaagaaaguagaguacagcuagaaccaagaaucaaagaggggcuugcaaccauagugugaaaaauuuagaggcugucucuacagaaauacuaaaacagaaaggcaguucagcagcaccauacaaugagaggcauacuccauggauccucuuggcaugaacccauagacagccuuuucacauagcugggauauuccauuugggaaacccaucccauuaaagaaaagcagcaccccaagcuuuugcaagagcccuggcaaaccuaggauugaggugacauguaaugcuaauaagaaggccacaaucuaaaguuaagagaauucaacaaguaaacuauacaguacaccucuaagcagauauaauccaggaagaucuaaccaagccagaaggcaaagacuacaauaaauaaccaauuauucaaugcaagaauauagauguacauauauaagaaacaacacaaccguggccaccucaaauguacaaagaaagaaacuagugauugacccuaaugagaugguaugaguugaguuacuggaagaaaaaaaaaacaaaacucuuugaugagcucccagaaaacacagaaaagcaauucagaaauuuauuacagaaauucaacaaauagauuaaagucauuaaaaauaucaaacagaaauccuggaacuaaagaauacauugaauuagaugaaaaaugcaucagagagucucagcagcaggacugaucaaccagaggaaagaaucagugaacuaaaagacaagcuacuugaaaauagagucacaggagaaaaauaauggaaagaaacaaagaacgccuaugagaucuagagaauagccuuuaaagagcaaauguaagagucauuuuccuucaagaggggguugagagaaagcaaggagaagaaagaguauucacagaaauaaagaaaacuuugcaaacccagagaaaaauagauauauccagguacagaaaggucaaguaucacuaaguaaauacaacccaaaugauacuaucccaggucauauaauagucaaacagugaaauaucaaggcaaagagagaauccuaaaguggaaagagaaaauaaccaaauaauauaaaaaggagcucugaucaaucugaaaacagauuucucagugaaaucucagugauucucagugaaaaccaggccagguggaauggaaugauauauaaaaaguacugaaguuaaaaaaaggauauauaaaaaguacugaaguaaaaaacuugcuaaacaaaacauacuauacucaguaaaaguauccuucaaaccugaaggaaugaggagcuuuucccagaaaacggaagcugaggaaauucaccaagaccagacccuuucuuaaaagaaauaauaaaaugaauuuuucaguuuaaaagaaaaagacacuaauaugcaguuaaacaacaucuuaauguauagacucacagauaaaaguaaguacacagacaaauucagaauacucuaacacugucauugcaaugugaaaaccacucauaucuauaguaugaagacuaaaacacaaauuuuuaaaaauaauaacuaugagaacuuguuaagagauauaaaaagauccaaacugagacaacaaaaaggucaauaugcuggggggaugaaguucaaagaucguuuuauaguuuucuuuguuucuguaucuuuucuuuguuaucaaaguuaauuguuguuuguuuaaaagagcuuuauauagcuauaagauuuuuuauaagcuucaugguauaagagacacacaaaauaaaaagcaaggaaucaaaacauacuaccagagaaaaauuacuaaacccaaacggaagaugguaagaaggaagaaaugccaagaggaguuacaaaacaucagaaaacaaauaaccaaauggcaguaguaaguccuuaccuauaaaaaguaacauugaauguaaauggaaaauucuccaauuaaaagauagaggguagaugaauauauuuuuuaaaagauccaauuauauaacuauauacuucuaacaagaaacucacuucaccuauaaagacacaaauaggauaaaagugaauaaauggcaaaaguuuccaaguaaauggagacaaacaaacaaaaagcaggaauagcuauacuuauaucagauaaaaauagacuucaaguaaaaaacuguaaaaagacacaaagaagaucacuauguaauuauaaaagggucaauucagcaagaggauauaacaauuguaaauauauagguaaucaacacaacagugccucauauuuaaacaaauauuaguagaucuaaauggacauauacaccacaauaaaauaauaguacaagacaucaauaacccccuaccaguaauggacagaucauccagacagaaaauuaaugaacaaauauuggaguuaaacaaaauuauagagcaaauggaccuaaaugacuuuuaaagaagauuuuauccaacggcugcauaauacacauucuucccaucaguacauggaauacuuuguaggguagauaauauauuaggccacaaaacaugucucaaugucucaacaaauuuaaaacagucaaguauuaaauaucuuuuccgaccacaauggaaaaaaucauaaaucaauaauaagaaaaaccuuggaaacucuacgaauauaugaaaauuaagcaacaugcucuuaaauaaccaaugggccaaugaaaaaguuaggacaauuugaaaaaaaaaagaaacaagagaaaauguaaaaacaacauaccaaaaccuaugggauacagcaaaagcaguacuaaagggaaaauuuauagcaaugaacaucuacauaaaaaaaagugguaaagcuucaaauaagcugccuaaugauacauguagagaaacuggaaaggcaagaauaaaccaaacccaaaauuaguaugaggcaagaaaucauaaaguucagagaauaaauaaaugaaaucgagacuaaaaacauacaaaagaucaacaaaaugaaaaguugauuuuuaaaaacagauaaucaaaauugacaaagcuuuagguagacuaaggaagaaaaaaaagaagaccuaaauaaauaaaauaaaaaaugaaaaaggagacauuacagcuuuguauuuaaugacaucacaaaauacaaaggaugauuauagcauauuauaacaacuauauuccaacaaaucagaaaaccuucaacaaaaaaauucaaagaaaaaauucauagguacauacaacuuaccaagauugaaauaugaggaaauagaacaucugaacagaccaauauugaauaaggcaguugaagcaguaauaaaaagccucccauauaaaaacccaggacuuaaugagaacugcugaacucuaccaaauuuuuaaagaagaaccaauaacaauucuacucaaacucuucaaaaaauauuuaagaggaugaaauacuuccaaacucauuuuaugaggccagaauuaugcugauaccaaauccaugcaaggacaacacaaaaaaggaaagugcaggucaauauucauaaugaauaaaaugcaaaauucucaacaaaauacuagcaaacauaauucaauaacauauuaaaaagaucauucaucaugaucaaaugagauucaucccagugaugcaaagaugguucaacauauuuaaaucuguaaaugugauacaucauauuaacagaauuuuuaaaaaaauguuuauuuccauagaugcuaaaaaaguauuugauauaauacacccuuucaggauaaaagcucucaacaaucuugguauagaaggaacauacuucaaaacaauaaagccuuacgugacaaacccauagcuauugucauacuaaauggagaaaaauugaaacccuuuccuuugagaucuggaacaacaagguuaaccgcuuucacuacuuuuauucaacauacuacuagguaaguacuagccagagcaauuagguuugagaaagaaauaaagaucauccaaacugggaaugaagaaaucaaaauacuccuguucacagauggcacaaucuuauauuaagaaaaaccuggcugggugcaguggcacaugccuguaaucccagcacuuugggaggcugaggaggguggaucacgaggucaggagaucaagaccuuccuggcuaacauggugaaacccugucucuacuaaaaaaaauacaaaaauuagcugggcauggugaugggcaccuguggucccagcuacucaggaggcugaggcaggagaauggugugaacccgggagguggagcuugcagugagccgagaucaggccacugcacuccaggcugggugacagagcgagacucccucucaaaaacaaagaaaaaagaaaaaccuaaagaccaccccaaaacuaguacagcugauaaacaaaauuaguacaguuuuauuauacaaaaauuaaauacaaaacucaguagcauuuauguacaccaacagcaaacaaucugaaaaagaaaucaagaaagcaaccccauuuacaauagcuacaagaaaaaaaaaauaccugggaauaaauauaaacaaaaaagugaaggaucucuacaaauaaaauuauacugacaaaagaaauugaagaacaaacccccuaaaauggaaagauaucccauaucuguggauugcaagaauuaauauuguuaaaaugaugaaaauaucuaaaaugaucaaggauggaaugcagucccuaucaaaauaccaauuacauucuucacagaaauagaaaaagcaacccuaaaauguacaugggaccacaaacaauacugaauagccaaagcaaccaugagcacaauuggcaaagcuggaaacaucacacuaccugaccucaaaguauacuacaaagcccuaguaauuguaaugaauauggcugugcuuuagucaugaguaggccaaggcagacauccaguacagcacgacacagcagguuuggagugcaggcacacaaucccaugcacuauauaaucacauuuauguagccauuuaauguaaccuguuugaguucauaucuggccuugaacuacuguugucuaugagaaauauaacugcacugcugacucuguaggagggggagagaauaaagccaugucccaacugccuguggucccuugaguguuuuucagcugccugccaccuguucaccagcuccccucagaccccagcuuagucugggaacuggaacuugacaauugguguagucagcaggauuccgaggugagugagcccuuggccccugaugauccuaggucagccguguggccccaauauggguuaugguacccagugacagccaugcugcuaagaugggcccugguggagacauggguggugguggacagguccccugugugcauggauaaggcacugaagcaccuggaagcacagagcacugagaaggagugugccuuucccagcagaauuggaugggcauuuuugacugugcuaugggaagugcaugcucagucccugcaggaugcagcacagguaagggaccuccaggcacaagcagagagccugaaggccgacguacacagguuggagugagaauuagaggcugcuauuaguguaggcuugggccugccaccccagucagagaccccugcccgaucugacaccgaggaggaagaaccucuguugugggcucccccaguggcucaucagaaaauacaccaggaagucauugaggccccaggggugggcucagagaccuccuaccaugauggagcacaagucauacacugccuauaccccaacggaguugugggaauaaaguaaacagugcuggcagcgcuugggggaaauccuacccaccuagaugcuucgccuuugggaugagggagccaacaguauugucugcuccuccucugagauggaaaaguuggccuccauuaugacucaucccucccuccaucagcaauugcaggugagcaagugguuagcacaggggcaaggcaaccacaccauaauugaauggcugauggaggccaugcaaauggugugggacuaugccagagaaauaccagaaacugugaguaaauggcagucauaaacagauguggugcagguaauucaggagauggguaugcagcaggcuauguuugauccgaauacccgagggccagaugaugaacaccuuaccucccacaugagggaccuuguguugugcucugcaccccugagugccuuuggcucccuggccacugucaaucugugugcagggugcugcauacaugaggugacuacugccauggcagcccucggggaagcagaggagucuaugccauaaaaagggggaagguacuccuucugcagggggccaucucaugggacaaaagggccccaguggugacucauacacauauguggauugguuugauuuuggcugggguugaccgagagaaaacugagaggcaacccaaugaagugcuguuaacuuuguggaggcaauugucccugaaucaccaauuccagaaaaugcccaacagcgggcgggaugaugcugcuugaccaugucccacccagaugcuccagcucaaggacuacuugcagaugggugaagguauagagcguuuuguguuugauuaggaaacuggucaaggugcccagcuuggggggacaccagacaacaggaggccacauguggaauuggcaguccacuggucucccaccaauguacagcaggugcugcugcugguagacauuggcacagauuguagccucaucuaugggaacccggauaaguuuccaggcaagguugcauacauagacagaggccagucagugggagugaagccugcaucuuugcaccuuggccucaggcacuuggcugcaugcuuauaaacuguguauaucuccuccauacuugaauacauuccaggguagauauuuuucacagcuugguuuuacaagccacggucagagaauucagacuccaaauacaugugguugagccauuaucggguggacauacguaucacuggccccagguccugccacaaccccgacagguuacuuccacccaucaauaccacuuuccagguggccauauggcgauaacugagacuaguaagauguuagaggaggugcagauagugcauggaaugcacaaacccuacaauucucugguauggccagucagaaagccugacggaacuuggaagaugaugguggauguucgagaacuaaauaaaguaacacccccuucacaugcagcugugcugucuaucacggauuugauggaucacuugaugauggaauugggacaguaccacugugugauggacuuggcccauacauucuucccaauugacaucacaccagagagccaggaacaguuugucuucacauggaaagggcgacaauagacuuucacgguguugcugcagggcugugugcauaaacccaccauaugucauaaaggggguccaccuuuuccauuauauggaugauauuauguuaaccucugauucucuugcagauuuagaaauagcggcaccccuccuacagcaacauuuggcagcaugcaguuuggcugugaaugaaaacaagguccaaaggccuggauugucugccaaaguuuugggaguuaucugguuggguaagacgaacgccauaccagaggccaucauuaauaaaauucaggcauauccccagaccacaauaaugaggcaacuagagacuuuugugagccucuugggauauuggaaagcauuugugcuccauuuggcucagaaaacaaaaccauuguaucaguugacaaaaacaggaauuacuugggauugggacaaugaggcugagauggcuuuucuggcagccaaaugggccauacagcaagugcaggugcuacaaguaauugaccuggggcacccauuugaacuugaugugcaugugaccacagaagguuuuggcuggggccuauggcagugcagagagcacuguagaacacaaguaggcuuuuggucccaacuuuggaauggaggugagcucugcuauucauggauagagaaggaauuaacaacuguauaugccacccuucaggcuugugagagugugacaggaagggcuacagucauuguguggacaacuuacccaauaguuggggagcaaguauguucauggguaaugaaccccagacugggauggcagagauauccaccuuagcaaaguggggcuccuacuuagaacagcagaguacccugaguacaagccccuuaucagcagaauuauaagaagucuugggaccuguaguccugaugcaagauaaggccaugggucagccugaggcgccccuaaacacugagccauuaccauuucaagagaggcaccucccauuccugaugaggcaugguagacaggauggguccagccagggugcuacugcugccuggacugcugucaugguccagccuaguacugauaccauaugguuuaauaccuggacaaaguagucaauagguugaacucagggcacuguggauggugaucacuaaggaggagacaccuaugguaaucuucacugguagcugggcaguuuauuaagcccuaaccuugugguuaacuaccugaaaguuacagaauuagcuaguuggucacaggcccauuuggggccaggccauguggccagaccuaugggaaaugggccaucgaaagguuguaacuauuuaucaugugucaggacaugugccuuucacugcccugggcaaugaugaggcaaaugccuuggccagguccggugguuggagucagcaccuacacgagauguagcucuauggcugcagcagaaauugggccacgucgggaguaaacuaauggaauaggucaauaagugcuauggucuaucuuugucuauguaagauaucugggaggucugccagaaaugcccagcguggacacagacauaccccagacagagacagcugcccaauguuacacaacaagugacaguaggguggaugcucuugacuagauggcaaauagacuacaucaggucacugcugagguugcaggggcauaugcaugugcugacagcuguagacacggccaccagucugcuguuugccuacccuugcaggauggccaaccaacaacauacaauucaggcccugcaacacuugugugcccuauacagucauccccugacuguugaaugugauaggggaacacauuuuccuggauagcacguacaacagugggcacaauggauggacauaaaguggagguuccauauaacccacaaacuacugguauuauugagugauauaagggacuccugaaaaauaaguuacauuugcauguuacuccaccucuuuguggggcuagaguucaagguuggaccuggugcuccaaagcuugaaugagcggccaugaaaaggcagccaggccccaguagaggcacugcuacacugugccacugaccccauccacuuacagaugcacaccaaagaugacuuccuccaaccagguauggggacaaugguaaucuguuguugccugccccaaugucuguaaaggcaggggaacaaaaaaccuggcuuuggccacagacccuccaaguccaccaugacguaugguuggcuaucauagucccuugcagggagagccuauaguaugauuuacaugucacucauuggguacuuaauauauggccucuaugauugaccauucauaggggaauggccagggaaggaagucuccagggaacaucuguauuuccuguguggccuauuaugagcuccccaguaacucuggcaagauauagacccaaaggaaccauggggugcugaaaaguugugguaccaucacccagggcagaaguccuuugcaguugcauuguuaucuagagaugaaagcuuggccuguauuuugccugaagggcaugauuuaccccuguuaguaccugugccuacuuugucauuuagaccauagguugacaugcuccaacagcauuguggaauggucccacaccuacgaugaguugaccaauguguccaaccguuggaucugcaccacccuucaagcagcagcaggggaugucuugcccuggcacauacauccagcuucuguggaaaacuggacauggauggacacuaggaguuccauggcugacguuuagaaugcaacaugggcagcuuuggauaggggaugccacaaaacccauggcaugcuugcuuccuggcugaccuguaaugucugugauggauggggcucguuagugggagaacacaaggugccccuaacacagguaucaugauguguagagcaacacugggguaaugucaccguggggugguugucugccauagucugaacacauauaauauguuaucaccacaccaaaggugugauggaauaggugaccacaucaaggcugggccccagaggacuuugugcccccugggaguuuaugggacuguggagacacaguauggucauauuugccagcaaacaggauuggccgcucuaccuggggguggccuuaugugcuugccacaguuauuuccacauuccuuagaugcccacauaacuggaaggugcuacguuccugguuuuugcaagugugaugagcccccugguggcucuaccucuuagcauuaaccaucccuggagcaggugucguaacuguagaaaugcaaguuauggcccuuccagagcauaacacuugagacuugaauuacacccaaguuguccuccuucuguugacagaugauguugaucaaaccaggaaagugguagugcagaaccugauaggccuacauauugauugcugcccaagguggcaucugugcuguuuugggaaugcaauguuguaccuucaucccugacaaucaacaaaacauagcagcuuugcaaggaguuucccaggaaaucaaggcagcugacagccuuacugaugaccccccauagacauggugggugucucugggcucuggccuaugcuggacccuaauaaucaugggcagcauagcaggaauacuaguagugaguuguugcucccuguauugcugcuguggccucuguguccagguuucugcccugugggcaugucucccugcuaggagaacucccuuagccuagaggguggagcguaaggaaaguggcugugcuuuggucaggagaaggcugaggcagacaucugguacagcaugacacaguggguuuguagugcaggcgcacaauuccgcgcacuauguaaucacauuuguagccauuuaauguaaccuguuugugugagcucguaucuggcuuugagccacuguugucugugagaaauauaacugcacagcugacucuauaggaggggaagagaauaacaccauuucccaacugccuauggucccuugaguguucuuuuagccaccugccaccuguccccucagaccccagcucagguuggaaccugacaguaaucaaaacaacauaguacuggcauaaaaacaaacacacuggccaagggaacagaauagagaacccagaaauaacuccaugcauuuauagccaacucauuuuugacaaaggcaccaagaacacacauuagguaaaguacagucucuucaauaaguggugaugggaaaauuggauaaccaugugcagaagaaagaaacuagacccauucucucaccauauacaaaaaucaaauauaauggauuaaagacuuaaguguaagaccuuacauguaagaccuaaaacucugaaacuacuagaagaaaacacugaauaaauguuucaggacauugaucuaauccagagguauacaaucuuuuggcuaggccacauuggaagaauuaccuugggccacacauugaauacacuaacacuuaagauagcugaugagcuaaacaaaaauugccaauaaauuucauaauguuuuaagaaaguuuacaaauuuguacugggccauauucaaagccauccugagcugcauguggcccauaggcugcggguuggacaaguuugaucuuggcaaagauuuuuuuaguaagaccucaaaagcacagauaacaaaagcaaaaagaaacaaacaaaaaaauuacauguuauuggaucaaauaaaaaagcuucuuuacugcaaaggaaauaaucaauaaaauuaaauuacgacuuacagaaugggagaaaacauuugcaaauauccaucugacaaaagauaaauaaccagaauaaauaaggaacucaacucaauaaaaaaacuccgauuuuaaaaugagcaaaagaucugacuagaaauuucucaaaagaagacauacaaauagcuaacaaguauaugaaaauaauacucaaccucacuuaucaucaaagaauugcaaaucaaaaucacaaugauggcaguuugaggcggcucuugccuguaaucccagcacuuugguaggcugaggcaggcagaucacuugaggucaggacuucaagaccagccuggccaacaugacaaaaccucauuucuacaaaaaauacaaaaauuagccagcauguuggugcacgcuugcagcaugccucagcuauuugggaggcugagacaugagaauugcuugaaccugggagggagagguugcaguaagccuagauugcgccauugcacuccagccuggaugaaagagaggggcucuguuucaaaacaacaacaacaaaaaucacaaugaaauaucaucucacuccacuuaaaaugacuauuaucaaaaagacagaaaauaauaaauguuggugaggaugaagagaagggcaacacuugaacacugcugauggggagguaaauuaauagagacaguauggaaaacaguaugcacauuucucaaaaaacuaauaauggaacaacaguaugauccagaaaucucacuaaugguucuaaaaccaaaauaaaggaaaucaguauaucaaagagauaccugaacuccuguguucauugcggcacuauucacaauagccaaaauauagaaucaaccuaaauguacaccaacagaugaauggauaaagaaaauaugacauauauauauauauauauauauauauauauauauauucauauauauacacacacaauggaauauuauuuagccauaaaaauaacgaaauccuguuauuugcagccacuuggauggaaauagacauuaugguaaauaaaauaggccaggcacauaaagacaaauagcacauguucucacucauauauaaugcuaaaaauauucacuucauguaguuaggaguagauugguggucaucagaggcucggaaggauagggcaaagagaggaauaaagagagguugguuaauggguacacaaacaaauaccuccuuguuuguuucagcuucugguagccccaggcauuccauggcuuguugaugaauaacucuaaucucugcuucagguuaacauggccuucccuucuacccuugucuaagucuucucuuuugucuguuucaaaucacccucugccuuucucuuauaaugacacuugucauuagauuuaggauguaccuugauaacacaggauaaucucauucauaauccuuuaauuauaucugcaaacacucuuuuaucaaaugcuucacagucacagguucugggugggcauauauuuuucaaggccacuauccaacacacuacuuugacaaagagaaaaagaaagaauacucuaauuacuuacgguugaaaaggagaaauuaacagcaauauuacuagauauuacuaccaggauuuuaauuacaaauaaaaaagcuuacaaaggaauaauauaaacaauucuaugccuacaagugagauaaacuggggaaaaugggcaaauuccuaggaagacacaaauaacaaaacugccucaagaagaaagguaaaauuagcauauauguaaaacacauaaagagauuggauuaguaauaaaaaaaaaauuuccacaacagaaacuucaagccaaaguagauucacuggugaauucuaccaaauguuuaaagaauuaacaguaauccuucgcaaacacuuccaaaauauagaauagaagggaacacuucccaguucaugucugaguccuauauaccuucauaccaaaaguaugugaaggcaucacagaaaaaacuauaaaucaauauuucuuauuaauauguauguaaaaauccucaacaaaaauacuagcagacugcaucauccaaaaauauauacaaaaauuuauacaccaggaccaaauaagauuuaucaaguaugcaagauuaguuuagaauaugaaaaucaaugaauauaguauauuauaucaauagaauuaagaaaaaaauuccucaagaccaucucaauagauugaaaaaaauuuuggcaaaaucuggcacccuuucaugauaaguauagucaacaaacuaagaauagaggcaaauugccucacccuaacaaaggccaacaaugaacaacucauaguuaacacaauaauuaauggugaaaaaugaaaugcauucuuugaagauuaggaacaacacauaaauaucuguuuagcccacuucuauucuacacuguauuggugguucuggccagauaaaauagucuagaaaauuaaaucaaagguaccgaaauuagaaggaagaaacaaagccaucccuuugaaaccaacccaacacucucacagacacgucuuuggauaaacauagaaauugacccuguuggucuuaaagcuugaaacuuacauuuguuuuaucugaguuccugccucagaaaaauaucuucaggccucccaaaaaguagaaaagaacugaaacucaccggauuauagcaaccagacaaugagacuccaggccccucauuuaucaggauuacuucuuuaccuccccccaacuaaguuucuguuuucucauauauaguuacauuucuucccugcuauacaaacuccuaauuuuuagucuaucaggcagaugguuugagacugaacucccaucuccucgacuguagcaccugauuaaagccuucuuccuuggcaauaaucaucaucucaguaauuggcuuucugugcugcaagaugcaggaccuagcccgaaccccuguguugguaacaccuauucucagaugacauaaucuguuuugguaacaccuauucucagaugacauaaucuguuuugguaacaccuauucucagaugacauaaucugauauuuaggaauucuaaggaauucacacaaaaagaucaaauuaauaaaugaguucagcaagauggcaagauacaacuucaauauaaaaaaacacuagcaauaaacaaucugaaaauaaaauuaauaaaaauuuuuacuuacaaugauauaaaaaagaaaauauuuaggaauaaauuacacacacauacacacaaaaguguaagacuuguacucuaaaaacugcaaaauguugcuaaaagaaauuuuuaaagacccaaagaaaugaaagaauauucaguguuuauggauuguaagaguuacaguguuaaaacagcaauacuccucaaauugauauacagcuucaauacaacaccaguggcuauucuugcagaauuagaaagcuaauccuggaaacgaucauucucagcaaacuaacacaggaacagguaaccaaacaccgcauguucucacucauaaguaggaguugaacaaugauaauauaugggcacagggaggggaagaucacacacuagggccuucgggguguggggggaggaaggggagggauaaaaaaaagaagcuaauccuaaaauucauauagaaugcaaaugacacaaaauagucaaaauguuggggcaaaaaaguugugaaacucacaguuuccaauuuaaaacuuacuaccaaauuacaauaauaaagacaguguggugcuggcuuggggauuugguuuauagauuaguggaauuauagauuugguuuauagauuagugaaacccggucuguacuaaaaauacaaaaaucagccaggugugguggcaugccuguuaucccagcuacucaggaggcugaagcaggagaaucgcuugaacccaggauguggagauugcagugagccaagauggcgccacugcacuccagccugggcaagagagcaaaacucugucuaaauaaauauauauauucagcuaaauaaauuagacuaaaagugauuucaaauugcagcuuguauauauacaagucagaauggaacauaauucaugucaauagacagaucauuggcagaguacagauaaucuauuuaagaugcaguaugaagaagucacagccaacaggaaauuauauggaaggcugaauguagaggacuugcuuugaaacagguaagauuucucuucaaugcuauguguacuuuuaaaaaugugacaccauagaucauacuucuugaucuuacacuaugacuguguuuggcuagauuaacacauuagugcucuugagagaaaauuagucuaagucuuuucagcacccaugcuuuuggaaauguguuucuguguuacuuuucccucuuuaaauugauauaugaaccaucuacuggaguaaaaauuaguucuccucuccagaaaguaaggaacaugacucaaagggccuuuaucuaaaugaacucugaaccgacaggauuuuuuuuuuuuuugcaacuuucuuccuauacaacuuuguuuuauuauuucguucacaguguauauaaacaaaucaaagaaaaagucaaucuaaaaugcuuaauuuuauuacugauuguaaacggaauugaaaaugaaaauuucuaaaguccaauuugauccaauucucugaguuuggggggaaaagcuuauagaauuuuaaguaaugugaauuaaauuguuuuaucuuaaaacaaguauuuuucacaaaauacaaccugguuucaagcauugcaaucuauaguuauuucugcuaaaaauggagugcucuguagaacaaaacaaaaauaaauuagggcaggcuuaugguggaggaaauuuugauguuucucucugugaaguaauugaagauggccaaggaggcucccaaauucuucauuacaguuccugaagggaaaugaggauguggucuaggcagacucaugcuauaauuccuccucagauauccuuucccaucuuuaaauuuccaaauccuucuucuuuuagaagcagugugaaugccaguugcauugauaggcucuccaagaucaucuccagauguauuuccugcuucugaauucaauuaaugcuuuaucuacacagacuacaugccauuuauuacuuuguaccuuuaacuucucuuacuaacugugaguuccauguaucuuuuucuuuauuucaacuccaguacaguacuuuaguaaguaaguaaucaauuauauauauguuuauucuauguuuauguauauguuagaauauauguuuauauauguuugaauaaacauauauaauuguauauauguguuuauauauaaaccauauauaugauuacuuaaauauauuauauauuaaauuacauacauauaauguauauauauguuuauauauggaaaucauauguaugauuacuuaaaaguaaguaaucauagauacauguuagaauaaauaaaaaaaucauuuagggagaacuugagaaaucacaucaaaaaauauucaauaagaaucaauuugacaagaccucuucuuuuaauucugacggauagaagaacacuagaaagguaagaauuuuguuggagaagagaaaguauagaaugaauauggauuaugagggauuuacuuaugaagacaaguuugggugaaguacacuguagacucaggaacuaagaagccugaaguuggcuaaaaucauugaacucuccaaaaaaagagaaguguuguuuacuggaaggaagaagcauauuaaaauaugacuuauuuauuaauaaauaguaaacgguaaaguauacauuucuaauuugaaaauacauuaccuucaauucuugauaaaaaugauuauacaaaccacagauauagauagauaaacaauguuuuaaucagaaaacuaguaaauguuuuucagaaaugggaaauuuaagugcauucauacuuuuucaguguuuaagauuuuuaaucaauagacacaacuuuaacccaaauuuagaaacagaggagauaaaguacuaaguccugagaccagauucaauaaguagaagugguaaguaggugcauguacaagaagagcagagacugacacguuguucacucugagccucaguuuucacaauuguaaaaugaacacaauaaaacagggucauuaagaaguggaaaggagauuacauguacuguggaccuugguauucccucgagguuaaugcccacuccacaauuccaaugggaaguuucugaauuucccccuuaguagggccaguggcauuagguuaacuauaacucaagaacugagaacacauuaacagaugcucugcaguuggaugauuuaagucuacaggaugugacaaaauuaaagauagacugcugacuuccauuuuuguuauaccugaauggcuaauaugcucauuuggcuguuauucucaaauaucaucuaauaguucuucaauccccaugaaauaagugauaaaaucuacaaacagccugguagacauggauuucgucuuugaucuugauaugggaaaaaaaagaaggcuuuuaggggaugaaguaagugaaaaucaggaaggcaauagcuuccaaccaguuugccagagccucggaaagcaaaacccuucuagaagaucacaagggauaucuuacaauguuucacuucugacuggcagaauuaauuugugcuauuuuauucuaguucauuguaauuuuuauuuuaguuucaauuguucuccauuaaaauucauuguuuuuaauagccauaaaccagacaggauuaaauucaauguauuuaucaucauuugcuaaaucggugaauguaucugaaaagaucaauuuuauaaacucaaggaauugacgaaguaaauggagggcuucuuauguuucuaacuuuccuuuccuuuagcauguuuccacauggacaucagcacauguccacgcguauugugggcuuuugagaaagucaucaccgccugaacucagagccacaucuagagaccauuuaggcuuaggagacuugaucaucacccaagaaggcuguauguuuucuucacgucgcauggguuacaaauacacuuggagacacauaucagggcagggaagagcuguggugaggucccauucaacagagcauucacacuuuuuugccauccucaaucaaggcacaucuggggcuucuauuuagacccagcaaauauaagaaguaggaaggagccucacuccacaauccguccuaauccaguacucacaauuuggcugaguagaucuuugcugcucauuuuccucuuuuuuugaccuucuuuugaaauucuggcaaggugaauuuugaggccuaccuuugaagaaggugauuuggccuuaccacuuguacccauaagccuaccuuguuuagucuccuaugucuuuauucucaugccuuacccuuucucauuucuucaccaucgucuacacuucugcacaagcauauucuuagaaugcaaauagaaauaacaacaacaacaaaauuuaagguuacuauucaaccucaaaaaaccaagcauacauuuaucccuaugcuauucucguccugaaaauacucacuauacaaaaguaaauuuaaugcuuauacuguagugcuuuacgaaggcaaaaaaaaaaaaaaaaaaaaaugaccuguuagagguggcaagaacuuuccauuugauucugcuugccuucauuauuuugcaggggaggaaacugaaaacgaggagaugaaagugauucaccuaaggucagaggguaacuaauuaucagaggcaagggcuagacacaaacaauuccccugacauaauccaguuaacucucccccacaucaugaauuuuuauugucucuauucuguggucagcuagaacaaaccuuaauucgaagaaaacacacaaauauguaauguaugcuuuacuuacucgacauggaaaugagaaaacaauaaaggguuguuuugggaaaucuguucucucccuuggauccagauacaugucaaacauaagaaaaugccauuguaacuagggucccagaggagcugaccugccuagccggcaucacaggcuuaucacagauuugacaaccucacucaucauuuuaucaagaaaugcucuauuucuacauugcccaaagcgccuccuucaauuuaaucacuuauaaaacuccauggcuucugcuagaauggaugauaaauugauuuuauccucugguaguugggaaucacuaaucuuguuuagcuuuugcugugaguguuauaugcaguugguaaaugcccauggaaacauagacuagauuuggaacauauuccuaaaugugcagaugcauugccuucauaagcuagcucaucgaauuauuugugaagggaaaauaaaaacaaauauuaaucaaauugccuauguaguaaauguauuuuaaagcauuccaucuuuuaaaggggguauacuuaaauauaaagugagaaaaaugcauugcaguauaacaguugaccaggaauccuuuaagacccccacucagguuaauuagaacauguguuucagucaguauaaaugaaucuauagcagucauacauauaucacacaguacuauacccuccuaacuguugguuauuugccuuucagauucaagucucaugcuguucuguaagcaggguaucaaugcuacuucauuucauugaaaaaaauuauaaguaaacauuuuguaacagaauuuuaaagauaauauucuuuaugcuuucagggaaacuuuuauuuuucacuucuuaaaauauuauuauucaauauuuucauaacuuuuaguauuuuacuacauacaaagcauuuuuauuuuuauuuauuuauuuauuuuuauuuauuuauuuuuuuugagacauagagucucgcucuguggcccaggcuggagugcaguggugcgaucucugcucacuacaaacuccgccucccggauucaugccauucuccugccucagccuccugaguagcugggacuacaggugcccgccaccaugcccagcuaauuuuuuguauuuuuaguacagacagcguuucaccguguuagccaggauggucucgaucuccugaccuugugauccgcccgccucggccucccaaaaguacuggcauuacaggcgugagccacuguuuccggccugcauuuuuauuuuuuaaauuuuuuauuuacuucaauagauuuggggauacaaaugguuuuugguuacauggaugaacuguauaguggugacaucugagauaugagugcaccuaucacucaagcaggguacacuguacucaauauguaugguuauuuucucccucauacaaagcauuuuucuuuugcaaauaauaccuaauuuaauguuuccucauucuauauugaaaugcauggugaauuuugucaauaaaauugggcagauuuuuuucaaaagacuguauuuuuaucuuauucucuuuccuuuuucuuaguaauaaacuuuuaagugucuguuuuuaccaagaacacacccagagacaguggguggcuugagaugcuagaugagaaagugaggcucucuuaacuaccuuuaauaauucuugcucuuuauugauuuuguacaccugggcucuuuauuuuccuuaccugucccagaaaccuaauuucugggauuagaaacaugcugucuucuguuuucuaguucucuuauuucaccuccucauagguucuuuuuagaucacuccaggaaacaucaccuuaacaacagaaaugcaaacauaaccuuuuucaaaaucuaucaaauuuuguuuucaaaauuuuuaaagugauucaagacacaaacaugacuccaaaacaaucuacuuauuuuagagauucaccacuauuaaccuucugcgcuauagaauuuuucauuuucuagauuuuuuugaagccaugcuauucaggaagagcaaaaaugggacacuugucagggauagauuugacaucauugaacagaaccuacagagcuuuauucuguugcuaaaaucaauuuugacuuaauacuuguggauaaacggagguauauaaauaaaaagaaaaugucauguucaauacugaucucaaacugaguucaugucaaggaaaguaaguuagaaagcgugugcuuccuuuuacuacuuuauuuccaaggguuauuauuuagauaugucugccuggauuauagacuuauccuuaaauugcgcuuagauuacucaaguauucauuacaucacaaaucucaucuuguuugguguuguuuacucagaagaaauaaagaccuaguaaauauuuguagacuacuucaaauaaaaauucagaaaauauuuaauaauauuuuauugcauucaggauuuuuguuaaaugaguagauuuuagcugcuuuugccacaaaaggaaaaaauguuuaagaugauggauauuuuaauuugcuccccuauaauauacacuuuacuguauaugcauaucauauaacaucauguuguauagcuucaauauacacaacacaguuuauuuaaaaacagauaaagcaacugagaaaccaaagcaagaugaaagaagcaugaaccuuaguucacacuuaucucugugcagagaugaagccugaauuuuguauacauucaucugucuuagaguugcguacaaguugcuuuuagaauucugccaaaggaguugguuugacaccugcuuaagaagauaugaaaagauuuacaaauugauguuuagaauaacaacuccaaggaagaaccaaggaacuaagaugaaacuccaaauguuuaaaacguggauugauuugugaugccuaaccucaauaaaauaguuucccaaagacauuuuuaugagcaagaugaacaugaggaagggcacaguauuugccaagugaauguuggcuugucaaauucuauuuuuacauuguggaaaucguauuaguuacucaugcuuucucucucucucugucucucucucucucucucccccucucucuccuccugccccccucuucucucaaccuuuuauauguauuuggucuuagcaaacauuuccauuuggcagugcaccauugugugcacaaggaugaaaacucgcaaaauaaguuuuguuuguuuguuuguuuuuacucacguuccaaucaccaucuuucuagagacauugcguuucuuaauuauagaaaaucagagcaguuuuaccaucuuggaauccagaaaauaaaacaagacaauaggcuucucuuauuuuuccaacagucacaaccauuuuugcauccucauaucuuuagaucaaggauacagaguuucagggagguaucacuuucugcaggcuuauauagaaauucucacaagcagacacauaauagaagaugaauuaccuuuuucuggaaauugugagaaauuuuguuucacaaaguaggcagaggaugaccccacaauuucuaauucaaaaucaaaaaucaauauuuucuuuacuucuuuuguauccacagauaugagacauuaguuucaucucagcuucugaauccauagaagauucacuaacagcacuggguuuguaagagaguaggaaugcucugaugggugccuggcauccucucuaaaaacgcucuccaauuaccgaagugacaaagccuuucgugugcauccuucaugugagucaccauuguacccuuuggggaguuaaucuuuggggagucagucucuugacacugcagcucagauaauaauuccaaaacgcccuaaucugaguugcaaaaguccccauaagaaaaaaaaauacaauauauuaaaggcaauaaaacuuacuuucugauuuucccuuacuuugggaucauguuguuuuuuuuuuguuaaaaagaagaaaaacaugaugauacacuucccaugagcauuguuauguuauuauaccagagaagugagcagaacccaacccuccaaagcucacacgggugugggauaaaaggggcaauacaagauuccauucugugaugaaauucuaugcucugaaugccacugaaguguucuuguagcuagaaugauuuaguuguacauggaaacuuuauuuucauauaacagccuuauaauuucucaucuuuggguuuuuuguuugcuuguuguuuuguuuuuuuugggggggcuuugcaaaaaucuuuaugccuuuuucauauaauaugcacucuagaaagaauauaauuuuuuaaaagauugagagaaauaaaaagcauauuuauagauaaauaucuacaaauacauauagcauauuuuuccauugguauaauuacauaauuggcuuagauuuuagacaguaaagucaccauuacaaagugagaaaaaauuaucugcuucgccauuuaucaguacuacauucccaugauagauauagaaucuuauugcucauugaaaaucuucauuuuaaaguggauacugaggucuaguaaggugaauaaacuacuuaaaauuccaguguuacuuugggaauuuaaagauaauuuaaagagaacucuaaaaauaugaacuuauuuuuaccuaaucaauuauguauuaacaaauauauacgauauuuuaagugcagauacaccuuuaucuuaguauuuucccauuggguacuacagaaccuuacauauagcagguacuccauaaauaaaauguuaaauugaauucuacacuuaaaugucuuacuguuuuuuguucauaccuguuucacucaacaaacauuuaucagccuuuacucaaaaguuaugucgcgggaaaacauguuuagaccauuuuauccaaacccacagucuuuacacuuuguguuuccauucugugauuguuuuuuauuuuacaacuuaccaauacuuagcauaguauacauuuuucuaauuuaucuuguauauugccuuuuucuuccuuuggaauauaagcuucaugaggauagacagguuuauauuauucacugccauauuuuuuccuagugauuaaaacagugucugagauauauaaaauauaguagcuguucaauaaauauuuguugaguuaaaaaaacaacaaaugauuauugaaacuugugagguguugauaguggcaggaggcagacaaaugccuaggcagguaggggcagguccccagugaaauccccccuccaaaccaaaggcaguuuaaagccugaaagccaagcuacaagucaaaucuauggacuggauugagaaccugucuucccauuugaugcgcuuucuucugauugaucccuacccaucacugauuuuacauauaccuaccuuucccuaauuuguuuuuuauacugucaugcccaccuuuaaguggugcuuuuguuuuaaccuuuuuugcauacucaaaccagucagcacacuccccuauucugagcccauagaaguccugaacucagccacacugagaaagaaaccacccgacuucagggguuggagaccacccccacgugccuucucugcugagagcuauucccuugcucaauaaaauuccucuccacccaucuucacccuucgaauugucagcauauccucauucuucuuggaugggggacaagagcuugggaaucgccgaacauggguacaagcuguagcacacgcaggccaagugggcagggcaccuccaaugacaguuccaaggccaacuguggcccugguagcaggugggggugugugugucacuggccguggagguccccaguuggcaaauuggcugagaaaacuccugcaucaguguuacacagaguucugauguaaggauaauguaaaacuuaguuauauuuuauagccuuucucaugaaccauacacauuauuauuacuacuaaaagagcaguaagagaaagguucgguuuucaauuagacaaguuaaaaacuaaauuagcuuuuugcaaugcucuuuauauauuucuacuugauuuccuacucauuuucaauauaaucuuuuaauauaaucaaaggagacugaggaucaugaaggcaauagugagauguuaaggaguuuucaguaacuuuuaaaaauugauacauuauauuuguacauauuuauaggguacaugugaaaaaagguuuaaccuaagaauuauucaaggaaggaacuguuguugggugauaguaauuaaaaugcagacuugggaaauggccccaaacugcugaaaaaugggugguaacuuuagcgauuucaaauagguguggcuucagucuuuucugcugugccagugcacagcuguucaaauugaaaucucuguuuccaugucccuaauaagauuucccuugagaaaacacuacugucucuaaaagcucaaaaacuucuguugugcccuagcgugguggcccacacccguaaucccaacaguuugguaggccaaggaggaggauugcuugagcccaggaguuugaggcuagccugggcaacguggagaaaccccgucuccacaaaaaacuagccaggcgugguggcacgugccugaaaucccagcuacuugggcaggugaggugggaagaucaccugagccugggaggucgaagcugcaagugagccaaaaucauggcacuguacaccagcacaaaaaacagagugagacccugucucaaaaacaaacaaaacaaaacaaaaaacagaaacaaacaaaacuucuguuuuaagagcguuucauuaggcagcagugaaugguugaaugaagagaaggaagguaggaggagcaggugagaagcuuuugugguagcguaguccuaacaaaauagagaguuugguuuuaaaaugacuaugcauuccagguauaccuacagaguccugauuucacacaguuuuuuucaauaaaugaaauuuaugacauagcuaaauaaaucugauauaauuaauaucuacuuauaacucuugaauaauaaauacacacauuaaagcaagaggaaggaaggaaggaagggagggaggaagggagggagggagggagggagggaggaggggaggggaggggaggggaggaagggaggaaagaaagaaagccugaagggauggaggguuuguagcaguggaaauuccucacgugcguaagacuaaagaaagaaaagagcaagccgcgugucugacuagauguggugauacaauuugacggaaaaaauucaagguaugauccaaauguuuaaaauuaacggauucaaaaauuugaaacaaagcaagaccucugaagagugggcuaaaucuagagaaaugauauuugguuuuagccauuagucuuuuuuucuuuucuuaacacuucucagacuuguugaaaaaucucugaacauugacccgcaguucuauuaaccuuuaaugucccuuacagaucgguuugggucucucucugucucuccacaccuccauuuuaaacagggcugacucuaagcaagauuguaaaugaagcacguggagcugggcucuugccugcuuuuccuuauuuccgucucacugcgcuucuuuaaguaccaagugcccaugaucugaacaccauucacucauuaccuguguuaguacaguaucuguacuugaggaugcugcguaagccucucuuccccagacuuuauggcaaucauauauucugaauuuuuuagaacauucugaaugucaacuaucucauguucauuuucuuuucucaguuugcuguggggaaaauugaucaccaagucccuccucugcccucacuuuugacucucaaauguaacuuaccuaaacuguuuguuaaagaaauuaaagauauuagcauuaaguuguagaucagucuaggaagagauaagcauagcuuccuuaggaggacauugcacuuugccauuuuaaaagaagaguuugucaacuacgagacauauguuugcaaugauuucauuucuuagcguuuuuauuucuuggguaccuucaggaaucuuuuaaaugucuccauuaacuaaccuauuuacaaauaaauccagacaugcuugucagaaucaacugggcauuaguauaacauuccuaauaaaauuaaguaccaaucauuguuuggcacugaaacaacuuagaauuugcauucuagucuaucauaauccguuuuuguuaucuuuuaauauggaaaaaaugaaucaaugacuuauuucaaugagaucaugacuuauacguauuaagauuuaauugaagagaauguggguccuagcgaaucucauucucuaaagaaaacuauuauucuagguuuagaaaugucauuuuggcaauucaugcauaagagagaaaucuccagaccucuucauuuucauaugcaauaaaauuguguuaaauucaagucacagagugaaguuacaguacagcuggaaaagaugcaauguuuucuuagagaaaacacuuggcaucuaggugaggggaauacauagaagaguaauacuuagggagccaagaacagaugugaaaaaaugagacaggaaccuuucgauucuuucaggcuugaggcaaaguaccaucugucaagcaccucucuuggcucucccaaaagaauaugccuccagcucuccagauuguccuggcaauuaaacuugcucccagaucugucacauuuaucaucguaaaguuccgaaaacagacuuccaugggcacucugauuuucuaugauaucuguuauuucaugacuggccaauagccugauggugacuuacccaauccacccagaguuucuccuaaugaaguuaaugcuguagcagccagaaccaaucccacccuaaucccuucuuccagacucuagaaccuauaagaagagauggaaggcaccugugucucagauaacuuuuuauuuuuuugcuuuaaaacaacccuagcaugauuaucucuacauuucuuagagcaaagcagauuuuuaucuuguuuaagacugcugugguggcugggcgcuguugcucacgccuguaaucccagcacuuugggaggccgaggcaggcggaucacgaggucaggagaucgagaccauccuggcuaacacggugaaaccccgucucuacuaaaaauacaaaaaauuagccgggcgcgguggcgggugccuguagucccagcuacucgggaggcugaggcaggagaauagagugaaccugggaggcggaguuugcagugagcugagaucgugccacugcacuccagccugggcgacacagcgaaacucugucucaaaaaaaaaaaaaaaaaaaaaaaaaaaaaaaaaaaagacugcuguggguuggguacauuuuugguuuccuuguaaugaauguacuacuaacugauacaaagaaaaacaugcaaucuuacauuugaaaggcauauuuuuaugaagauuaaaaucuauuuaacuuguauagacagauuaaauuguauagacagauucuauaucaauuuuuaauuuuuuaacuuuuauuuuaaguuugggguacgugugcagguuuguuaauagguaauuugugucauggguuuuuuuuguacagauuauuucaucacucuguuauuauuuaaggaagcuccauggcaggagggugagguaggaggaucaccugaaccugucgagguggaggcugcagugagccaagaucgcaccacugcacuccagcuuggauggcagagcgagacccugucucaaaauaaaagcuucaugggauuaucuuuucucuauauucugaaaaguuaucugggaauugcaucuuucaaaaaaguaagcauuccaucaugacaggaaauaugaaggaaagagcauguguucagaaaucagacccaucugggucaaauccaauucuaccacuuaccacugguagguguaucacauaagaaauuuugcuauaccucugagcugacuuuccucaucucucaauugguaucauuauucaaauuucuuagaauugcuguggacauucauugggauagaauaaguacacaggacauagcacaggugacuaaugcaucuuacauccucccucccagccugccugucugccguggcaucaccuuauaaauaagugguuaauaaaggcugcuugaugauggugauuuuuuuccacucucuguuuuauuuuuuuaaacauugucacaguguacuuuccaacauugcaaaaaaaaaauagcaauuagcaguuacuuucccauuuuugucauaucuuugcaagaucauaaaagccuaaaguuaagaaaagaggauaauuacuaccauuuguaagguaaccuggcaaaaucagaaagaacaaaaaaaccuagucuugcucuuuuucguacauaacacacauuauuauaaugcuauaauaaaagcuuuuuuaucuuuugccauuguauucuuaucagcacgaucaauuucuaaauuaugcuuuuugaaccaagaguaaagaaaacagaaaauaacuauauuuuaaaaacuauaccuuaaaaauaagaauauguaaggguuggaggaaagacguaaugcuccaacuugcagacugaagaaucuuuagcaaggggucaagaagaaauaugccacaauuaaucucuaaucaugggguguagcaauaagacaacucaguucuuaacaaagcuucuaccuuccaaaagucaaaacaagugugcuuucaaagcagacauguauuucuucuuuuucuuucuuucuuucuuuucuuucuuucugauacgguuucagagauuuuuguuuuaguauaaugucuuuuuugucuauuccuauuuucauccuuaugaaaaagauucaccaacucuuuugugaauauaaacgacucaggauaauugaguauuuauguuauccugcaaaucugaugaauauaaacaaaaaaguuuaaaacaaaaucucacaccuaaaggagguagauccugaaugcuauuuauuuuguaauucuuaguuuuagacagcauucagacuuuuccaauauaauauuuucuaacuggcaauaacaauuuuauguccugaauuuuggugggcaugacugcggucaugugucacuuaacagugggaaaauauucugagaaaugugguguuaggugaauuucauuaugugaacaucauauagcauacuuaaccaaaccuaaaugguacacaccacuacgcaccuagacuauaugguacagccuauugcucccagguaacaaacuuguacagcauguuacuauaguucauuguaacacaaugguauuuguguaucuaaagauauauaaacauaaaaauaguacaguaaaaauauggcauuaaagauuauaagaaaugguacacuuguauagugcacuuacuaugaacggagcuuacaugacuagaaguugcucugggugagucagugaguggguggugggugaaugugaaggcugaggacauuacccugcacuacuauagacuuuauaaacacuauacaauuagauuauacucguuguguagaaaacauuuuucuucaauauccaacuaaccuuagcuuacgguaacuuuaugaacuuuuaaauucuuuaacuuucagacucucuuguaauaaaucuaacucaaaacacaaacacguuguacagcuguacaaaaauauuuucuuuauaucccuauuuuauaauuuuuuucuauuuuucuuuuuuaacuuuuaacuguuuuuguaaaaaauaagacauacauuuaccugguuaagauuccuuauuauauuuaaaaacuuuuuuuauucuuggaauuaucuauaaacuauuuuuaagaacauacugagaucauaauuuuccaaaacucccgauuacuaggaaaccaaaaaaauuacacacacacacacgcacacacacacacaaacaagcuuuaaaaauaagaccuguguuagaaaccagcucuugaacucuuccuuuggcaauaucugacccucacuuauuuaacuguaaaauuauguaacaaugaauguguaucaauaugcaauaaugcaugcuauucacaacucugugcuuaaauauauauauauguauauauauauauauauauauauauauauauauauauauauauauauuuuuuuuuagacggagucuugcucuguugcccaggcuggagugcaguggcgcgaucuuggcucacugcaaguuccgccucccagguucaugccauucuccugccucagccccccgaguagcugagacuacaggcgcccgccaccaugcccggcuaauuuuuuguauuuuuaguagagacgggguuucaccguguuagccaggauggucuccaucuccugaccucaugauccgccugccucggccucccaaagugcugggauuacaggcgugagccaccgcacccggccuuaaaaauauuuuuuuaaaauuuccagugcaaauaaaauauauuguauugaagagauaguaaaugagaaacacuuuuaauaauuuaaauguuuauggacauuaaguaaugucacuguuggaagguuuuuuauuucucgaccaugaguauguauaauauuccaugauaucuauuuauucaaucaaggucuauuauucuccuguaucugcuguugagaaaauauuucauguuuaaauuaugacaauuuuuuuuuuuugagacagucuugcucugucaccgggcuggagugcaguggcgugaucucagcucacugcaacuucugccucccagguucaagcgauucuccugccucaaccucccgaguagcugggauuacaggugugugccaccacgcccagcuaauuucuguauuuuuaguagagaugggguuucaccauguuggccaggauggucucaaucucuuaaccuuaugauccgccagccucggccucccaaagugcugggauuacaggcaugagccacugugaccaaccuaaugugaguaugaguguauguuuguguauacacaugcacagauauauauauauauauauauaauacacacacacacauacauauauaucccucuauaugcauucacauacaaaacauaaaaucaucuauauccaaaaugaauacaugcccuuaauuuaccuuuucuucacaaacacuuuacuauccagaaaacucuccuucuuuuucuacuuuuuaaauuuuuguuucacuggaguuuuuuuuuuuuuuuuuuuucuaauucuuagccucuggcucuuccauuuaggucuuagauucagcuugucaauuuuuaugaagcacccacuaggaaucuugguuggagucuugugacuguugcuuugacuaacucaauuuuuugcuuuucuuuauguuuuuaaguuaucauuauuuuuuauuauugauuguuuuacuccuaguaaguugagcuuuauauauaggcaugcuuugaaguuuagauugaaggugcuuuccuccagagaagauuuguguuugcuuuagacaggcuucugagggcacuauuaaacugggacacuuacaauaaauucuuggugaaguuuucaccucuauucaaagucaaauucaaguaaauuagcuuacuuguucuugucuacaggagacgccccucaacaccacuucuacuuuuuccuuaugauguagcccacuggaucuugguuauauuuaagaguguaauuccaggcuaaaaugacuaaagggauaauacaguauuagcacaaggagcuaaggauaauuaauuucauaaaucugcuacuccgagcgacagugaaaaucauuccguauauauuucuacaagccuucaaccuuucaauaggaucugaauaaugguugaaaauaacugcaauaauuccaaugaugaugaugaggagguggaauacauuuacugaacaauuauuauguccuaaaaauuguucuaagugcuuuacaguauuauugaguucaauugucacaaaaacacugcgcaguagaugguuucauuguauucaggaaacugaagauaaaagacagugaguaacuugcaaaaggucacauagugauugacauggcauuaaacuccagaucuguuucuagagccaguaugcuacauugccuuggaaaauauauccuguaugcacagauauuacccaaacauuucuucuaauguuacgaauaaguaaaauguaaauaaaauguugauuaggacuggugaggacugauuaacaagaacuaaaaaaugaaaauuaggaauauugggagauauaccaaaugagcuacaauauaccaauuuacguugcaagaguauuaacugauguauuuuacuugcuggaaugaguugauaaaccauuuacuacuggcuggcaguuucagguuaggagaaguauaugauuuuggucacucaauuucuuaucuagucuuuaccucugagauuugaaaaaaaaaauuuucauuaauauaccagguucugggggccgggcgcgguggcucaugccugugguaccagcacuuugggaggccgaggcgggcggaucacgaggucaggaucgagaccauucuggcuaacacagugaaacccugucucuacugaaaauacaaaaaauuagccgggcgcggugaugggcgccuguagucccagcuacucgggaggcugaggcaggagaauggcgugaacccgggaggcggaggugagccgagaucgcaccacugcacuccagccugggugacagagcaagacucugucuaaaaaaaaaaaaaaaaaaaaggaaaaaaaaaaauauauauauauuuuauagguucuaagaaauugcuuaaaaauuacacacacucacaaacugugaaaccaauaguauuuguguaauugacagugggagcuugcauucugcaaccugggacgaagaauaacuacaaaggugcaucaacuucuuuaugaauagaucaccauaaaauauuaauauuauguucuucaaggguccagaauagaagcugaacguuuuuuguauaauuacauaaaauuacauauuauuuuaagauauauaaucauauacauuguaauuuuugcgaccuauugaaaucauaaccaucuuuauaaagccaugacacugguaccuauaaucaaaucauucuccuugcugacaaauuauucucauugccuuucuucuggcauccaaucauuuccauucuuuuauuuacaauuucguuuuagaaauuuacccuuuuggacuuuauauuuuccucuuagguuuaucuauuauguaaaguauuuuuguagauugcaguuuagacaggaggagaugauucuacgaaauaauuugcugucgguguguuaucauuaccucauucccagagggugcuacuuugguggaaaaaccaggcucaguggcucacgccuguaaucccagcauuuugggaggucgaugugggugaaucacccaaggucaggaguuugagacuagucuggccaaccuggugaaaccccguaucuacuaaaaauacgaaaauuagccgggcguguuggcgggcgccuguaaucccagcuacucuggaggaugaggcagaagaaucguuugaacacgggaggcagagguugcagugagcugagaucgcaccacugcacuccagcccgggggacagagcaagacucugucucaaaaaaauaaaaaauaaaauaaauaaaauauauggagcuauaauuucuacccacuuaauugcauuccucuaaaagucauuaacuugaaacaaguuuuuuggguuuuuuuugguccauuaagcuaauucuugacucuauacuuauaaaguuuauaaaauuauuuguuuauaaaguugauaaacuuaauuuuuuauaaauuaauuguucacuguauguuuagacacugagaauagaguucuuuuuucuuuuuaugcuuuuuagcauaagaauaaucucauuuauuauguaaauacaucauuuuuauaauaaagcaacuguuuuaaauucauaaaacuguuauaaauuuaugugauauagcuaauaugaaagacaccugaauuaaacacuuuaaugaaaugaauauuuauuaucagacagagguuuagaauaagaaaugucaauauauagaacugccuccacuaaaccuuuuuccugaugaauuuaagagauguguuuauugaacagaagcacaauucauagauaacucaucuuuauagggcgucuguugccaugguaauagugaugugacaucguucaaagggaaguguuuguucuaaaagcaaugaugaguaacauccugcagccuccauucaaaacuaaagguagguagguugggcuguuuuccuaggcacagacaaggguguagaauccugacaaucucucugaaguacacccccuugucagauccuaucaucaccuaccagucagaaauaaguucuuuuauuguaucaacguuauuuuuuuccuacuucaauacuaaauaagcaauuuuaaaaguauuguuuugaguagagaacagaaaaggaaggaguucaccuucaauaaucgguccuauuuguuguaauaauuacuuaggcaguagacaccaucuuuaauuuacauauuauauaacuacauuaacuggaaagacaacauuaaacuacauguuaauagaaaacucuccuaaauuacuugagcccccaaaacuuucacuuuucacaugucucuaaaucauccacggacucuacuauuuauucauuuguguguuuaauaugugcugugcaugcaugccuuccugugugugugcauguguguguacauguguguagaggggaagaggggagggguugguuaucuggauuucucuacuugaaggaggagaagcuaagcauaacauuagguggcagauacuagaugugacacuuagaugacucaauggugcggagaauuuaaaaaauauauuuagucaaauuaaccuaucuuuccacaugugggguuaauaccuagaucucauaacaaagcccgcuacugaugugagaccaaaucaaagaggccccgcuuggaggguguugguguccaggaggcaaaaaugucaaaccagcuuagaacuuaauuagcacugugagguauggaucacccucucuuggugguuuuuuguuugugugcauguuuguuuguuuucuuuuucucguuuucuuuauucucacuauucccuucuacuugcuggguuuuuguuuccugcaucccucuuucugcauucauuuuugucucuccacucuuucuuuugauuuauucuguacucuucucucaggcuugaaaggguccuuaaaggggaaaauuaauugacgagauaugaaugaggaaagaaaagccgcaaacucagacuaaaccuccacacucugccauaaaacugccucaaacuuguguuucucaccugugaugcuuuccuaacuaaaccccaaaccaacucucugucugggguuaccaaagaguaaaaguaacuuuuccuaccacuuaaucuuucugaggcuuuuauauucagugcuuauuuuguguuaugaggggccgugugugcuuguggaggacgguagaaugcauacaauaauuuaacaccugcuauaaguugggcauuauauuacucacuuucugacccuuaucucauuuaauccuaacacugaccaucuaauuuagguauuauugucuuccuuuuaaacauaacgccacaaaucuuaaucugggcagaaucacagucucuaaauaauaaacuuuguugguuacaaauuaauuucaauccaaaauauauaaauuuuuaguauacaauccagaagauguguguguguguguguguguguguguguguguguguguguguguguguguuugcugaagaagaaugauuacuggaaucuuugaauagaggaagcucaaguucaacuacaaaguaauaguuaaauuaaaaaugguugagauuaauccaguacaacuccauguauuauguaaaaugauuacauagauaauauggcaucccuuuuuguaacaaaucucuaugcuagagaccacagaaaucauuaggaagcuuaacauuuuaucacucacuuaaaaguaaaauauguauaauggaauccuccaugagacaaauaauaaaacuagaaugaucuuagcaacacauucacaaagcaguuagagucuucacagucauuuuauauguaugaccugauuuuguuuuuaaaauaaucuaucugaaugaauauuacagugccaacugagguccuuagugauaaauucguuuccucaauuucaugacuagguagugguucaguugaaacuaaaacauggauuuucaaauacugaguuguugcugauugacuuguaacaaauauaauuauauuaacuaauugaaaacuuucucuuucucuaggaucauaguuaauggauucuauuauuccaugaaauaaaauucuuugcaacucaaguguuuggggaaaacaaauaguucaugcagcacuagcaaucuuacuuuaaaaaaaauaagaaaacuugcuaagauaguauccauaauuuuauucucuaccuuuguuuaaaauugauagaaaauuuugggaagcggcaguguaugcguagccauaguugcuagagcaugugcgccuaugauuucccuauuuuuuguagcccuacucgccaaguaauuucauucaugagauuuuaucuaagguuguacugaauaggauguauucaguuuuucuucuuuaaacuauuguuguaucuacuugucucaauguuuauuagauucuccauauauagucuuauuuaaaccaaaucaauuuaaucuuaaccaauuguuucaaaaaagauuaucuucauucuagguagaaucuucaucuguacucuagcagacauuuuagggaaaggaaacaugaaaacaaauauuuuucuguguacaacucuacguucaauucauagcacaaaaugcuugccucuccaaaaguaaaaaauaaugauaauaauuacagucacacaaaaaagaaauaaaaaaaaucaaaucucuuuuuugagaaaauaaauaccaggaguuaguuaugcugcuuuauuuuccauagcagcuaugaauucugcaguaucuucaaaagccuucagcuuggauaaacaaguguauaauuuuccuuuuguugaaauuuuggauaucaaauggaauugcuaaugagcauaaaauauuacaagauucuuugggugaauauugcaauuacuuggcaauagacauugacaaccuacucuaaauuuguucuuguaacuaaagaagaaaaaauuuacauuuguacuuaaaggcaaaagagagaaaaauaaaggugaaguugauauuuuacuguaucugaaaccaguacaaaugacuagguuuauccugaggaguagauagccuaaugggaaacacauuucagugagagcugauuccguuuucgguuucaacaaccaccuguguagagacagcuuccuaaucaauaucaacucaccugauauuucacgugggucaccuuucaauuuagagugccuuuaggauauuuuuaauuucccaacauaaaaaaucauaaauuuaguugaaaacuaaauucuucagcuucucugugacuucuacuuuucaugucugcugucaaacugugacaacaucauuagcuccaacucccuggccaaaaauauaugugauauuuugggguauugggaggacuggaaguaugaucaaauacugucaguuacucauuugccaucuaucucagauauacucauucuuuuucauuuuucuugucacuauugugauauaggcucuugucacuuccuauuuagaucacuacaacuguuucccacugauuuucagucugucaaucuuggucucccagaucuugacuguauaccauucacugccagaauaaucauucccaaacuucaauuucaucauuauaccauccuguccaaaccacucaauggcuggcucugccucccgaaaacuaauaguuaacacagacugauccuaaaggccucugcacucuauauuuuuuucugccuauuuccaaaugaaaaccacuucauucauugaaauaggucucuucucauccucaagauguacuguaacaaauuuuaaugcagggcuuccuuuuucuauguuugaacugaauuuccucuguucuaccaauucauaucuucucccuuuaagacacuagccccaucucuuccaugaaguuucuucuaaucacugcauugccaggugaccuguuagaaaccugaacccagcaagcuaagaacagcuagaaaacauacccaauauauuagaaucacaucaucauguaaauuuguuauccaaaaguucaaaauauuucaaauaugugcuuuuuuugacauccagucugcagaaaaauaaauuauauauguaucuucacacaaauauauagcauauacauauuuguuuauauguaaguacgugugugugugugugugugugugugugcgcgcgcgcgcgcgugcgcgcucgugcucaggcauauguuucaagccaaauuuacagguuagggaucuaagcuccagagaacacaagugaguuacccacaccuaagcugguggcaguuaagucuuaaaccuggcccucugguuacagugauaaguagagaugagaagcagcaucagauugagcaauacacuucuaccuggauauaaaugccaacaucuuucuucaaaaucuagauacagucaggucuacuuuuauuuuuccuuugcuuauuuaauaauacacuauaauucuuaaauaaaauacaauuaacauaaaacugaucuuaguuuuuuuuaaagauguguuauuuucaugauuguaacuaagucugugcuauuuucagaucgauugaugauuuacaguucauuuaaaaucaauaaugauucuuugggcaauaacagaguauuguauauaacacaggaaauauaacagcauagaaugccaacucccuccaaugcuaaagcucaaaucaugugaagaacaacagcauucuccuucccuguuuggcaagacacauaaaggaauauauggagggagguagaccaugguaaaaaaaaaaaauacaaauaaauaaauaaaauaagaagggauucuggaaaauucuggcaaauguucucaaaauuguuccaagaugagugguaaguauauguuuuggggaaaaugaaauauauauuuauauuuauauuauauaaaugaaauauauauauaaauauucagaaacaaauaguuuauuuggaaaaguagguuaauaaaauaaaaaaaaauaaaugcacuuugaaacugaaauaauaucuacacagaaguccugaaauauauugaaauacauugugcagaaauauugauuuagcacucagaaucuccaaacacuccauuuuaaucuuuaucccaaucauggagaguccauuccaaccuaggccucuuuagagaguagagaggguuuuacuagccaacuacauuaaaaugaccucggccauccacccaguuagcuaggucagauucugacugacagauggcucuuacuaaaaauaaauuucugauuuuuguacgguggacacaauccugaaaucuuuuauucuacaagacagaaguaaucaaaauguaaauaugauuuuuaaagauguuauuuuuggaagaacaaaacaauacuugagacaaaccugugggacccaggagacuguaucccauuguggauuacugaauugaauagaaaaauggggggaaaaacauacaaaauagguauucggagauaaauuguaucacaaaaacaaaugccuaagguuugcauaauuuuaguugcagguggaaagaacauaaacugaauagaaguagacugugauaaaaauaguuuaaauccaggggcguuuauugagauuaauuuucuucaguaaaccacaauauccaagaaagaaagaagaauauugucacccuggaaaucaagagaugguuuagaucaaauucaacucaaacauccaaugaguuauuugguuuccugagggacaggaaagauagaagugggcuguuuugaaguuuuuauaguagaaaggaaaaaauaggaaaagaagaaaggaaaagaagaagggaaaagaggcaagaaaaaagccagaaaagcaugagauaauucaaggacuuuuuaucuuuuuauacauucugccuagacaucaccuaaugagacaugccccuuagaacaguuuuacucauuacccagugaccucuuuccacucuugugcuucuagaauugucuaugggcaccuugggcauuaacugaaaggaguugaagccuuuucuuucccugacccugccagagaaauuuuuccccacagagccuguagacguuccuucagagaugcuagaucacggacaacucucaugauuaagguguaggcucaacauuucuuuaaaucucaaauguugaaaauucaggccaaauauagaucuacuucucugaauauaaauauaauucuucccuagccucucuaaacaucuacaaauucugcaaaugauguuaagcacacuuaucauuuggcuucacguaucuaguaucccacugcuaaugccauuacauuuaaaaugaaaagauguacaauuauaauauauaaaaaugauaauauuaaaagaggcucuaagcucaaggagcagaauuacaagugcauuggaucguccaaguaugaucugcucaaacuaauucgacucucagcuaggcugacugaccuugcaaaauaccaacuacguggcuaagaaaggaaaauauauucaaaucuuguguaaaacguauuuuaauacuagaaagaugcaaaagaaaauauuugaauuugcuuguagagaaucuauauugauuuaaagcuuggauacacauauauauuuccaucaauuguuagauguagugauuuuacuuuuucauauuuaugguaugguuauguaaguguuggguaguaauacauuuuuagauuaaugaugaacaaaucauaugaaacaaaauugauuagaacucucaugcucugagguccuagugguuauccgagugcaaugcaagcguauugcuuuaacuuugaggcuacauauuauguuuaguucagaaauccguuaucuacuuagccauuuucuacagcagaaaagaugugauuuuucuuuaaaauauggaacauaauaagugcaauuauuuggaugcagaauauacaaaacuucacuguaaauagugcauaaauguggacucauuuguuauugauuuacgagccauauauagcgcagaccuccauauucccuacauuaggucuaaauauauuaauguggaacuguguagucauauccacccacugugaaacagaacuaccugaaacaccauacagaacaguggccuauguaacggugcauuugcagaaugacgauaauguaggaaaguuaaauugagcuacauaaaauguuuauaauauuuuuccaaaccaggaugcccaugagagcuuuuauuuucacuacuuuggggacauuuucauucaaacuugcaaguucauuucagauucuuaagaaaucugggaaacugacagaaucuguuggaauuuucuuuauucagcuaccagaacugguccccauuucccacaaaaaaagugauuuauggaucuuaauuucuaaucauuugcuauccacagaauuccugaaauucucaaauuuaggcaauagccaacacucacuuauaggaauuaaaaagucaauuuucuggauaauucaaaaugugccuacacuaucugaauaguuaucauuaaaauaauuuuguguuaacuauauauguguuacaugagaaguucaaacacgccauuuaucuuauugagauuucauuugagcauucauuuguuauugaaucugcacacacaaauugagaaacuacuaugugugaggcauucauuaugcuggcacaaggccacauggaaauggaacagaaaggagugcucuaucacagcaaacaucauggaacucauuacauuuuugccaucagaaaagacuauuggguccaauuaaacccagcagcuauuucuccauuguugauucacagcugagaugccuuauagcauaaaagcagagaaccaagaauauuuuaagacuuaaaaauguauacagcucauacaagcuaauaaggagaacuugaagcuaucaaagguucgacuuaagacuugucugaaacucugauucaaggaagugacuucuauguugcaggauguggccagacagaggaaggccaguaaacaauggagaacaagagcaaguucucacccagaucauguuuucaucaaauuuucuagugaaccuggauuaagauuuuuaucagauccaccuguauuguuuauugcuuguuuucaauauaacuuaaauuugucuaacucuuuuuggggaauaauaugugauucuuauuccacucccaaucauucugugaauauuguauuuuuuauuaacccauguaaguaucguuacaaacagaaaauugguaauuggguccaugguucugaaagcaaagguaggaagacuuuuuacagaauucuuguuaguaaggcuuacucuuaucuggcugggcuacuuaguaaaauagauacaugggauucagauaaaaaaaaauaaaauaugggcuuggcacggugguucaugccuguaaucucagcacuuugggaggcccaggcaggcggaucaugaagucaggagcucaagaccauccuggccgacauggugaaacccuguaucuacuaaaaauacaaauauuagcuggaugugguggugcguaccuguaaucccagcuacucgggaggcugaggcaggagcauugcuugaucccaggaggcggagguugcagugagccgagacugugccacuguacuccagccuggugacagagcgagauuccgucucaacaaaugaaacaaaauaaaauaaaauaaaauauggcaguuagggauagcaagaaacacaaccaagaaaaauuagaaagauucauucaggaaagaagaggcaauaucugggcaagucuccaccaggcagagaaaggagaaagggacguaucagguagugggagucauaugugcuaggcauuuugcaaguaagaguuguuucucuauaugcccuucauuaaugauguuuauuuauuaucucuuuauuuuuucuuugugaacucaucuucuauucccuugcaucuucagcugccuugguaaagaaaacaaaauaaagaauacuaucaacagacucauuccauguauauaaauuucaaaaauaugcaaaauaaaacaugauguuuacaaauacaaaugugugauuaaauuuauaaagaaaaacagaggagugauuaguuuaaaagucaauuaaggccgcgcgcaguggcucacgccuguaaucccagcacuuugggaggccgagacgggcagaucacgaggucaggagaucgagaccauccuggcuaacacggugaaacccugucucuacuaaaaauacaaaaaauuagccgggcgugguggugggcaccuguagucccagcuacucgggaggcugaggcaggagaaccgcgugaacccgugaggcggaguuugcagugagccgagauugcuccacugcacuccagccugggugacagaguaagacugugucucaaaaaaaaaaaaaaaaaaugucaauuaaggcugggguugguggcucacgccuguaaucccagcacacuuugggaggccuaggcguguggaucucuugcgaucaggaguucaagaccagccuagccaacauggagaaaaccugucuccacuaaaaauaaaaauaaaugauuagccaagccugguagcaggugccuguaauuccagcuacuagggaggcuaagacaugauaaucauuugaaccaaaaaagcagagguugcagugagccaagauugcgucacugcacucuagccugggugacagagcaagauuccaucuuaaaaaaaaaaaaaaaaaaaaaagucaauuauuaagacagugguuaccucugaaguuuguggaaacaauuugagaagagaaagagcauguaugagcuucaaaagaaaugguuauacauauucuguuucuuuaacugggcaguggcacuauuuuuuuuuuuuaaugcuuccaacauuuucucaggguaucuucuuuggggagcagucucugggaccgagaugaugugcaggauggcuacuggaguuugcuuuggggcaaacacuggugaaagggaggggaaggcagcuggauuggucagaaggagaaggguugcugugaugugggcuugacccucagccagacucucagggaaccccaaagggggcgacagguaaaggcagcucaccuccagcacuuccugcaacugggacagcagaucuuccuggaaggaggagcuggaugcugcauauuacuuugcaacaacacaguauuucaggaaauguuuuaaaaauuguccuaacuuaucaauuuauugccuuuagaaucugaucauuucuuuuacuugacaucagagaaaacaaguguucuauacaguauccugugccucuuuuucuuccacaguuuuuuuuaaacacuuuucuaauucuucaguauuuagacauauuaucagguucuagagacuaacauuuaauuugguugugcauucucuuauuuuugcuucaccuaucucagucuauaauuuucauuuugcagaguuuuuuaaacuccuuccagauucccaacuauuuauucuuacugaggaagguagaagcaacaggugaaucagcuuugccaucuuuuuuuaaguugcaacuuagacuuuuaccgaccuuccaaagcagagagcuuauuucuuugucgaaauucuuuaaaaacaaacaaacaaacaaaaaaaacuauguguugagcauuuuugcaugaacuucagcacaacagcaagacaaauuccuacugauaauuaucagagucaguucaaucucacagucuuuugacauuuccuugaaacucauuagacuggguuguacacucuccuugcacuuccuguguuacccagaucauugucuucuuuuuuuuuuuuucuuccugacuuugauuuuagauucagguggcacaugugcagauuuguuaccuggguguauugcaugauucugagguuugggguaugaauuauccagucacccagguacuaagcauaguacuuaacagguuuucaaaucuugccccucuacuccucccugcucuaguagucgucacuuuauugucuccaucuuuauguccaugaugcauguucuuaccuacaagugggggaucacggucuuuaucauacuguguuauuauucuuaguuuucuucguugacuuucuccagauugagauaauuuugauguacuuuuuaaaaaauuuuagaugucuaauauuaugcuuucuuuugcacccaaaaucuuucuauacugucuaucaagauuucuguuuuaucucuaguuaccuuuuuucuuuuaccugauuguauuagagaacacaaaugcaccuucuuuaugaaacuguuuaacucuugaacaaguuuuucccaaaauaaauaagaugcuugucaagucugccauguaugcauguauuuuuaaucaacuacuauuacauugaacaauauugcucucacacuauuccaagguauuauucaauauuucaauaacaggaagacauuauaacuuugugcuaaguaaucaauaauuuuaucuagcauauguaaauauaguuaugugaguacuagaucaacuuuaccugaauucauuguuuuccuugagaugcacagaauuuguauuucauuugggauuuauucaaauaguuauuuuucaaggaaauucaauaauuauaaaucaggaaacuaacacucugaaauauauucuuauccaucauagaaauaaauaaaaguacccaaaagcauuuaaucuaaggaugcacuuucucuaaaaucacccaaauuauuuccuguagaauuuauugaacaggcuguuccaagagauggauggacagucuggaaaagaugcagaaugaucaauugaaaugacaaccacauuuaacuuuaucagaaaugaccugaaaaccuauuuacuaccaucaucuuuugcauuagucuguguaaaauugcuuuuaaugaaagcaacaagcauauuuuaacuaauuacuuagagauacugaaaucagucaugucaacgacuccaucacaaauacuugguuuuuguauuaguuuuucuuaaaggcaaaauaauuaccagaacauucuacauuuuaaggaauagaagaccagaugguaguaauauaguuaagaagugguaauauacuugaaaacugauuaaaauuaacacgcuaauuuucaaauaugauagaguucauaaauucuuugcaaauaguuuaggcuacuugaaugauggaagucuuucauauauugucauuuguuaacauuaaauuauuaaauagccauuaaucccccaaugauaccacuuuguacuuagaagaguuuaaagagggacaagauaaaaguacauugaaauaaauuugaauguauaaaaaauauauuacugaagagguauguguaaaccauauuaauuuuuacagcuaugcacauaaucaucaaaacacuauagcugucuucacaggaacagcaguaugccaagcacaauaaaguauuaaguagggauauuuuagaucagacuguuucauuuuaggauuaauuaguugcuugucaauuauucaacaauuggucugaucagaagaugaagccuaaucaggcuuuucaaugacuaaaaucaucaaacaauuaugagcaauuucagucauuuauuacgcuuaaaacuauuauucuuuuauuaugcuauaaauuccugauuacuucaaaaucagcauuuucuacuggaaucuagaauaaauauuguuggggaaagcuguccaaaugaauaaaggaaagggaauuugggaaaagggugaaaagauagauuaaauguacucacuaaucuguaguaaugauccuuucuaucaguuuguauuagguaaaauuuaacaguuaaccaguguugaaaacaacagccuguugaaacacauuugguaagcauuguuguaguucaaaugcagcccugcuguaacgaaauuguguauaggaaagaugaaguucuacgaaacagcacagaauuccuaauagcgaugcugcaaaaacuuauuugaaagcugaugugaucccacucccagccacucacaugaaagucagaauucucaccucucagauccucugacccggugcauccuucacuuuguaucagcuuuuaccaaaaagaaagggaagugaagggaaccuaauccccucacuugguauucaagaaucgcuucuuugcugguuaguuggaaguaaaaacaacuuuuugauucuaguuuacaucaucauuucccucagucuuuagaacccaacgagcuuuuaugguguagcccagcguaaacagucaaaaccagaccagagguccaaucaaaguccuggaauucaaaugcccacuacucagguaaguagcaaacaccacuuaagucaauaagcgacucaacaaaagagcaaagaaaauaauuuccaacuuccagauaauaauuuucauacaccguauaugugauaauuccugauaaaauugauuucaauaacuagauuucauucuuagugucuuagccaaagaaucauauaaaaaaacaacaacauaaaccaaauaaauucucauuuucuggacuacgaaaauauguuuccuauaauaaccuauccugccguaucaaucucuaguacucugaaacaagauaggucugaagacagcaugcaaagucucagaagaucccauuuuuaaaugccucuccagaagcugguuaaacauuuagccaucuuguguaaagggaagugauucugccacacauacauggaaugcacagaaauucuaugauuugaugauucaaacagacuagggaacagcccaccuaauacuuuucuacaaaugagaccuaggacuucaauuuacccuacacaccucacuaaaagucacauugaagaguuagagcuggaacugcuaauagcucuggaacuuagauggaggaagaacaagacccacagcuggguagguuucugacuguucugugcugcagacuugcaccuuaaugcuuugcucaaggccauuccacaaucugaguccuuuuugcuacccugccacauuuuaaucccuuuaaaaaaacaaacuucauaaucuuugcuuuuuaguggggaaaaauuuagcuagcuacuguugccuuuauagccucugaguauuuggacucaagacugcaacaucuugcacuagaaaacacaaacacaaauaaagggcugugugugugugugugugguguguguguguauguuuagacuagucaaagaggcuucagcuggggauacggugaugggcagggcuucugacuaucuuucugaaaagcuccaaucuaacugaacaaaucacaaaagcaggccaauuaaagcagacaccagacuagguucagaaauggaaugaucauagacugcagaaaaggcagcuagaaaauggaaguaaaguugaugggguccaagcacugaggcaggcuacaauaucauuaaaauucaagagaguauuugcaaccagaaugaugcagugaaacaacucucaaauucauucccgcuugcccagccaaucuggaaacaacuuuuucuuaacauuuugugaucaaagucauuuauaagacuuuccaacauagugugcuaagcguggugcuaggcugcucauuuaugaagcacucgauauuagaaugcaagauggaucacuucagaauaacguguucaguauuaaaaaugaugauaaguucgcaaauagugaaaauauuagcuguggaauuggaggaggagaaggaggaggaagagaaaaagagggaagaaggugcaacuauguauuuacagacuuacuacuucaaaaaguaucuuucccaucuacaccucuaauggguuuuauggauuacuguuaauuagcuuauguuuccaauuuccacaaggcagaugaguuaacaaauaagagguuuucuucuauucucugaaauaauucauuuuaggacaauauauucaauaugaucuguuacguagauuucuucugccaucacugagacaauuuccuuccaaagccacacccuuauuaaauauucugauagggaggaggaaagacaauaaaucugccuuaaaaacuuuacuucuauugacaggguuuuugcgguuucauuuguuuguuguuuggagagaaaagaaagagagccaaaaaaaaaaaaaaaaaaacaguuucaaaggaaagacauugagcaaaauaaaaguauucuguugagaugguucauuaacgaacuguuuuuuguggucaaaaaaugaacgcuuuguuuugaaaaugcauugugaccaaauugaauauaagaaaauaaguaggagaaaauuuaaaauaauagcaggaucaaacacauuguauauccauguuuccugaucuggucucaaauucagauauucuaaagcacugcuucucaaaucauuccucccaggcucaccuaaaauagugauccacaccaaacaaaggaugucaaccuuucucuguuuuuaugggaaacagauaagugaauagauuguauuuuauuguuuuuuacaaaccugccaucauuuuuuuaaauuuuagcacuuguuaacacuauauuagaaucuaguauugaugaaaacuuauuuuugucaaaauauuuuaaguuacucuauauauauacacacauauacacauauguauauaucuguauacauguauauaauauacaugcauacaugcacauauguauguguauauauuacucguauucauacaugugcauauauguauauacauguguauauaugcaugugcacguauguauauauguacguauauguguguguguaucauauauauuacuuguauacugugauaucuaguugcuuugucacaaucacauuuaagaacaauguuccugacacgugguuaacagguuggcaagauaauuuaacauauugauuccacuggacagaaacauucauuuauacugaagaguagauuaccuuugcuuagaauuuggaacuaauggggguagcaggagacaaaaagaagggaaggaggaagagacagaagaauucaaaaagaaaggugaauacauggaaaucauggcaacaguacacauaauucuggcaaaacucauuuaauauaacaaagcccuugaggaaacauagaauagauuaucagagacaggaagaauugagcaagauaacaguucucuucuuguauucaucacucuccuuuuuguuuuuauuucugucuuaaguuuuuauuuccaguuuuauuuuccucccucuauuucuucccauuuauccucuaauacuuucuagucuauucaacuuccucuuucugcccuucccuugcucccaugacgaacuggaguguaggccuaccucaccugcaagggggaagguuaaugucugaugcauuguuuccuccuccaucaaucugguuauuucccucuaaagaagacuugaggaaauagccugauguuggguaauuuaaguaauuuuuagaacuacuacuaauuucuggacuauucagaaagagaugaugagagagacgcccaaacuguugcaagggaucaaucaugugauccacaaugcuacuaagucaacauacuauuccccgcuacaaggaguaaauaaguuuuuccaaugucaagaacucugcgugggccucauguguauuuauccaguaauaaugauauauuuugacuaaaaaaucuccuuucuugauauugcagaacacauacuauuuugugugcuauauuauaucuggcuuugauaagagauauucugaaaacaaaacguacuaauggagugcaucucacaccaauaucaagagcaguguuacuuuaauaaagagaucaacuagugauuaguauccugagaugcucggaaaggaaaacaccaaggucagaagggaagacagugucuggauaauaaucaacuucccuuuaugugugaaguuagaagggggagaauguggcuguguagggaaauagaggaucaucuguuuucuuuaucaggguucugcauaugagucagagcuaguaaacauacuaauucucauucagaucucuucuugaagaaagagaagaaaaauuguaaaggagaaacaaagaagaaaagagaacugauaaauuauacaacaaaacaaggcuaugcuuugguuuaaguagagauaaaacagugugcuacacaccaagaaguauuaauuacuccagguagugacaugugguauuauucuuuuuggcuccaaacuauucucuggaucauaucaccuauuuuucggaggucuucuaacucauucaagccucagagaauaugucuuuucacuacgccaaauagaaguuucuucaaugaaaaacucuaagaaaaaauuuagaauauuuaaaguaauauuugcacuguauucaaaaaauaaaaauaaccauggagcaugagagaagcuuauuaggaaacaagaaaauauuuuaucuuucacauuucugguucauuuuuagcagugacaguuuacauugacauaaaaauagccuagucuacguugauuuuccuuuuuuccagaacacugaccuacaaaugauuaugugaaagcauuaugugacuuuuaaugcugucuaguguggguauuuaaguugucuaucccaaauacacuuaaauuuagacagguacugaauccuauuuuucacauauucuuuaccacauacaguguacggagucaaaagguaagggaccaacgucugauucuacuccucacuagauuugaauucagacaauucaccuauucuugucuagacacguuccacuacaguuuucuaacucccuuagauaauuuuucugugagaaucacauuuauuuuaaaaauuuaaagauuuuugcaaagcaauaaacaaaugcuacuaaaaguuauuacuguaucuucuuacuaaauuucuuuuucuguuuuccagcuuuauuaagguauuauuauuauuauuauuauauuuuuuuuuuuugagacggagucuugcucuuuugcccaggccagacugcaguggugcucucuuggcucacugcaagcuccaccucccggguucacgccauuguccugccucagccuccugaguaacugggacuacaggugccugccaccacgcccagcuaauuuuuuuuuguauuuuuaguagagacgggguuucaccguguuaccaggaugguuuccaucuccugaccucaugauccacccaccucggccucccauaaugcugggauuacaggugugagccaccgcgcccagccuuauuaagguauuauuaacaaauaaauauuacauauuuuuaugguguacaguggugauguuuugaucuauguguacauugugaaaugauuaaguccacccaaguaacauauccaucaccucccauacuuguuuuugugcugagaacauuugggaucuaugcgauuuucaaaagcauaauacaugauuacauauuauuuuaaaguauaguuaccaugcaguacaauagaucuguagaacugacuuaucuuauguaacugaaauuuuguacccuuuaaccaguaucuccccauucccugcccuauaccccagacacugacauccacaauucuacauuuuacuucuguaaguucacuuuuuaagauucugcauguaagugagaugcaguguuugucuuucugugccuggcuuauuucacuuagcauaauauccucccaguucauucauguugucacaaaggacaggauuuccuucuuuuuaaagguugcauaguauuucauugcauauuguaguauauucauuauauauguguauguuguaguauauauacauauauaucauacaauuuauuuauccauuuaucagucaauagacauuuggguugauuccauaucuuggcuauugcgaacagugcuucaauaaacauggaguacagauaucuccuugacauacuaauuucauuuccuuuggcuauauacccagaaguaagauugcuagaucauagaguaguucuauuuuuaauuuuuugugaaaccuucauacugucuuuuuuauaauggcuguacugauuuacauucccaccagcaguauacaagaauucccuuuucuccacaugcuuguuaacacuuaauaagaauuaauaauccuuguuauaauuuuuuauuaaaacaaguaauguauugaacugcuuuugcugugaagcuagacuucauucuccugacaauuucaaaauuuguauauuaauuuauauauaaccuaucacagguguugucaacauucuccugagauuuggccaguuuaggaaucugcucuuguuccaauaguucuaaaucccaagcuuggccgccauuuuguuguuaaacuuccucuguucugccucucacaagcauccaguagccccuguuuucuguuuuguuuuguuuuguuuuuuguuugagauggagucucgcucugucacccagccuggagugcaauggccugaacuuggcucacugcaaccucuaccucccaaguucaagcaauucucaugccucagccucccaaguagcugggacuacaggcauguacccccaugccaggcuaauuuuuguauuuuuguagagaugggguuucaccauguuagccaggcuggucuugaacuccugaccucaagcaauucaucugccuccgccucccaaagugcugggauuacaggcgugaggcaccgcgcuuguccaguggccccuccuuguguuuuaaaaccuccuuguggcuuuuugugcguccuucccuuuccucuuuccauaauaauuagacaaucaaacuuuacccaaaugucauguucaggaaguauuuuauucucugacacuccaugcacuuuauaggcuuggguaaauuugcaaggagaagguaguuccuuugaagcaaggaggcaaguaaagagagugaccugagcuacaugcaauuugugcugugauguugauauuauaaccagguuccaauuguaaguuuuggcuauaucacucuugcaauuggagcuaccugagggagugaggugguaauaccugcugagcuaauaucacaugacuggugcuaacagcauguggaaauucguauucuuaaaaugcacacgcauggaccuacacauaaccaucuauauauuuucuccuucuuggaaaaccauggaaggagucagcauccaugggacaaauuuuaauguugaugcuauuuugagaaaaucaauuucaucggugaguagaagucaugcaaagaugguguaaaugaagcaggccugauuucuccauuacaugguaggaauuaagaggggaaucugugaguuacauuugaaagaaauauaaucuuguugccuucugauuguuaaguagugcugagaguuuuugauaugcaagaguauuuucauaaccaacaagaagugacauauuuuauguggguauuguauuagaguucuccagagaagcaaaaccaauaggauguguauauauagagagaaauacacauauuauaaggaauuagcucagccaaucaucgaggguggcaaguccuaaaucugcagugagcauugugaaggagaauucuuucuugcucaugagaagccaaucuuuuugcuugauucaggcuuucaacugaugggaggagacccacagacauuauggagggcaaucuacuuuacucaaagcccaccaauuuaaguaucagucuccucccaaauaccacucacagaaacacccagaauaauaccuaaccaaauaucuggguaccccauagcccagucaaguuggcacacaaaaugaaucagguuuuacauagauauuuguauguauguauauguauguguauaggacauauguaaaaucuaauguuccacaaaaauuguaccacauaaacccuacugucuaauguuguagcaugugcuacaaaccaaaauuccagaaaagagaugcaugugagggugacugaaucuuugauuuuguuauuguacauuccugcgugguuuucguauuagaugggauuuuuuucuuaauagacauuuauuaaaugaaauuaauuagauaucaauaaucuaacaugcaucucacagucuuuuuuucuuugucaucaacuuuuauuuuaaguuccaggguacauguguaggaugugcagguuuguuauagaaguaaacaugugagaugguaguuugcugcacagaucaaccuaucaccuagguauuaagcccagcauccauuagcuauucuuccugaugcucucccuccccacauaccccugacaggccccaguguguguuguuccccuccauguguucucagcguuaacucccacuuguaaaugagaacaugagguguuuggcuuucuguuccugcaucaguuugcugaggauaaugacccccagcuccauucacgucccugcaaaggauaugauuugguuccuuuuauggauaguuuaaguagccuucaaacaaguguaugacaguaacucauuguugagugaugaucauauuauauauuaaugcuuuuuaaaaauaauuuuugauauuuucucaugugccuugagaaauaaauaaaaauaauaauuuuugcaaauuaaacauaaaaauacauuauuugggccaggcgcaguuguucacaccuguaaucccagcacuuugggagacccagguggguggaucaugaggucaggagaucgagaccauccuugcuaacacggugaaacccagucucuacuaaaaauaaaaaaaauuaaccgggcaugguggcacguaccuguagucccagcuccucaggaggcugaggcaggagaaucucuucaaccugggaggcagagguugcagugagccaagaucgugccacugcaccacuccagccugggugacuauauauauauauauauauauauauauauauauauauauauauauauauauauauucauuuuugaagcuauaaaugaaucaaauuauaauuugauucauuuauagcuucaaaaaugaauauauaaucauuuuuugaauauucacacugauuaacuuucuagucauuaguuuuauucaucacaugcagucccuugaugacauuacacuuuaccucagcuucuaaaacaaucauaacuaucuauaguuuauguaccucauauguccaucacuuucuauaaagaucacagaaguguugagaauaugaaaucuaauucaacacuucuaaaaauacgucugugacugcagaauuaucuuuaaggcauuuaucuugaauuaccacuugacauugcauuuagcaaaugacaaaugaugauucugauccucucaggcuugauuccauagugcuuuccacaucaaaaucugcaaaacuuuaaucugaaugaggccaguagaauaaagaucaagguguuaugcaaugcaguuugaaaaaaauacauuuaaauauuaauuaaauuacauaaaaauuuuuauauggacaaagaauagaaaguugucauuuauacuuuguggauuagaugauuucuaagacugucuuuccuaccaauuucuuuauacuaauuagaucuguucucuaucccauuaaagcaaaauugcaaaugggcuguugcauguauagaagcauaaaucauccacauucagcugaaugcuuauagacauauuuauuuuuuuagugaaacccuaagauuuauuuuaaagggauacugaccucuuuuaggccugaugcugacaaggcauugcuucacagcaucacagcuggaaaaacugaugugaggccuuaaggagaacuugggaaguuugggagaagauuaauuaaaaauuaaaacuccaaaagaacaaguaaaccaggccuagaaucucagauuuugaggaaucuggagauuuuauuucuauucucaguaacagcaaacccuuugaaaggaucugugagacuucagaaaauuuauauaaagcccaagcagaggaaguuuuccauaucuaaacuuucagauuuggaugaaucuggaacuuuuuguucuauuuucaguucugucaagcaacuugcuuuccuaguuacaccuaaaucauagguagauaagaacuuucauuugaccagcagacugacccggaaaucuuguugugauuugcuagucugcuguugcuuuuuguguuccuaguuggcuuugcugaaaacauuaaaauacauauauacauacauaccuaaaguaucuuacuuuugauuuuggaaaucaaccaccuuuuauuuucuggcauucacaaacuuccaaaaauucacauuuaaucugacaccagccaagaauucccauuauggagaucagcaaugaauuucauuuauuaggaauggaacaaguauauugaaacauaaacauuucccccuuuuuuuuaagaaaaaacucuccacuuguauaaggaugagugauauguaugcaugugcucagauuucauaucaauucaugguuuauagccaauaugguauaacuuuagaaauuauaacagcauaaguggcucauguguuuuauauauuucauguuuuaagucacuuuuaagguuacucuuguacgauuuuuaaauuagcuuuccucucauuggcaguuuucguuaauaaaaauagaaagaccaacugaccacuaauuucuucaguauugaguuuacaaucagcguuaaaagcuauuaaaauaugcagcuaccuaauuauuguauuuucuuuaugcccaggaaaaauaauaagcuggauagauuaaauuauuuuuccacuguaaaaugaguuuuuauuuuauauuccacacagugguuucucccuuucaacauaagacccuaugaauuuuaaauuauaaacauuauguauagaaugagagaaggucuuagaagaacuaauuaagaaacgagacagggaugccuccuguguccuuaaccagaugccugaccucauucucauuucuucuugccugaaaagggcacagauguuuguuccaaacuaguacuuaugucccaacaucugguccacauuuugaaauugaaaggaaaagcauacggguacuuagcccugggaaaaauaaaaggauguaguguagaaagagauggcagauacaaggauacaucagugaauaaaaaugcaggauuaaaaugacuuucagagaucaagaauaaagugaucucagaaauauuucuuuucaagcauaauacaguuuucuuuuguauguccuuauagagagauacuguucucugcaaggguauuugccaugauugauuuacaucuagggcaauguugcaugccuauaaucauuaucaaaagaugccuuagugcuaaggaggauguacagauguggaaauuaaaggauaaaaggauuugacauaaaaccacagacugagagaggagcccgagcagucuccagauggugguaacagcaguggaucucaaagagcccacauucagggcacaaaggaaggugugcaacuacaucaggauaaacugcguagccauauacggacuggcuauuguuauauacaggcugguuucagagaaaguaaggaacuuugagggaaaaguauaauacaauuuuuccauuaacagaugccaguucuaagcuaacauauauauguauuuauuauauucacuuuauuuccaaauuuuuccaaaacaauuaauuuuuaucuauuaucuaucuaugaucuaaucuaucuuaucuaucuaucuaaucuaucuaucuaucucucuuauuuugguuugcaaucauuuuuacaguucagcaaugcaaucaauauagcugccuuaugaaaauaauacuucauacaguauucauguauaccuauuuuuauauauacuauuauguauauacuaauuuauacaauacuucauaaaguauuauuuauuuauacacuaaagaggacuuucauaaaguccucuuuuuaacgugucccaggauuaaguaaauggauucacacuaccuucccaacuuucuuacuacacaguaaaaauuuuaaaaggugagucaguugaccaucagcuagaccauuacauuauugaaaacaaguguuccuuuugcaaaaucucuugcuucugcguaaacaaacucaaacuaaaacuuuuauuucaaaguuauuuguuauaugucaccuaccuucuuagaaauacguaaaggggguaagaaauacuucauacuaaggaauacuaagaaauggccgacagaucuaagguuuaaaaaauaucuauaacaagaaaugauuuuauuugauaaaaugaaucuacuaguauagaauaagcagccauuuuguguaugucacuauguugaacuacauucaauccuacucaagaaguuuauagcauaacuuuaaaauuuuaucuuuaucuuuaguuuuaaccaauuugauaaugauguacuuuagcuuuuuccauuuuuuugaacuucuauuuuuuuugaaaauuuucuaucuuuuaauugauaguuuucaucgaauuuggaaauuuuucacuccucauuucuucaaacauuucuccugcuucuccacccuuuuaggaccccaaguugccccauagcucacugaugcucuguuaauuuuuugucagucauuuuuuucucuuuguguuuccuuuugaaugguuucuguugcugucuucaacuucacucaucuuuacaaucucuaagcugccaacagucacagccuaugcauuuuauaaucucuagaaguuaaaucagagucucuuuuauaucuucuguaccucuaauuuucaugcucgcucaucauucucacuucuugaauauaugggauacaauaguaaaacaaaaauguucuuguuuacuacuuugaucaucaguauuauuucuuggucaguauugauugauuguuuuggauuuuuuucuccucauucuagguuauauuuuccugcuuaguucauacuuggcaacauuugauuggaugacagaccuugugaauuuuaccucauuggaucuggacauuuguguuuccuagaaauauuccaagcuucauuuaugacaaguuaaguuacuuggaaacauuuugggucuugcuugaaaguuguuaguugagaucagagcagcauuuaguguaggguuaauuuugcuuuacuacugaugcaaacucuaucccaugccccaugaauuaugagacuuuucucucuggauugugggaauaagcagcagauaguuugagcucuaugcgagcuucaggaauuguuccuuuuaaucauuucaguaguuauuuaccugccucagauaguuuccucaaacacucccgaaucaguucuccacugaacauuccggaggguuucuucuuagaucucuggaacaucguuucugugcagugcucuccucuccaccagucuucucuaaggacuauggccagcuuggccuuucaagacugcucugccucaacccagagagacaacagacaaccuccuggaccugcaugacauccuggaaucauucuuuccacacaguagcuggggcuguuguaggucucuucaaauuuguuuccaaccugucaaagaucaugcuacuuuauucauuuacagcuuuauggacucauguucagagucuugcaaaaucacuauuucauauucucuuuucucuaaguugauguuuucuucagaggggagagcaaauuuggucccugcuacuccaccuuggcuggaaguaaaagcuucuacaaggacuuagaaucuagugguagaugaguuuccaaauauaaauuaauaaaacauacagaauggcaaauguuaaguaaaaguaaauguuaaaccacaugcauggcuuuuauuaucucugagaaguuaaguuuaaagaaagaauuuaaguucaaguaauaacuguauaaaggcgauugaauaucugauaacaaaagaugucuuauauuuccagugaggaucaaagagaauuagacaaaaauauaacugagaaguuucacuagagauauaaggcaaacacuguuaucgaacaaauuuauaccguaccucaauguacaguguuuuaaagaaggauacauaacuacauugcauuaaucuauucacuuguucuuugauucaaucaaauauuuauugaauauuuacuauacaugucauagauuauguacugggaaauuacuaaguggguaauaaugaguaucaugcuuuuuaaacccaacuaauggaggaugaaaaugaauacacaaauaauaauaaaacaauuauuauaauagaaguuuaugguaagugguaugaagacaaaauauauagaagaggccgggcgcaguggcucacuccuguaauccuagcacuuugggaggccgagguggguggaucaugaggucaagauaucaagaccauccuggcuaauauggugaaaccccgucucuacuaaaaauauaaaaauuaucugaguaugguggcacgugccuguagucccagccacuugagaagcugaggcaggagaaucacuugaaccugagaggcagagguugcagugagucgagaucgcgccacugcacuccagccugggugacagagugagacuccaucucaaaaaauaaauaaauaaauaauaaauaaauaaauauauguauauguguauauauacguauauauauauauagaauacguguauauauauauguauauauauacguauauauauauauagaagagaccuuauuucuucuuauuccuucuauagcuaggguuagggaauuagaauaauuuugaaaaucaaaaugauauuuaagcugagucuugaagacuguuugaaaacuuguccaguagaauauugugagguauagaaagcucauucuagacauaaaaacaagacuggcuuauaaucugugcaacgcagugcaaaauaaaaacguagggcccguuguuaaaaaaugauuaagaauuucaagacagugacagcagagcacuauaccuaaugugcagccuauuugaguucagcacccuguggaaugcauaggucgcauccccauggagcuggccuuguuuaugucaagaguguaggcuguggagugguggaaaggucagagauaagccuggaaaaucuauacaacacaugaaggagugagaugguuugauugaguuaaugccagagaaaagggaaaucgacugaauacucuuaaaaucucuguuauugggcauagauucucuaaacauuauaaaggcucaacugcacugaccaauuacaauuauuuagaaauaaacaguuuuauggcugggcacgguggcucacgccuguaaucccagcacuuugggaggccaaggugggcagaucacgaggucaggggauccagaccgucauggcuaacacggugaaaccccgucuguacuaaaaauacaaaaaauuagcugggugauguggucggugccuguagucccagcuacucgggaggcugaggcaggagaauggcgugaacccgggggucagagcuugcagugagccaagaccacgccacugcacuccagccuggacgacagggcaagacuccgucucaaauaaauaaauaaauaaauaaauaaauauuuuuacuaugaaaauaacagcaucucuauuuacaaauuaugaaauaagaaaucccauucaaucuacgugauguguuauuuuaaaagaccgaaaauugcuuacuuaauuuacaaauuauuuguaaaaaucccugagguucaaaaauguuaauuuuccaagaggaaaaaaauugaagauaagaucauaaaacaauaucuuuuauuccacaugccuuuuacaauaaaauugggucuuuccuuucaucaagagguggagucuaucccuuuucucuuaaaccuaggcuggcuuggugauuuguuuucaccaguaaaauaugacagaauagacaacauguggcuucguuuaagaggauuuguagguuuccauuuuuguaugcucuuagaagucuguuucgaaucuuaaggaaaacaaaacuaacgcaguagagaagccacacgaggaaguuaggucccauauaaguuaaucaaguuuucuuggaaauuucaucccagcuaccagcuuaaugcagaaaaugaguaaauccugcccacccuuguggaauagaacuaaccagcuuggcccugacagaauuccauacuuacaaauuuauaagaaauaaauuacugucauuuaaaaucugucagauuuggggugguaugcuaugcagcaauagauaacugaaacugcuauaagauauaaaacacaaaguauuaauacagcuaaaugucauauuuucuuuaaaaugcaauauuggcuuuaagauagcucaaaguucauguuauuaauuauuaaaauguauuaugacuauuaccuuuguuguuguuguuguuuuaucuccuuggaaaagaaaagcuuuuuagaaaagguacaacguagaaacaguguugguaaauaacuugcauaauguccguauuuaauaauguaaggauauacugaggaacacgggaaugacauuaaaauuguguucuguauagaaauaguggacugauaacuaggcagauuggaugucagugcuccacagaaaucaacuggauuguacaucacuaauaaaaauaaucuucauucaccugaauacaaggaacaugguucugugcugacaggauagugccgucucucaaucaucacugauugaaaucuguaaaaucacagguuuuguacgacugucaacuaaagcuugucaucauacuaaaaggcauaucaaccaguuuaauauuaggggcauucaugaaauaugcaaaauucugucuaaggugccaucuuaaaugucguuuuaaguauauuuccuuucuuucaauaauacccauuaucacauauguguuugugauaucaaagggcuagcuagggcuaccaguucaacuccaagauggaguacacauaauuucucuauucuuucugugaacugcagccccaagucauugauacuguagaugaaacauccauuaagaagauucugaaaagcagagaaaagauagguucauuggggacauagggaccugaggauacauggcagugaauuccuuggauuuucuuuuugcuucauauauuuucuuauagagagaagccaauaacccagaaauaccaacaugcacaagaggaaaaaagggccacaaauuacauaauauaauagaaaaauaccaacacuaugaugacacagaagaugggauuaucugacaaggauuuuaaagcagccaucauaaaaauguuuuaacaagaaauaauaaacauuccugaaaccaaugaaagaaagucucaacaaagaaauagaagauauaaagaagaaccaaaugaaaaucuuagaacugaaaauauaauaagcaaaauaaaaaacucaauaggaucuacucaacaguagaauguauagggcagaggaaagaaucaguaaauuagaagaaagaaugguaucaauggccuugccucggcaacacagaaaagaaagacugaaaauaagaaugaacagagccuuagggagcuguggcacuguaauaacagauuuagcauucaugucaucagaguaacagaaaaagagaugaaagaggauggagcugggauaaucaaagcugaaaaggacuuacagggagucaagguuucuacauccagcagacggauauaaguuguuauguauagggcugaugggugacguuuuuaacuauaaagguguagugugaagaaaaguuuuguguuaacagaauaguucuauauuccaauugcagugauuaugugugaucgacauuacacaaacaucauaccaauauccauuuauuaugcuaguuugguaagauacaaccauuagaggaaaguaguuuaaaaugcauggaaucucugcacuaacuuugcaaauuuccaugcaucuuaauuaguuuuaaauaaaauguuuuaacaaacgauuacuguaaaaauccuauauucacauguacccuaaaacuuaaaguauaauaaaaaaaaaacaaaaacaaagugcuuauaaaauaugagaacagagcaacgguaagugcaaucuucuauaaacaaagaauuuaauaaaagagacggaaauaaaaauaacuuuaaaaaguuaaaaaaaaaauccuauauucuuuaucccccuucugaaauuacagaguauaggggaaauauuuugagcuggaaggcaggagacccaauuguaguagccacuuuauggaaugacaagcuguuuugucuuagaaaauugucauuacuuuucuguguuuugguuucccuaaauguggauaaaaggaugacaaucgauuucugaggcaccucuuaauuugugauuugauaguuuugucauaguuaacagccauuucucaaucauuaaauauguauugguguugguagcauuaaccauuuuucuuuacucaguaaaugcuauuucaaguuacauacuucaugggaaucuugugaauuaaauuaagaauaagaggaagcuuccuguugaaaaaagauaagcucuuagagacucucuuauuaucauccaauuuuggaagccaauauuauuaauaaaaggucacaaauuguuauccccauuuuuucaaaugugcguaugacguaaauucaaaacacugacaauuaaggaacaaaugcauauggaacuuaaacacaguuuuuuuauaugauuuaauuucaauccccagaguaaugaguaaacaccauugauauucuuuuaucauacacgaaccauuuuaggauguuuauuaacuguaacagauuucugcuuggccuuugaaacuauuaaaauaaauacuucugugauuauugcaaucugaaauauuccuucaucaaauuguuaaaccugaauuuauagcacagguguuaaugaagcaugaaagcuucucaauucugauuugcaguugcaagauucucauauuuuauaacaaugcauauuuuuugguuuauguaaugucaaagaaaauaauauugucuuugucaguauauauucuauguuacaucauaaaacuaauaaaaauguaggaaacaauuugaaaauuguaaauugguucuaaaauaaauauaacauaauaggugaaacuaaaauauuauagccuuuagaagggucacucauaauuuggcaaauacuaaugcauugcugaaccucaacuucagacaugcacauuucuuucuuuaacaucaaauaagaaaagagcuaguuauugagacaauaaauuagcuccuuucuuuuacugaaaccauauucuuggcauaacugugcuguggcguacacucuccauugagcaauaaaaguuaagcacagagcagcauuuaaaaucauauuaauacauccauuuguucccccaaauguuagaugcagcauaaaucuagcagaaguauauuaaucugaaauguaacuugaauagcauaauaugaccuguauucuuaggcaagcugaccagugccuuccuaagauacuguuuugaauuuuucucuuuauaauagauaucuuuaaagcaaaauuaacaauaaaauaaaaauauugcuagguauugaagccauaguuaguauaaauugcuacuuuuugaauaccuaaaaagucuaaaauuaauaugcuguauacagagcuggacuaagauaaauguuguaagcaguccacuuccauagucagucuuuugggccuuuauagaauauagaacaauaaaagcgauggaauauuuuguugagguagggcaggacucauaggugaguauacuguauauuucaaguagauuucucuccagccaucuaaauaaggaucuucaagaguugcucaaguguucugugcaaugcuaaauauucagaguugaaaauaaaucagcaugugacagaauccaccugggagcuaccuucaccaacuucucacuuacuguuucaaugucucacauguuuuguuuuguuuuuuccccuagaaccaacuggucuuuuucuuagcucagugaccacugaggcaaagaauaauagggauuuguuuuuaagaauaaauguucacugaugugaaacugacaucacaguguucugaagaaagugcuagucugguugcaaauauaauuucuuuuuuuuaucuuauuuucugcaacacccucagccuugggcauuccauauuguagaauguguagaagauuucucuagauaauuuggagcugagugggauauuaaaauguucacagccacgauccucuaaauugguuuaguccuuaauaacaauguagcaacuguuuccaagacuguuuucuaguuuucacuauauuugcuucauacugugucauauuaucaugauuauuauuaaaacauaauauuuuuuauuuaagcaguagcacuuuacauuuauguagccucuugauuucaaguuaaauuccuuggggcaaucuugccuucagcaaucuuucucaauuuacauguaagaccaaugaacuuaguaagaaugaucuacgguucuuuucugcucuggaguuaaugugauucuucuuuuucaaaauguaccaaccaucaagaagcaacuuagucacuuuaccaagauuaaucccaucaccugaaggagaguuuagggaauauaucuucuuaggguugccuguaauaaauuuccuacccgagauacuagaauucuauuuaaaacaaacaguaacagacauuugguagaauuucaaguuaaccuagcauuuauaagaauuccuacugucaaugcuacaauaaauaggcuugugggaaauguuguuuccacuaccaauccauucuuucucccucccucauucaucuugcucuacuacuugcuaucuuuauuugauacagauuuugaaaaugcuacuaaaauaaaaguaggauauugggaaaaugucuugauaaugcaagcacauaaacagcaaaaagaaaagaaacuguaaagagauacacacacacccucucuucaguuauuugauucucuaauggggaaaugcuuucuuguuuugaacaauuuuaaaauuucccuccauccuguacuuaagucuuccacugaucuggaaaaacucugggaacucuuuuguuaccucaugugaaauugcuugcucuagguuucuauuauauaagguauucuguuucaaagauaagaaugguaucaugucauaagaagaggcaagcauuucuagacauugaaaggaauuuugaucacaaguaaauuucucuuuuuucaaagcuaccauguacacaacagcuacucaaucuaugauacuugauuugauuuugccccauuuacaguuacaacaacgucaggcauaaaaaauaaaaucauaauauuuacugcaguauuuauuacaacaaucucauuauacuuuggccacauggagaggauuggguugaacauagccugguuuuauuucucucccuggauaaaaauuuuggugacucugguauaaaaucugacccuuccuggaaacuguacuaauacuuauuagaaggaaguuuuuuuguuuaugaaaugauuugagcagaaugucccugguguggaaccacuuaggugaacacacuuagaauccaugggcugggcgugguggcuuaugugucucgguggguggcucaugccuguaaucccagcauuuugggaggccgaggcggguggauuacuugaggccaggaguucgagaccagccuggccaacauggugaaagcugucuccacuaaaaacacaaaaauuagccaggcaugguggcaggcaccuguaaucccagcuacacgggaggcugagggaggagaaucgcuugaaccuggggggcagaaguugcagugagccgagaucaugccacugcacccuagccuaggcaacagaguaaaaugcugucucaaaaaaaaaaaaaagagagagaggaucuauggauuuaugaagcaugugcucuuggaaaaugucauguaaucccugaaugaucaguaaaguggcaacaguucaugauacuucuggcuacaugaggugaacagcgaccuucauugcaauggcucauccauuacuuugguccagcagauguauccaguccaggauguaucuauccaccuaggaagaauccuggguccuucaggccauguuccaccuguaucuauguauuaccuguauccuuuaaauuauuaguaaaucuuuacacuauacaaauuucugauucauguaagucaguucauuuuuacuguguuaaaaaaugugauaggcugggugcggugguucaugccuguaguuccagcacuuugggaggcugagguggguggaucacuugaggucaggcguuugagaccagccuggccaacguggugaaaccccguuuauacuaaaaauaugaaaauuugucaggcaugguggcgagugccuguaguuccaggaggcugagacagaagaauugcuugaacccaggaggcggagguugcagggagccgagguugugccacugcacuacaaccugggcaacagagcaagauucugucaaaaaaauuuaauaaauaaauaaauaacaugauaaauaccaacuaauuagacaguuuauucuacugagaaaaugggauauggauuaauuuuucacaaacugaaauucagcuaauguauacagaacacugugauaauacuagccauauucacaggcuauacuuauguaauucugcuuaaugcucaaaccagcuagaauagggcuuuaugcuauuaauuaacaaaagauaaaauuggggcacaaagaaauuauauggcuuauggaagaucacacuauugacagcgcuaggauagcagcucugucuuuugccucuuaaucuagaugucuucuuuauaaaaaaagugguugacaggcagacaaaaccugaauauaaaauauagcucugcuacuuacucaguuuuggguuuugguaauuuuccaaauagccuuuguuacaaaaugacgacacuguggucacuaauguuauaaacugguuguuagauggauuaaauuauuuaacacaaaaaauuaaugcaaauacugggagcaguaagaguuauuacggcuuuguccuaauuuuuccuucuucucacucuguaucucaggaguaguccccaaauuucuaaacagggaggccugagcauagugguaugaaugaaagggguggaaagagcagaggcacacucugaaacucucuuuuauucuaaauacgauuaugcaauuaccauuuaacuuuacagggaaaagauggucguaaaguauaauuauuuuuagucaugucagcauucucaaaaccugaccaugcuuuuauuuaucuauuuauuuauuuauuuauuuauuuauuauuuauuuauuuauuuagagacggagucucgcucugucaccaaggcuggagugcaguggcgugaucucgacucacugcaaccuccgccucccgaguucacgccauuucccugccucagccucccuaguagcugggacuacagucgcccgccaccacgcccagcuaauuuuuuuuuguauuuuuuuuuuaguagaaacgggguuucacugugcuagccaggauugucucgauuuccugaccuggugaucugcccgccucggccucccaaagugcugggauugcaggcgucagccaccgcgcccggcccauguuuuuauuuuuaaugaaaacgaaacuucaaaagcacaagccauggaguaugaacgaaucuuuggaaauacugugaaaucugcacccaagacaagaagaaugcuuagugcuuacacucaccuccucaguccucaagccucaaguacuaauguuggaauccugaaggcuaaauccacggaacagggcuaggugugcugugcagggcuaguacgauaccacaaaaaugucaagugagcaggaggggacucaaggauaagucacgaucaauagcuccuucuauugugauaagcuguccccauucaagauggaccacagauguuaguggggcaucaggcucuuucaagagguaccaauucaacacagaguuuuugaccuacugaguuuuuuugaugagguaaaaagaccuguaagauuaagauuuggaggaagguguuucacacacacucacacauacacacacacaugcgcacgcacacacacacacaccccaaauggauugagaauuuuuccuaguuuccucuauugcauuuguaccuaucucaccacuaacacacauaacauuuagaauuaaaaaccuacacuuagauguaucauaguauauuuuaaguaaagaaagugcaaacauucaaaagacuucccgaaacaaggaacaaaaauuagaugggcauaagaaacccucgaugcaagaagauaaggaugaacccuucuaaaguguaaaagaaaaauaacuuguggcuuacaguuuuauauauagauauuucaucacuugaaagugagguugaaauauauauacucuuuggaauagaagacuucaaaaguuuugccacacacagaaauauacacaaacaacauuugaaaauuacacagagaaaguacuccuccaagagaagaaauaauuucagaagaguaaauaaugacagaagacaugagggaugugcaaauacaugacaguaccuuuguguuuugaaagagaaugaugucaagcuuacaaggaagauacaaaaaauuaauaucuuuacauguuuuaucuuuuccaauuuuacccucuuuuguuuguuuguuucuuccaugagacuucuugggaaagagacaauaaugcagaaacuaguaaauaucugaucaucucuguguccuugucuccagcuggagacccaggagcgaagaaaagagagacacagcagaagagaugagaggcgaugcugagaggagcuccaugccuucuucucagguagagauuuugggaacuggcaaaaacccagagaggaaugcgagauucaagagcaaagaggaccuuccucaguagacuccagagcaucagcaagaggaaaugcaugccagguuuaggccaaugaacucaucuuguagacacugacauccauggauggaaaccagagaaugaucuccauggccaugcauguaaucagcagcagagagggccacuuuaaaugaaaggaacaggugggcagggaagagaguugauguguaucuguaaucgaagaccaaauagggagacaguucuuucaggagauaccgcauagagagaugacuugaggacaacuugcauaugaauugucuugcaauaugaaaguccucugaaacuuagucacaaaccccccaaaaaauuuuauuuugccaacccagaagaauagggcuuaagaaagauauuaaguugucuuccagagaaaauuuuuuucacgguugaauuuuugaccugacagucacacucauuacauauguuuauaguuuuauucugaaguuuucauacugacaggguuuaaauaaaggucaaaaacauuauugaauguauccucugaucaccucguucaucucuccaaaaucuucaacuuaugaguaagugaaauacgccuacaauucugacaaaacugacucuuauuuuagacuuguaggacaaguugucaauguaacaucuugauuuauguccagugggaacaagaaugaacugugugacauuccaaauguacaaucaacaaucacauuacguauuugguaaugaagauacugcuucacugaacuaacaucucccuaucuuaaauucuaauauuagguuuuucagauaacuagacaagauauuuauguaaaauaauaauuauaacuuaaucagaaauaugaaucuauguauuuauguuaccacaagugaggcauggguacuuccggguugugguauaaaagauuugggaaaaauaccaaacaguacuaaguaaccucucaucagccaacuuuaaaacaauggaaaauugugaaauauuuacgcagaugcauuguuuugguggagggcuagguaaugaaauucucaagagucugauuuuuuuaaaaaugaagauauacacacagacagcauaaccagugugacuuuaaauuuucacaucuucucuuuagguaagagacauacccauccacuucauuaaacgucaggcuauauugcuauuucacagucauuaucuuaagggcuuucauuacacucuuuggauuuuaaguugaaugucaaauagaauuuugguaaaagaaauacgugaucuaguuucuuaugagaaaaauuaauggauaaaucucagcacuuuucauacacuuaauugaguguuagguuaaauaaguuuuaacugaccacacuuuaaauuuuaaaaguacucaucuucauuuacuuuuacuccacuaaguuucuuacuacuaaagucuauguuuucaaaaaccaauccaaaaaguacagcaacuggucugucaaauuuuaauauacuuauguuaauauaggacagauuuuuuguuuuguuuuguuuuguuuugagauggagucgcucucuguugcccacagggcagugcaguggcacaaccucagcucacugcaaccucugccucccggguucaagcgauucuccugccacagcuuccagaguugcugagacuacagguuuccaccaccacacucgauuaauuuuuguauuuuuaguagagacaggguuucacaauguuggccaggcuggucucgaacuccugaccucaggugauccacuggcguaggccucccaaagugcugagauuacaggugugagccaccacgccuauccgagagagauuauuugaaagugggauuguuucauaaauccagaaaaauaugcuaauuuugcauacaauguaaggaaagguguuuuuuuaaguaccucucuaaagugcuuaaucaaguuggaaccuuugugacuacgacaagagucauucugcucccauauauauaugaaaauaaggaaaaaauucuguuuuguggaaaguuguagaaauuaaacuucaaauaugaagaaguagaugcagauggcauuuuguuugggggcuucuggaaauauggggugaguuuuuagaugagauuuggacagaacauacaauuuucaaaucaucuacuuugaaguaaugauuaaggcuaaauaaacauauauaauaccaggaggaaagaagagaagacaaacaaaaaaauguccaacaaguuccuugaugaauauucauacuuaagggaaaaaagaaggccagcuacuggcucuaaaagcaguaugagaaauaaagaauaagaaauguuuucaugucaaagaaguuaguggcaucuacaucaauagauaagcugcuaaacacuuugacaagcauacuauaugagagaaaacauaacuuugguguaugucuuugaaauugaagagaguguuuuuuaaaaaaugaauaucuuaaacacuggaaauauaaggaagggauacauaguccccuucucuggggagaaaugugcucuccaguuuuaaaaaagagaacagauguauuaauguuaagauacuccauccaccuguggcgguacuuuuuuuuaguaauaaauaauccaaaaagugauauaaugaaauccuacacuguuuucuguuuuugaaaaugcaauguaaagcuaacaugaauaaauuagaaaagaaaacuucuuaagguaugaaaauagccugaagaauagaaaugauuuuagaggcauuaaaaucuaugcucaggaugacagaccauguucaacaagugugugcccgagagaaagaacuagauagcaaaaugaaucccuauuuuuccaguauucccugguguccacucuaaauguuuugagauaucaaccaaagcucaauaaaaaaccuaucuuaaucuuuuagaaauuauauuguacaaccauuguaaaaauaguuuuugguguucaauuaugaguaaaagaauucuagaaaauccaggaaagaacaacuaaauuaaagacuuggaaaacuauuuaaaaagaaacucuuaguaguauuauugcuauuuucaugaaaauaaccuaccaugucugaaaaugugaaaaauuagauauaauuaaaaugcaaacuaauaaaagaaauauaaauaugaacacaaguuuucagcucauuauaaauauguagcccaaacuucugaagguaauauuugggcaaagauagacuuacucucuuauccaguagagaguaaaccuucacaguguuugaucccuuguugcuaaaaaggauaaugaaauaaauaagaugaaaaaccaucuaaaaucaguguuucacaagcuguguuccauggaacccuggaucaaggggauaugaauagacucuuuaaaaaaaaaaaaagcuucuauggauaaauaacuguaggauaugugacagaaacaguuugagaauucccuuuacugcaugaagacuaagaguuuuuuauuauaugauacgaauugcacauauguauacuaggcauuccgggcuugcuaguaagauauacauauguauaauguauagcauaugaccaauguaagcuagauuacgucucgauagcaaacccugaacuccuaggggcuuaacaauaaagauguguauauuguuaacccuauguccccaucaugggauagcaaugauguucuguuccauaacaaccccuggcuaauacagguacuguuauuuugugguuguaccaucugcaacauggggcuuccucccuuacuccgguaagaaaggggacaaaaacaaacaaaaaaaaaaacgagauuggggaauugcacaugaguuuuccagugucuuaguccaaaauccacuucacuuuugaucacauuuuuuggccauaacuccucacaaauuugagugcccaaacaggcuagaaaauauaaggaaacaaauggaauguuuagcaggcauuaauauauuuaucccagcaucuaaggagaaauuuuaaaguucauuauuuaccaaacuuauuuugauguacaauuauuuuuuuaguuugccauuuuauaggauuaagugucaaugaagcacaaauugagaaauacugguuuaaauaagcuuacguuucaugagaaggauuuuugagcaaugcacuuacaauucaaccauaauauuuuuguaugaaugcgagggagaaugguaaauagaugccaaaauuaucucuagucaccuuaaacaugguacgcauuucacuagauaauaugaaauauaguuuugauucaauauggcauuuauuauuuuauucuguguuauaauaguguauaacccacacauacauacaugagcuaugcuuauaucuuugaaauaguaguuuugucguuuagaacagucguccccaacauuuuuggcaccagggacugauuucauggaagacaauuuuuccacggacaggagggugagguugggguagaugguuucaggaugaaaguguuccacccaagaucaucaggcauuagcuugauucucauaaggagcgcgcaaccuaaaucccucucaugcacguucacaguaagguucacgcuccuaugagaaccuaacgccaacgcuaucuaaagggaggugagcucagacaguaaugcucacuugccaccgcucaccuccugccgugcggcccgguuccuaacaggccauacaccagcaucagucuguggcccggcaguuggggacccaugguuuagaauuauaauuuauagagauucuugucuuucuaauauuucuacaaugucaacaaauguuaacaauacagcuuuagauauugcuugucaacagggcagucuacuuagccucuucucaguuuuauauucuccauucuuuaauauaacggaauaacauguuuauaguuaauguuccauagaguuuauacaccaagcacuugcuauuguccuguuuaagaaauuucauaaauuguuuucauacugcauccuucaaaauuaaaguuagguucuuaaaaauauuuaucaaguuuuagagguuucuguuuccaggauacaaauaaucucuguguuuuuguuucuucuaaacuguguuuuauuguuuuuagcuuuucuguauuuaucauuuugcuuuauguuaccuauuguauuuuauaaguaugugaauuauuuuaaauuuuccuauuaucuccccuuauugugauuacuuaggugcuuauuuuuaaaacugaaauaguuuuguuuuauauuaaauuuggaaaauaugucaacacagacauugucacauguuguuuucuaauauacaugugaaaaauuaugaauccacauuuuuauuaucaccacugcaacauauauagccacaucaacaugccugcuaauagcaagaacauaagagcauaccucuuuuguagacacugauuauuaaucuaagucaaaaaucaucuauuuguauggggaaugaagauuuuuuuacccacuuacccaucacaaaaaacauaaaaucuccaaaguauuaugcggacuuagcccuaugguuuauucuaagaguauugcuaggagagauacauggugcuaguuauagguaauuaacaguauuuucuauauuauaaauuaagaauaauguagacauucccuaaacugucauauuuuugcugaauaacucaucggcauuauagggaaaugugaucaauaacuggauuguuugcaaaaagaaaguauauacugguaaauauacaaguuuaggcuuuggauucagccaaaucuuggcauaucauuuaccaaguauguuauuuacuagcuguauguauaucuuggauuugaccaaagcaaucuacugcagauaagcuccuguugagaauugacuccauuuccuaacuuaacucuuuaaaauauaugauagcaugaucauaucuuguugugaggagaggaacgacuccuacaacauauguccaaauaaaagcauuaaauaaaggggguugaaauauauguuuacuaagaagugauuagcauacaugacauacacacguuuuuaucaauucucucagauguacuaagugccuauauaauauacugccugauuuauacucccaaacaucuccgaaacacuggucucuucaaugacccuuuauguacaaggaacugagauuuuaaaauucuacuagagauguuuacagcugauaaauaacuaacggauguaaaauuagaugucaagucuaacugauuucauaucauuuguucguacaaacucuacgcuuacaaaggcacacaauucuuuuaacuagaagucacaagacgcagaacugaaauggaaacucaaaauauugggcacaguuuuuuagcagggucuaaaagcagcugguacucacauugccaagcacuuuuugcagugguggagagaggaguuaaauuuacaagaauuauaaguuaaaaaaguuuauuauuggugcaaaguuuuagguuaaaagaaauuaaugcaauauaauguuaauaacacuaaauuuuaaauuagaccaucugaauuucagauuuuauauacucaucccacuagcuauguuggccaaaagcaaguuaauuaacccucugaccaugagacuauccugaaaaguaacaccuauuccccucauaguagaaauuucucaaaagcagaaacuucaucuucuauaccuuuugauuuucuauaucaaauaagaaacuuccauggcuccugaguugcacaacaaagagagagagagaaaaguuugcauugaaguuucugugaauugcacacuuuugauuuguguaucacaaagcccugcagagcggcccugaaugagugccuggcacacauaggggauucaauaaauccuauugcaauccacucugaacugccacaaguuucuuuuuuuuccccaggaauuaaguauaaaacaauauauauuaaauuucuaauuuacuacaaagaaauaugcuauuauaauuucuauuguuuuaaccuucucuaauauuguuuuaauccauugcugaaacaguuaagcagaaacuacauaauugugccguuauuauuaacaauaucaucuucuauuuuuguaaucuaaacaaauuuugauucagaauuuguuucaaaauuucuucaccaccugccuaaaauugugcucccaccucuucugaagcguaucaugccugcaaacucuguucuauguuuuauaaagaaacuuagauuauucacauaaauguugaggguuaugaacuaauaguaaguaaaggguaagcauaauuuuaauccaugcuugaaaguuucagacugcugugaaaauuagccuguggauccagagaguccccugacaacaugcauucacaauggcguaaaaucugugaaagcaccauuaaugcuuuagccacgcuuauaaauaagaaaacuaauaagauugccucuuagaaauucuguugacuacauuggcucuucuuuuuaugucacuuuauugaguagaaccaacccaaauguaaccucacaguguaauucucucaugaauagcuucugcagauuuagauuggaaugguaucuggccauaaaaaaagcaguuuaaugcuacagugaacaccauucacuaauccucauguaucauuugugaaauucagucuguuuggcaaaaauaaaugccccuuugcccuuaaauacucuguaaaaaugcagucugaaaaccauacccaggccauggucgcuuuucuggaagaaaguaaagaacuguaauagucaagaccauuauuuucuuuccagcaaaccaaugcaaaauaaauuccuucagcaccguaagaaggacuuuugaaagguggaagcugugguuagguuugcugcuuaugccuguaagacugggcuucuucuaaaaugauuacauuuguguacauacauuuauucaaaucaacauaucaugacggaguucucauuugcaccaggcaaugcauggcuuaagacacaagacucugcucuccauguuuucacaguugucuguacgacacuccacaacacagcgugaugagggaccaucuguauagagaagcauuuugcaaucuuuucugaacucaugacuucaugcuugcuuucucacucaucuuccacauuccuccacuaugauauagaugaacucucuggauccauagacagacuaauuuuuacagcagucugaaacuuuaaauauauauauguacacacauauuugaguuuauauuaugaaaagcagaaguaaagagaagccuuugucaauguguauuuucaaucacaaccccauuuuggaaauucucccacugucgguuuuauuguguuuaaggagauuugucuccucgagcuuuucuacucuccauucacugagcaucacagcucaagagucacugaaaucgcguucugaauuagaagguguggaccugaccccaaacaaauuaaguuaagagagaccaacagauagcuuuuacguuuugaauuauuaauuugauuucuuucuguguguacaaaggccccagggaucaccuguaacaaauaugcuaaauucaauuuagcagagagaacauggauauugggaucacuaaucacccuacguucuggagcccccaaacacuuuguaguccaaacaaaagcaauuacaauagaguacugacgguuuggaaaugcgagacacuucuuaguuuaggaggaaggauaauucagcuacuccagacaccauuguuuggggguugaguugauuuuuguuuucauuagcucgagucucuuucauuaguuccuuucauuagcucuuuucucuguagagaaaggccuaggccguggagugauacugguuuaauaaaugcacuuacaacucauuagugcuccaaagucaaccggcacggagaaugcaggcuuugauucuuaugagaccaaugcaucaacacaauaaacuauauuaaagagaguacagcuaauuucaaauaccugcaguuuugguuuugcucuucacacuuuaaaaauaaggaacaaacaucacuuuucuaauaaugcaacuaaagaacuaaauggaauuuguggccacuuaacccuauuccuuuauuuuagcaaaugaggaaagacgugaauuaguggcagaguuuuuuuagaacccucauuuucuaccuggcuagcauuccuuccacuagaauggacauuuucaaaaucacuugaaaaagauuaauuuucuuuugaucuccaaagagcauucuauauauuguuuguuccauaguuucuacauuuacagaguuucauaaugagaauuuauauuuagaagaaaauaaaaaaugcuagaccucugaaugaucaaaaaauauauaauucaauuuauuuauuuuacugaauuuccuaagacaagaaaguaaaacaugucuuaaacuuuauaguauguaaaaacagugagcaugacucaagauaauaauacauagcaagauguucuauugaaaaacuauaaaaacauuccucuuuaauuaagaauuauuuaacaggaaacacaucauuccuugaucauugaucaucugauucaaauauguuuuuuucuccuguuucuacaucaaugaguaaauugaaucaucugaguuugacuuuuugcugugacuguugaaauuaguugguuuugcucagaauaauuucuuuacugucauuacuuuuuauaacagggcauuggacaggauuucuuguucuuaaugacuuuucaguaggaccacaagaugagaaagagcuaucuucaccaccuuuaaugauugagcauuuauguuuuuucugugugugaaaucucaaagagagagcaaacaaauguauuugauguaagaauauuucucagaucauacgaaagcuauuuuuaaaaaagaaccuggagccagaaggauaauccaauaacuggguauuuaauaaagcacaaaauaaacguguuagucuagagccaggcugucugaguuugaauucuggcucccuguuuaacuagcugugagacuuuguuccaaccaucaaaacuuuuucuuacuuacuaaccagcugugugacuuuggugugacuuuugucuauugauccuuaugauaacgcagucuucucauuaugaaaauggaaaugguaauacaacuuaacucauugaucuauuauaaaaauuaaauuauugauucacauaaagcauauagaaauaugccuggcaaauaguacgcucuucacagguuggcuauaaauauugcagucauaaacauagaaaucauaucuuaugaagaauaacuaaagcaauuuuauguacaagauaagauuguucugagcaguuauuccaaagggccaagccaaaaaucaacaaauggagguugcaggaccagagacuuaaaugaaaucaauggaaauauucuuuaauaauuagaauuguuauuaacuaugggcucuguacacauugaagacauuuaagaagagaaugcaugauaaauuuucaaagauauuagaaggcauuuauugcuacuaaaugagcauaauaaaugccuuucuguuucuauaaguuuguauuuuuuaaauggagcaaaccuuacuagaauauauguauuaccuggaguuuguguuucucuagaccuaggugcuaucagaccuaacuucugcccacucuaacaaacuuuuaccuccucuugccagauggacagauuuuucuuaacauuuuacaucuaacacugaggaugauacuguaauuacagcaguucucaauauguagucuagaaaaacagauauaggagccuuaugaaauacuucuaauauuucaaacagccuaacagaacaucugcuaugucucacagugacgacgaauagauuaacuguuccauuccuuuguuuuuaauggaauuauguuaauugaacuguauuauuucagguucuugaucauaugaagcucuauuuucauuauuaaaaucaaggaaaaauuaaucauugauuuauacacacaguugaguauuuagaaacucucaaaacgugcaauuauuugguagaaaaauaauuagaauugaaaaaggaucaaguagauugguaaucacccuguauuucuauuaaaacagucaauuaaaugcuagcugcuuuagguguaaaaguaucuuguaguuagaagaauugaggugcagccaggccaugcugauuaauuguucugagauccugaguacauuauauaacaccacuuaauagcaguuacugccuccauaaaaugaagagaaugucugcauuugcuuaucuauucauucauucauauccugucuacuucugugaaagauucgauaaagacuaucaagugaaagguagauuauauuacaagugguauauacucuaaaauugguuuuaccuuaggaaauauuuuuacugcuguaagauacuccaguuccagaaaaauauuuugaacaaaguuacagauuuuuaaauaaauaaauagauauacuuucugugauuauuuggacaugugcauuauuaguagacuuccuccaugcacugguguuucuuaaugcacuaagacauggguuacauccuggcagagauuaaaaaaauaaaacaaaaaaaaaaaaacuucaggcaaauauccuugaugaacaucgaugcgaauauucucaauaaaauacuggcaaacugaaucuagcagcacaucaaaucuuauccaacacaaucaaguuggcuucaucccuaggaugcaagguugguucaauauaugcaauuaauaaaugucauucaucacauaaacauaacuaaauauaaaaacuaugugauuaucucaauagaugcacaaaaggccuuugauaaaauucaaucuucauucauguuaaaaacucucaauaaacuagauguugaaggaacauacuucacaauaauaagagccaucuauaacaaacccacauccuauaucauauagaaugggcaaaagcuggaagcauuucccuuguaagccagaacaaggaugcccucucucaccacuccuauucaacauagcauuggaaguucuguccagaacagucaggcaagguaaagaaauaaagcauauucacauaggaagagaagaaaucaaauuauuuuuguuugcagaugacaugacacuguaucuagaaaaccccaucaucucagcccaaaagcuccauaagcugauaaacaacuucagcaaagucucaggauacaaaaucaaugugaaaacguuucuagcauugcuaugcaccaacaacaggaaacuagagagcagaauuaugaaugaacucccguucacaacugccacaaaaauaguaaaauaccuaggaauacaacuaacaagggaaguaaaggaccucuucaaggagaacuauaaaccacugcucaaaaaaauuagaacacaaacaaguggaaaaacacuucaugcucaugaauaggaagaaucaauaugaaaauguccauacugcccaaaguaauuuauagauucaaugcuauucccauuaaacuaccauuggaaauucuucacagaauuagaaaaaaaaauauuuuaaaauucauauggugccaagaaagagcccaaauagccaagacaaucacaagcaaaaagaacaaugauggaggcaucacaauaccuggcuucaaacuauacuacaaggcuaccauaaccaaaacagcaugguacugguaugagaacagacacagacacauagaccaauggaacauaauagagaacucagaaaugugacugcacaccuacaaccaucugauauucaacaaaccugacaaaaacaagcaauggaggaaagauucccugcuagccauaugcagaaaauugaaaauugaccccuuccuuauaccagauagaaaaauuaacccaagagagauuaaauacuaaaauauaagaccccaaacuauaacagucauagaagaaaaucuaggcaauaccauucaggacauagucaacaggcaaggauuucaugaugaaaacgccaaaaacaauugcaaugaaagcaaaaauugacaaguggaaucuaauuaagcuaaagagcuucugcacagcaaaagaaacuaucaucagagugaacagacaaacuacaaaaugggagaagauuuuugcaaucuauccaucugacaaaggucuaauauacagaggcuacaaggaacuuaaaaaaaauuaaaagaaaaaaaaacaaacaaccccauuaaaaagugggcaaugaacauaaacagauacuucuccagagaagacauacauaugccaacaaacauaugaaaaaaagcuuagcaucacugaucauuaaaaaaacguaaaucaaaaccacaaugagacaccaucucacagcagucagaaugguuacuauuaaaaagucaaaaaacaacagauucuggcaagguuuuggauaaaaaaaggaaugcuuuuacacuguugaugggaauguaaauuaguucaaccguuguggaagacaacgugguguuucuucaaauaccuagaggcagaaauaccauuugacccagcagucccaauaugggguauauaugcaaaggaauauaaaucauucuauuauaaagacacauacauguguauguucauugcagcacuauucacaauaguaacaaagacaugaaaucaaccuaaaugcccaucaaagauagaauagauaaagaaaaugugguguauauaugccauggaauacuauaaaguuauaacaaggaacgagacuauguccuuugcagggacacggauggagcugggggccauuauccuuagcaaacucaugcagcaacagaaaaccaaauaccacauguucucacgcauacgugggagcugaaugaugacaacauauggacacauggcagggaacaacacacacuagugccuguuggagguacagggggauggagagcaucaggaagaauagcugauggaugcugggcuuaauacuuggugauggaaugaucugugcaggaaaccaccauagcauauguuuaccuauguaacaaaacugaauaaccuguacaugucccccugaacuuaaaaguugaaaacaguuuuuuaaaaaagauacauuagaugauaaaauaaugagcauauauagcuauagacaaaauaacguauguaacuauaggcaaaagaaagacuuuagcaaggcaaagcaaucacagauaauccuagcaguuucuuguuauccagauccaggaucaacacaguauggcucuugggcaaaauccuguucaauggcuagauuucuaguguccuuaagcucagaaugcuuuuuauguuucuuaaugguaaaaagaaaaaucaaaagaagaauaaaguuuugucacaugaaagaauuaagugaaauucaaauuuuagcauucauaauaaagcuuuauugaaacacagccacaguuauucauuuacauauuauguaugucuacaauggcgguauugaguugcgacagagauugaccccugaaacuuaaaauaucugcuaucuggcucuuucccaaaaauauuugucccuuagcuagauggcagagaauuaaaucauuuccaguaaagacuaucuuaucacuuauuuccaagucauuaaguaaauaugaccuuggaggugaaacuuaaaagcgaucuauuuaaagaugcauauauaaauaaucuuuuuaaugaucacggaggggagguuugcuuuuuuucugaaaaauaacguuaucuuuucagauauuuaauauguggaagcacuuaacuauaauaguuuuuguuuucuuuuuacuuuagaugaauaguggaaaauaagcaguuuuuuucauugacaaguaaaauuguauauauuuaugguguacagcaugacguuuugauauuuguauacauuguggaacggcuaacucaaacuuuuuaacauauauaguaccucacauacuuauuauuguuuguuuugugugugugugugcaguaagaacacuuacaaucuacucuuuuaucaauuuucaaguacacaauauauuaacuguaguccccgugauguauaaaagaucucuugaacuuauuccucuugucuaacugauauuuugugucguuugaacaacacgucuccaauaucuccaccuccccagccucuggcaacuagcauuuuacucuuucuuuuuguaaguuucacuguguuuugcuuuuuuuuuuuuuuuaaagguguuauugaaaugagucacuguaauacuuuuggcuuaaaacugauuuaacugauuaaugcucuuaaauauuuuuaaauuuuuuaaaauguuuuauaauauacacacguguacaaguagauauauauguguauauguguguguguuuauauauauacacacacauuuauguauauguguguauaaauguguguguauauguguguguguguauauauauauauauauauauauacauuuuguuuucauacgugcacacagaaacaccccagaaagacacugaggcaaacgugagccuaaaacagcaacacaugagcucugguaccauggugcuagugcuugaaugucugcucugcuccugcaguggguacuuguauaaugacaccuugucucaguuccuuaaguuuuaauuuuuuuuuuuuuuuuuuuuuuuuugaggcgaagucucacucuguagcccaggcuggagugcaguggcgcgaucuuggcucgcugcagccuccgccucccgaguucaaaagauucuccuuccucagccucccgcguagcucauauuacaggcuugcgccgccacggccagcuaauuuuuguauuuuuaguagagaugggguuuuaccauguugggcaggcuggucucaaauuccugaccucaggugauccacacaccucggccucccaaagugcugggauuauaggcaugagccaccaggcccagccuuuuuuuguuuuuuuaacuuuuaauuuuaauuaaaauuuauuuaguuuuuuauuguuuguuuguaguuucuucuccucaaaagguggaagacaauaaucauaauaauaaaaaccuaccacauaggguucacuuagagaaugacaugagguuacauagguaaagcgcuuagaacacagucuggcacaucuuaucccucaagaauguuaaucaauaauuauacuuguaguuuuuguuacuguggcauuucaauuccuucaucauccacaagggucuucagauauaagaaaauacauucugcgcccuaucuccuuagcuuaggaaagcaaagugcccaguuuccugaauuucucacucugcaaaaaauaauuauugauguacuaaaauacauggaugguagagaagggaccacagccucaaagauguuucucuuuuuaucagcuuuaccaauacugauugcucucaaaauggcugcuugccaauucuuuguuuuuauuggaaagggguuuuuaagagaagaaaaaggaaaauaacuuugggcauuuucuacuuuccuaggagcuuuauggcaacaguucagguaauggggacuuuucuucuccuaacaaaauggguuuuauacucaucaaaaaacacaaaugacauaauaguaaacuauccaaaaaaucaaguaucaggaaaggguuagaaaagggugaggauauucuaauaaucaaaacccaaaugaauacaaagguaaauuaaaaacaucauuuuggagaaaagagcuuuuuaauuauuauuuguucuguuucuuguuuguuaguuuguuuuuaaaucuaguguuguguuuacggaugucaugguggaucuaucacauuuccccugcuggauuuguuuuuauaccuagugauuaauaauaaaauguaaguaaauugaaaacguauuagauuguggaccacugauaauuauaaggcuucauuuguaaauuuuuuuuucaauaugucagagagguuugcaacacuuguuuauugacaguguuuuaaugacuacauaggguagaacuaguacuuaaauaacagauuugcuguucauguuggcucuacucucucugagcccuucccuuaaucucuuuucugcuguuuuuagaugaaaucuaugcaaaaacaaauuaacauaguaagcuugagacuguuauucuuagaauggacggcuugcaaaguuagcgcuugacuggcauucaguaacuugaaggguaaauaguucccuacacggauauaaaacuuucucuaaaugauaauaggaguccauugugcuuaaacuguuuguaaaaacuaaauaauuuauacugaauaccuggcuuuccuacugaaagacuagaaauguggcauauauuugacagaaggcguuugcugaaccaugauaaaaauccuaaacuucuaaucuugggcaagauuuccuaguagacauuucguacacguugucacaacucauugcuggaggaauuaagugugucccgucugacuccaguagaagaagcuucuuggaagguugcacugaguuuucucuggauguggcuuuucccuuugcugaucuugcuuuguauccuuuugcuguaaucaaucauagccguuaguuuggcuaugugccgaauccugugaguuuuagugaauuacagaaaaugggccagggggaguuugaagaucucaaaagcauaguucaauucaacuuuauugagaauucgaggcagaugaaucccacugaguacagcuguuccaucauuuuagauuaauuuucacauugaaugucuucauuuuaccaccauaaauugggagcauuaugaaauuucccccaaguucuccuugaggauauuaugaaaaaaacuaacaguuacuaaauauuuugagugauucagacauauuaucucauuuaauacucaaaagaauuaacugaggagggucacuucaucucuccagcacgccuaugacaaaaagcucagagacaucacagaaauugaguaacgugauacauuucauagccuuauuaucugaauuuaagauuuaucugacuaaagccuaucuucuuauauuguauaauuuuuccugaaaauuaaaaaagaaaagaucuaccuucugauauauucuagaaauguuugcuauaacuguuuuuaugaauuuaagugcugcugagcaaaauaaaugcuaaguguaaaggaauaccaugccuagaagacucacuuggagacacaaagaggccaaucugcaugacgcagagcauuuggacaaggcuucuggacauuccucucauauguuacugucacuaguuuuccccuuuggggagcagaaaagcagguggcugcuaaaaauuggagcacaaauauccugucuuuauccaugagguacucaagauggaagaguaggaaucaaucauucaucucucuaacccuuuuuuccuugcauacacacuucuaaaacuucugacauuuucuuccauggcuuuuaucugcacuuuuuucuccaauuaaugauaauguuauauccaucaaucauaaaauucuugaggggaagaacuguaauauucauuuucagaaaaauaaauaugaacaaaacagcuaaggaaacaaaaaaaucuacucauagaauugaucgcuacuguaauuauaauacacacuaaauacuuaaaagacagaaaguucaauauguuauuuuacauaugacuauucuuccuucccaagagagaacaaauaaagaaaugaaaauuggaaccauaauaagaaaaguugcacaagagguaaaaagacuggaaagaaaggaauguaaaauaaaaugagaauagagaauccauaugaaaagguggcuaacuacaauaauuaaauaacuagcauuagguacauuuugcaagaggccagaaaauaauuuuaguagugcuguaacaguauuuucuucacagaaaauacagagagcugaagacagaaaaugucuuaaucuugacuuugauuuauauuucaucccuuuuaucuuaugaugcacuacauauaucuccaauaaggcauauuuuaauuaauuuuuugcuaaaguauaaguaaacuagcuucucuuuugaaugggcagacuaucacuacuuuaaaaauuaagcauuugugagccuugugaugguucaggucagcaauuccagcacuuuaggauuccaaggcaggcagauugcuugagccccaggaguucaaaaccagccugggcaauguagaaagaccuugucucuaccaaaaucaauaaauuaguuaauuuaaaaauauaaaaauaaaacagcauugguauuaguggauauuuuguguugugugcuauaaggcaauuuacucuuacaaauugucaugcuuugagcauuugauagagaguuuuucaaauagagaugaaaaaugucaagugggaaaaaaaaaguggucuuccagauaacacauggaauuuuuuucagcuauggaaaugacaaaauagcauaaguaacuuauuugaagguagaaaauaaagaccacacacagaauuaugacuuaaauggcuaacauauauauauauacauauauauacacauacauauauguauauauauucuuauguauauauucuuauauauguauucuuacauaagaauaagaagauacauguauaagaauauuuauugcaauguuuucuguaauaaacaucauauaaaguaaccuccauagguacaauguacacuacucaggugacaggugcacuaaaaucucagaauucacaaccauauaauucaugcauguaaaaaaaaacauuuguaucccaaaagcuauugagauaagaauuaauuuuaaaaaauaauaaauaauacaguugaugugaaaauacuaaaaaaaaauuacccauauggaaaugaugcacugguaucacuuuuguugaauagaaugcaguagacuucugugugcuaauauaaaaagaucuuaaaguuguacucuucagugaaacaagcaucuauaauauauagaaaaguccaauguguaaaaaaaaucugucuauauuuguuuauauauaaauucauguauaugaguauauaauugggaaauuuguaagauacaaagguaauuaaugauuuaguuacuucugugaaagagccuaagucccuggaguagaaagaagacucaguauauguuaucuuauauaugucuaugauaucuucuaugguucuagcauauucacuuucaucuauauuguaauaaauguggauuugacuuuuaauacaucuagauauuggcaauauucugaaaacugcuuauuaauugauaauuauaaauauuuagaucauuaacuuuaaaugaaaaaauauguagaugucuaauaguucaaugacuauuuaaacauuuaaaagauuauuuucugaauuacauuugcaccugcauuuucuaccuguuguaaaacucaauuuuaauuugaaaucaaucacauuuuccauaaaaccuucuguguauauacacauuaauauuauucuaacuaaucauuauaacuaguaauagauuagaaguuaguuaagcaagagccagggacauuuguuuauguuuuucacaacuagcauuaugcuucauuauuucuguaugcauuuaaauaaaacaauugauagccaacuugaugcuauaguaauaguucaaucuaauucuaugucaauaccaugguauacauacuuguuaagagagaaauauggucaauuucaaaauaaauuccauuauaugguuucaucauuuuaagaggagauguaacagaugacaaaucuuacaguauuucuauaaacucacaaauuuuuagcucaguuguacucuucuugacaucauaccuuuuuucacucuauaccugugauuguccuuucacuucaaaguucauuuuuccuaauaaaucccucauauaaaugccgaaaaucuuugcauaguaaaguggauauguuaucauaaacagcuaaaaugugacuaucagggcauucugaacaguccaaugugaaagcuugcauaacuuuuguuucuuucuucauucauuaauccccaaagauagaucugagugccuacaaauugcuacuaacaucacuugaucaauaaugaaacaaugaaaauguuacaauuccuacauuaaugaugugucuuauauaacucaauggaauuauuguaauaucaugaauacauuacauacuuuucaagccucaguaaaaugaaucagacagcuuuagcaucucucuaucaauacaaacauuuaauggaaaaauagacacccaccuacaaggacuguuguagagaagacuuuaguuuggggugagacaguggacaacaaagaccauaucuaacugucuucuugcagguguacugccauaccuaguuuauugcccacacauuaauauugccagaaaacuuauuagaaauauuuucaucucaauaauagaaucuuaaaacuuagauugaaaaauguuaaaaaugcgaauucacuauugcaccugucuccaaugaucugguaaauaugggcaagacucaaggaauaagauauuuuagaucaggcagugacgggggagacagagacuuuguucauuaacagaaacccuugcaaaaagaaaucaggucauuuuaagucaaagaauaaguuuauucaagacucucaagcuugaaggugagauuccaauagaugagcucuagucaaauugccuggguuuuuuaaccaauucaaaguuaccuguguaaguuaaaaucagcacauggaguaaaguacugacaacugcuucauuuuccuuuucuccaugucuacaaauauuucucagaugccucugggcuacaggaaucucugaaaaaguuauucaacagagcuccguuucuucucuuccuagaggguggcccaaagggaaaacaguucugucaauaaaguauuuccuuuuuuuauauggaaagacuuuugcaggccuuaucuguauacaggguauaaaaaguucucuauauuauuuucuuaaauccaucuaauguuuugacaauaccaugacaauguuuacauucagauuuccagagauaccauaguaguuaggggcauaaaauauguagacuucagucaucuuucaaagaaguucaguguucaaaauaacugugggcaaccugguggcaggaauguaaacacugcaauauuugugucuuuuggauagaagccguauuaacaggggugagaugauaccuguuuuuaauuuugauuugcauuuuucugaugaagaauguuguuaagcaccuuuucauaucuuugccauuuguaggucuucuuuugaaaaaugucuauucaacucuugcccauuuacuauugaauuuuuuuaauuaaagaauauaaaaagaagauauuucuggucacuuuuauuguucucugauaauaauuggaauuaaaauggccaauccacauagguaugaaaucuuuguuaguucccucaggcuuccauaaagaaguaccacaaacuggguggcuuacacaagaaaaauuuauuguccuacauuccaaaggugauaugguuuggcuguguccccacccaaaucucaucuugaaauuguagcucccauaauucccaaguguugugggagggaccuggugggagauaauugaaugaugagggcaguuucccccauacuguucucaugguaguuaauaagucuuagaagaucugauggauuuauaagagguuucuccuuuuguuuagcuuucauuagcucuuguuugcuggcauguaagaugugacuuucaccuucuaccaugauugugaggccuuccuagccauguggaacccugaguccaccgaaccucuuuuucuuuauaaaaaaaucauuuucuuuauagaaaaauaaaggcauaccccaaucucagguaugacuuuaucagcagugugaaaauggacaaauacaaaaggcuagaagugcaaaauuaaggcgucaacaaggcugguuccuuugacuacagugaaggagaauauuucuaugccucucuucuaaugucugguaguuauaggccuugcuuggcuuguagauggccaucuugucccugucuucacuucgucuuccuucugugcaugucagccucugugucauuaggauuaacccuaaugaccucaucucaaauugaucauuuguaaagacuuuguacuucaacuucuuucaggaggacacaauucaaaucauaacaauauuuugcagaggauaugauaguauuuuauauaacauugguuuccugggguuacaggugagagaaagaauguaccaaagaaggauuucccuguauauauuuuagaguauuugaguaguuaauaaugagaaaauaaauacgcauuauguaccaauuuaagaaaauuaaccagccaaaaaguugcagaacuuuguauuuucucuuuuaaaaacuauuuagaaaauauauagaaaaagguaaagccaacaguugauaguaauucccucuggggaaacuuugcaaaagaaguacagagagauuucaucuuuuauucauuuuucuaccuuuucuauuuaaaaauauuaaucauuuaauuucauaauuuaaaaauuaucuuagagauccucacugggguuauuuaagggaggucaaguaggugcugggaugugcccugacacuuaauuuguggccgagugaaacagaguuaugcaagucagagcaacuagagagaacuccaggcugagaccauucacgcacacagaacucagggcuuuggccccuagcugaaaacugugaugaguuucaucaccauuuaaaacagguaagucacaucuucuucuucucuuucacagaugaggaagacuaagaaguuaaaugacagugaaaaaugggaccaaauggucaauccagcuguccauguguuugugugauuucacauggucuguuucucuaacucauucucuuguuugugccuuuuuuauaucccccaacuggaagguaagcacuucaagaacaguguaucugguaaaccauggcaccugacagccuaguguggcauuuggugccucauacacacucaacauauauauguuaaaugaaugaauaagugaaaacuuucuggugaagauguuuaugauuuaugugaugacaauagccugguaccuaauuaauaacuacauaguauauguaaguauauauaauuuuauauacuaaaucaccuguugaaacuacuuucaaacuccagaucuuauuauuuuagccaaucaugaauuuugaacacauaccuuuuaugccaacaccaaaaacacagaaaauuuuaaaacuaugaaguuaguaaaagagagaugauuaaaaacuaucacagauuaucuugcuaauagccacaaaaaaagaagaagaagaagauaacuccaaugguaaguaaacagucuauauuugacuucagaccaagaucuaaaguugucuucauguuuaacuugggucugcuuuagaauuccaauuuaaucacaaauaguggcauaaacaugcugccuuugagagcucuucuuaccagagagguacuuagcaugcaaaucuaugacauaaauuuaguuuacaaauggcaugcaacaaagauugcugcuacaucucauucucuagucacaauagaugugaaaaagauaacuaguuagugaaauaacuauaauucaaguagaaaacugacauaaagucucauaagcuuugccaaguagcuuuacuuuugacaguacagagcucuuuauacagauauaucuuuugguucagugacaguuuuacuagaauaaaggauggacaagaauuaaagugccuuaggguaguuaacuauguacagacauaguuaagaauucuuucucuucugcuguccccuaauuucuaucaaaugucaaaccuauuguauacauggagagugaguccacagcauaauauuuuaggauacaauccaaguuguccucacuuagaauuucuaaaaucaggcgauagaaggucacauaauauuuaagaaaucaucagucuucuugcuuggggaauuuuuugaguugcacauuauuguauuguauuuuuagugcauagaugcuaugcauuuuaaaaagauggcgaaauuggguaauugauucaucuuugcauucacaccaaauauaagugguaaaugaaaugugaucagaacuuaaaguagaugauacuugaaaugcacuagaaagauagucauuuccagauaaaagaacucugauaagcagaguuaaccacaauuagccaccagaggaaaaccacagagcuccaagaaguccuuuugccucuguaugauuuuauggcuuuaaauggaaggguuagaaaggucuuucuuuagauaauaagcugcauauuuuuaaaaaauuaaauuagaaauaaaaugugcaugugccaggugugguggcaagccccucuaguugcagcuacucaggaggcugagagaaggauugcuugggccugggagcuccugguuauaaugugccaugcugaucacaugucugcacuauuuggcaucaauguggugaccucucaggagcuguguguaaugugguugcaaacgagaggcaaacugacccaggucggaaauggagcaggucaaaauguggauguacguccuuaacauuuauauucuuagcauuuuauauuauauauauagguauauauauagguauauauguauauauauguguguauauauauuuaacauuuaguguugacaauacaauaacauuaacaaauuuugaaaacuugggcugugcugucagaucaacucaucuuuuuucauuuuauauguaaugaaauaaaggccaguuggaaucuuauauauaaaaaguuaugaaauuauccauuuucaugcaauaauaaauagaaauguaaggaauauucuuccaugauuacuuuguaauuaacucaaauauuuuuuaugugacuuugaauauauauccuuuaauuuauaaacuaucacaaaauguguacucuuuaaaauacaauuggauaaagagagccuuggaauuaugaaauuauuuauugaugugaaugaacagacauuguuaucaacugaaagaccauuuauauugacuuccuaagaaaugaaaacaauuugauuuuauaguuguagaauuuucccucauuuuacauauauaaauaucacuuguaauuuuuuaaauuuaucgaaaauaccaggaaaacuggcauuaaaauaaggaauagcaugacuuugauugguugcaaauuuuuuuuaaauuuuuuuaaacuuauaaggaagauaagauguagagauuuuccuaugauucaaaaguggagugucuuaauuacagguuucuuaaacuaugugggucaaauauaauagauacaucuaauggaaaucagaaugaguugcauuaugcuaacaguuaaaauuuucaaagaguucauuaagcauuacacuuaauuuuucuuuuggcaauaaaagccaauacagugucauuuuacuagcuguacuauuuuuguaaauacacauaaagauuuuuuugaaguaaauuauuuugaaguaaaaacacaauguguuugaaauuaauuccuaauauuguaacacaaccuagcuuaaucaaaacgaguacauuuuaaaguuggcaauaacagaaaaacacaaauaaaaaguauucauuuuaaaauucacuacucuucuuccuccaggaaggugaucauuguguguauguguguguguauguguguguggugugguauguguguguguguuucucccugaugcagagugcucaccauggcaguuacuuucuucauggacuguggugcuuugcuccuuaugaauugaagcugucaauugugauuuuuccaguugaagcacuguuacaagcuaacuugcuucacuaggcacacaaaacuuggaauauuaaccgauggcauucugcccuucgcugccaaggcuuccuaaguuacuuuuuacaaguauuagucauuauagaauacuuugaaauauuugcaaauaacacuccuuuuuuuccacccuauuccccccaaaagagacuguacuuauuuuauucucuuucaaauaguauuuagcagcagaauaaaggcuuuuaaaugcacgccucuaugccaaaaggggaccuuucucucaagccuguuauuccacucccagauacuuggcaaguguuuucuaguuuuuguuguggaaaacaucaugggugcauaccaggcauaagcaagcucaucagagagaccaccuacuuccaaacccagcauuuuugccacaauaccccacaacugacccccaaccuagucuuuuuccaaaccccuucagucaccccuuauagaucuauaggaguaggaacucgaaauaacaauaggaucaggccagaaaacaaaugagugaagcucagggauaacacaguaggcagcugccaggacuauggagaaauagucuccccugacucaggguauuagcaacuaucaccuuccagaugacggcugcugcuggggaaggcagcaggucuagucuugcaagaccuucagauuucucaagagaagcuacaagcucuggauacucauggggcacuucucaacuucuaaaagcagaaacacagcaaaauguaauuuaaaacaauccuaugugggcuaagcaaaacauguaucuguaaucucgauuugaucagcaaaaucgcagaguugacaccacccuuuucuuccaacucuuuaagcagcuagaacacugcuucauauuuaguugauaaccacuaagaaucacgaauaaauuuacaaaaacuauacaugcauguaaauauaugcauauaaaauagaaacguguguauauacacauagaugcauagguuugcccuugugcuucaaaccuggcuguuuauagaaacauaagacaggcaaguuuuaugguuaacauaguucacauguccagcuuuucucugaagaaauaauuaaguuuucuuguaucaauuuuuaacaacuugacaaacuguaaaggaggcuacaaaauaccuggucuauaaggucguuaauacucuaauucuuccacuaaugcugagaggaguggaugaacacagcuucaccaggcaugaucuuauaagcucaacuuuuaaaaaagaaaaaaaagaaaagaaaaauauagguaaaaagugcuuuccuuuuaaaggcuuauuuugaaagucccccuucucucugccccacucgggaaaauuaugaguguaauucauuugaguaguugaaaucucacaugcaguacaaaugcagaaaaguaugagaaggaggagcaggagaaagagagaaacaggaagagagagauaaggaagaagaagaacaaguaaaaggaagaaaaggagaacgaggaagaugaggcagaggaagaaaaauuaaaaugugaugaaaucagaucagauguguaacuguuuugagacugaagcuauuuucaaccugcccagaugaucucgagcuuuguuuauauuguucuuugucugcaaauagaaaauaaccuauuuccagcuauguauaguguuuccuuacucagcuuuuuacuuuguuuugcucaaaaacaccgaaacuccuguauuuccuuuuugggaucuugggacuugcagaagagcaccuccacagcaaguugcaaguggaagguccaaccugaagccgugaaauaagauccaaacaggauugagaaaguggcccucacgacaugcagacccucuucucucaugaggcuggaccaugccuuuugaucauuuucuuuccugcaucuuucucauguguuaagcaccaagcucagcuagucaagugcuuuuucauuuaaaauacuagagaagucucaugucuuuaccauuauguggcugcauuuugcugcuuuuucauuacuuacaguaacaauuguuuuguuuuuugcucugcaacgcaguuuguguaacuguaauagccugauucaccgacaaucagccacauuuuguggucuacucuaacugaggggggucuucauuuucauacgauuggaauuuaaaagucuaucugaugagguauaaaaaaauguauccauuuucaugaggcacagauaaaagggaagcagucaucccaggauuuuagguuuacucugugacuaaacugaaacccuucauauuaaagcuuucaaauuuuacaguaauguuugaggagccacagaaaauuugccagcuuucuaaacugccaaacucuacuucuauguccguugaauguaacuagugaauuaauucgaagcaagauaucacagcgacuuacagcuccgccucauagauaaggcaccacaacuuuaauaugcaccgaaaagaaauugcugcaguaacuuuaaacuucccuaccaggcaucuuuagcacuauggaggcaagaaugcuacauaaaucucacaagugguagaaugaauacauggccugaguagauauuauucacaguggaaaggcagucacauaugugcccugaagaaacaucagcuaagucuuguucuggauucucugaccugauuugacuaaauuaauucaaacaaggaauuucuuucccugagacucuucucuugucucuagccccaaauuaauaagaagaauaacaaagcacauccacaaaccaaaucuuucuuuuauuggaaacaucuuugcagacauuuauacacaagcauuuugucugauuuacagauaagagcauugcggcugugaagcguguagugacuuuguuacuuguuuggccacgucccuggcuccugguuaacaggagccgaccugcagggcuccagggggaagguggcugcuuuguucuauucucauacaaacauuucaaaauaacaauguuggccgggcgcgguggcucacuccuguaaucccagcacuuugggaggccaaggugaguggaucacuggaggucaagagaucaagaccagccugaucaacauggugaaaccucaucccuacucaaaauagaguagcagggugugguaaugcaugccucuaaucccagcuacucgggagguugaggcaggagaaucacuugaaccagggaggcggauguuguagugagcugagaucaugccauugcacuccauccugggcaacagagagagacucuaucucaaauaaaauaaauaaauaaauaaauaaguaaauaaauaaaauaaaauaaaauaaaaauaacaauguugaucauguuucaaauacaguacaaaaugccaugccaaucucuuuaaaacugacuuuauauuauaccacccuuuauauguggcaauuuguaacuucuaaugguugugaaucuacacacaacacgguuggaacuauuauaaccguuuuaauaaaaauuaauaauuuuuaaaugccugauaaaauuauacauauuuauggcguacaauaugauguuuugauauauguguagacuguggaauggcuacaucaaguuaauuaacaaauguuaauuaacauuaccucaccuucuuaccauauuuucuuguggugagaacauuuaaaaucuacucuauuagccgggcacaggggcucucaccuguaaucccagcucuuugggaggccgaggcuggcagaucacaaggucaggaguucgagaccaaccugaccaacauggugaaaccccgucucuacuaaaaacacaaaaauuagucaggagugguggcugcaugccuguaaucccagcuacucaggaggcugaagcaggagaaucgcuugaacccgggaggcagaaguuguagugagccaagaucgugccucugcacugcagccugggcaacggagcaagacuccaucucaaaaaaaaaaaaaaaaaucuacucuauucacaguuuucaaguauauaguauauuguuauuaacuauagucacugugauguauaauaaaugucuugaacuuauuuccagguucauugcauuuuucacaauagccuagauauagaaucacccuaagugucuuucagcagaugaauggagaaagagaauuugguauuuauaccauggaauagucuucagccuuaaaagaaggaaauccugucauuugcaaacacguggauaaaccugaaggacauuauguugugugaaguaagccaggcacagaaagacaaacaccacacuaucucacuuaucuauggaaucggaaaaaguugaacucagagaagcagaggcuagaauggugguuuuuuggagcuggggaguggagggauuggggagauguuggucaaggaaacaaaauuucacaaagauaaaaauuaguaucuuaugagaauacaugggcacauagaaggguccaacacacacucaagucuaucagaggguagaggguagaaggaaagacaggaucaggaaaaauaacuguuaccaggcuuaauaccuaggugaugaaauagucuguacaacaaacucccaugacacaaguuuaccuauauaacaagccugcacgucucccccugaauuuaaaauaaaagucaaaaaaaugauaucuauagauaaagugccccuuaagaguuccaauaauauccauuuaauugauauuagugauuacugcuguuugcuuauguuucuguagggcagaagucagcaaauauuuucuguaaauagcaagauaguaaauauuuuaaacuuuguggccauagagguucugucauaacuacucaguuuuucccauguagcaugaaagcagccagagacaaggguacacaauuggguauggcuggguuccaauaaaacuuuauuuacaaaaauaaaagguugaaagaauuuagcucacaggcagucauuugcccaagcuugcucuagggaauggcauucgugaugagacaucaacaucacuccgaauauuagcaucaaaauaaauacgggaaaguccagaguagagacaagagagaacagugagaggaguuggaauagauacuuuacugcaaauauaccagguccuugauuguuagguucuguccagccccaacuuucucacuuaagggguguucuaaguaaucauuacagagcacaggcgacacacagaaagaccaagucagaaggaccuugaaagucauugcauccaccccacugcccugcuuucauacuacugagaccuugaagugguaaaugucaaggauguaaagaauuuggaacuguaauuucuggugcauuacuauuucuucucuaucacccugacccaggugguuuucgaagagugguuuuuguaaagguuuuuggcuuuguauuaggaauaaaaaaucuuaguggaaggguagaaagccuuuggggaggaggaugcagugauuaaucuugaauauaagcaugauuuuacccuugggaaggugagaaaauuagaaaagcuaacaaauuuaacauauaaauauucucaucaugacccaguuuuugugauagauguuuuagauaucauuuauuuaucauauugacauaucugauauuuaaaggacaagauguucaaaaauucuaauugguugaauguuuucugcuuuacuucuugaauuauguaaucacuuauucauccugugcuauauggauaaacauuuccaacuaauaaacauuucuaauguaucuuuaaaacuaaaaaauuacuuaauugcuacuaaaacucuauuuaaaauuuguuuucuuuuuaagcgauuggcuaguuuuuaggugauuucaagugauuuguuuuaagcaaugguuuuuaaaucauaaauuauaaaaggugucaucuuauuagccucgcaaaaugacuuauaccuuuagauauuuaauacuguauugauuuuucuggagaagaaacacugacucaaaauuaaaaugacgucuugaaugacuucauggaauuuauuuacauuccccaaguagaguugugaugcacaacauaauuuauuuaucauggguaagaaaauauagaguaaaauacaaaaauaaauuaaacaccuaccauauucuaaguuguaggaucguugcaaggauuagaugagauuauuauauauauagucaucauugugucuauucuccagaugagaaggcuggguucugaagcuaaagugaccaaugaaggcaugugaauucgguguggauuugauuccaggcccacaugagugcaaggacccucucuuuucuugauucuuuuuuuuuuaauaucuguguauuauuucaaauaucuacauagaugcuuccaugcuuauuaaguaguuuuuaccuaauauuuauuuuuuauuauacuugaaguucuaggguacaugugcacaacgugcagguuuguuacauauguauucaugugccauguuggugugcugcacccauuaacucgucauuuacauuagguauaucuccuaaugcuaucccuccccccuccccccaccccaugacaggcccuggugugugauguuccccuuccuguauccaaguguucucauuguucaauugccaccuaugagugagaacaugcaguguuugguuuuuuguccuuggcgacaguuugcugagaaugaugguuuccagcuucauccaugucccuacaaaggacuauuaguuguucaccuucgaggaaauugccaagauuuuaaauuugccuuaagaauuuaaagaggucucugaggcagucccuucugugcuaaagaauguauaagugcugcuuguuguguacauuuuuugcaaccaguuuauuuuacuaaaucauccuuaacucaaggaaaaaaaguccuauuuuuauuaaaguauucuguuaauagucucuauaaagugcaaugaauugcuuauuuuuaaugguuaauuuugcuugaagcaauuaauaugguucaacuuuuuauucaucuauuuuagaagauuugugugacuuuuuuccagauacgguugaccuuugaacaaaauggggauugugguucugacuccccauacaguugaaaaucugaauguaacuuuugacucucccaaaacuuaacuacuaauagccuacuguuggucagaagccuuguugauaauagucuguuaacauuuuuuuauuuuauaaguaugagguacugcauuauuacaauaacauaagcuaaaacaaagaaaauauuauuaagaaaauaagaaaaaaauauuuuauauucauuaagugaaaguggaucaucauaaaggucuucauccuugucaucuucacauuaaguagacugggcaggaguggaaagaggagggcuuggucuugcugucucagugguggcagacguagaagaagauccacauuacagugaaccgugcaguucauagccagguuguucaagagucaacuguauauucaauguucauugaccaugugaagucacacauuucugagcuucuggggaaauggcaguagaugauuaggaggcaaaugaaguuucugcguugaugacuaucccagaaguuuccuggaagagguugucuauguugguuuucucuacaguucucuccucaaucaaagcuugcguagccguggcacaccaaaaugauugcacaagauuguaacucacauuauaaacaguaauacacuauaacagugaauuuaauguguccagucuuaagauauuuauauuuugaguugguaaaaucguacauuucaugagacuugaauguuugcucaauauggaaccacaguaguaacagcaugacaccaccuaccaaauuauguaaugaugauucucacuauacuuaucuccauauuuuuaauuacuucaccauauuuaacugaucaugcuuuuuccacaagacacaaaacaacuagaaauuaaguauaaauaccaauuauuuugguauuccuggaaauaauaaaguuauucauguuguccugacucuuuguaacgaaaaccuuagacaaaauuagaaaagcacaguuuuauucugugucuacuguugcuucuuucuauagccuucuucacauuacugauguccucugccgucaaguacccaaggcacuauuuuagcacccaauacaggcaugcuauugaucaaaacucucauccuauaauuuagaccauguuuacuuagaaagugaucuaugaaaauaaggacuaacuuuguaacagcuuuuuucaaacacuucugacauaaaugaugcauugaaaaacacacacuagaaugaugagagccuguggaagaugccuucaccuggcugcuuuccauauucuaugcauguguagccaugacccuucagaucuaaggaugauagcccugaaccauuagagcagcugcucugguuuuucagauaccuuacucugauacaaaagguucugcgagguugacucaagguaguccccagaggaggagguguaguccccucugugugaugccagguucagcccaagccugaaaccccuuuguccuccuggcuguucuccuccaccuccucuucugacugagucuuugacugggugcuucaacgauuaagccuugccaauaucucagcuuuucugcaugucagccucucaagaucucagcuccuuauucuacgugcuuugauuuauuguuuuaauaaaccacaccaggaagaaagaaaaguccaguucuguaacuguccuagaaagaaauauauugcaucauguucaaaaauccucaaccaugucugaagagaagcaguucacaugccuuuuaaaaucauugguuuaucauuaaaugugcauguauguuuuuaaaaccuaaggaggacgaugcaauacaacauuuuguuaaaaaauagaauuuguggauucugauuuuaaaagauauuugcuaaacagugcccuguccuaaggucaccacugcauauuuaugaagagucaggagauuuaaauauaggcuauagagaugaaagacagagagagaacuuucaagcauaucuuaauuaggaagcauuuuucuauuagcauauaacuaaacauccacuuagcucugaaccucugguccucacuuugacaauuagugcugucauucucagugacaggaauugugauuugcucauuuaaauuuacuuuaaaauaucuaguggguugaucacuguuuucagucaaugguuccucacagaaacugucaaauacuccuccaacuacucacucaugcuuuaaauauuauuugcucccaguugucaucgugacaaaagaagguuauuugaggauuucuuacauaagucugauuguacuggccccauucuguccuaaaaagguuaaacuuuuuuuuaacacaguagguguaaauaugauuuguauaucuuauagcuaaauguuaaaaugauuuuggugaaggaaucagauuaaaauccuuguagaaaccuguccugauaauucugaauauuugcuucaaacacaaacuaaaaaucugauuuuuccgaguaucaaaaaauucacuagccaguuuaauuugucuuaccuguuacguauuuguuuucuuaaucauguucucucuguacguauaauucuagaaauucagagagaaauaauaccuacguguaauauuaguuaucuuuaaauucaauggcccuuauauaucucagaaaaauuuauuuucagaucacaucaaaugaaagugugaugacaggcuauaucuaccagaaaacuuaaaaugaauuuauuauugcauaacaugcauucauuuaacaaacuuuuguuagguaucaacguugcugagcaaagcaggcaagauucuagcccuuauggaacuuacaguuucauaauguaaggauucuuucagucaggguuguuauccuugccagugagagagacccaagucaacaaacuuaaaaaugaaaguaggaugcuuauugacuuacaacccaaauuaccaucaggacagggcugcagguagcuucagggacaacaacaaggcucauuagagcaucuccacuucucuuaucuccaacuuugcauuuauccuugucagcuucgugcaccagaugggaaauauauuuccuuuuuacuuccaauuccaaauaucuugagggaagucucugcuggcuaaaauuugaucaugugccaagcccugugcucagaggccaguaacucuguacuuagaaagacauaucaccuaaucauugauaaauaugucauuacaaauaugauaauguacagggcauccugaacgcuacaguagaagaccggaacuaauguggaacggaggggaagacugcucaaaggaaaugaaguuugaguugacaugugaaggaugaauaaaaauuagcuaaguagagaaguuugggaggcuuugaagcccaaggccaacuccagcagaaggacgaggagggaagaagcauggcaagugggcuggagugaugcaaaggagaagggaggggcaaggaagggauggcugagcaguaaagaugaggcuccacaggcguucagguuccagauccugcaggccuuuguaguuacuccagaaugguuuuuauucucagaccaauggauaacuuauuguggcaaguugauuugcacuucaaaaugaucacccugacugauaauuugaaauuggauuggaggaggaaaaaaaugagauggagaaaucaguuaggaaguuauuacaguagucuaagggagaaacuaagcuugaacuggggagaaagcauuaaggauguugcugcggaugcugcaccugcuaaaacgcacaagugaaaaggauguguacagauuucuccauuccaccccaggccaugguuugcggcccaaccaugcaggguaaccuggaugugcccaucugcuacuggcuucucugcguccccaucugcuucagcauaacucacuccacaacuacuuguaaaacacugaugcagaaaagagugagaaagaaagaguucuucagugaauauucaucuuuucaucuucuuauuuccaagucacuaaaaccaagaggccaaguucuuuguuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucgccguuuuagccgggauggucucgaucuccugaccucgugauccgcccgccucggccucccaaagugucuuuguuuuuuaaguccaaguucugacugaaucucaguacaccgaaacuggaaauucaugacuaucccagugaagacagugcuagucucuguucuagaccuauguuuggagagguuuuuaauauuuuguuuuguccaauaguguuauacauuauuguuguuuauuaaguagagcuuaagcuagauuuaaacuaucucauuugggcucuuauuaugugaagguuuguguugcuguuguuguuauugucauuuuaagguaacauuuguuuuccaaaauauacuuuauuagggcuaaaggcaauauuucagcucauuauugaucaacuuuuccccccaaaaguaaauguauuaauuagaaacugaucaaaaauaaaaauggcgaauucacauuaucucaaauaguguguuucauaguuuuauuacaaacgaacaaaaucgcagcagaaaagaaauuuaaaccuaauauuauacaaauucuauacauuauuaacaagucucauaauuguaauaaaauaaaaggaagccacccauucaucaaaugacccaaacuuuguuagucuaaguuauaauuaugucauccgaauaugauagcaagugacuauugauaauuacuggauuaucacccaagucauuucauggauauuauuuuaugaauuucauaauuaguaacacugagaagauuauaguuuuugaaaaaguauauaauuaaaaauugaugugaauuggcuaaccucuauagccacacccuuaccaaaaauuaugaaaugcauauagagugaauaugacaaguuugaguaucaauuagaauucauuaaaaucucaacauuuuguaugaauaacuuccauaagacauacaaauauauauaagugagugugugacuaggucauuaauuucaauguauaguguaacaaauaauaaauaauuacuuuaauacuucaaauaaggcaaaaguauaaaaaugcaauuaugcaaguguaaacuauaauuaugcaauccagagccgcauuugauuaaguuauucaaagucaaaaauucaaccggaagauucauaucuauaaaaacuucacugaaauuuauuauuaaaucugccaaaguuuuaaguaaaacuuuuugauguagucaccaagucuaauuauuuuaccacuuacauuuauuucucuuauuuuuguguuuauauaggcuaauaaauagaaaccuaguuauaucuaaggaacuuuuucaaauucugcaaaaacaauuccaauaucucacaguauacuguacuuaaagacuuaucacuuuguguuauaauuauuugcuuacuuccuuuuuggcagguagauauaauuagaguguuacuguaaauaauuucuuuuguaacauaaguucgucuguagcaugauuaagcuauccuuaugguuuuacauuuuauuuuagaacaauaaaaagaacaauggcuauugaugacucuggauagaaccuacuguguuucuggucccugaaccaagcaggagagauugucucugaucucuuuuguauugagaaaaauauagacuuaaaaauugacaugcaaaguguagauaguacuuuagcucaaauacauagaaaacagcugaagcacagguuaagaauucacacguugauggugcucuacaaaacacaguaucaauaaaauaguugguaauuugaagguuuauugcagauauuaacagcaugaaaugaacgcacacucaucuauuaagaauauaagugguacaguugcgcaauguaaauuguauaaaagaucauuauauaugaacauacuuauggaagaccuucaacuucugaggaaaauucaucucuacauauaauacuuauaaaaguuauauuuauuucaugcccuuaguugaaaauaaaacacauuuucaaauuuuacauuuuaugcuuuuuacauuauagcuauaaauaugagaaauauauuucuuaaauaccaacuuuacacugugaccaaucaggauaugaaauuucuuuugcauaaaacagacuggagauguuacuuggcagugauaaaauaaaguuuuguuguaggagauuuguaagaaaaauagcuaauaaauuacacuguuuugucuagauugcuuuucacugaguagaaauucacauccacuuaaaggagagaacgcaucuugcaaaauuucauggaaugaaaaugaagccaaaggaaaaugcaaaacacacgaggcagauguaaauuauucaccaggauaagcaaaauauccucagagccuauuaaucagaaaguaaaccauaaagauacucuuugaacacacaauuuauauaugugaaaaauaagcaugugcuacucuacaaaaucaacuacaguacaaguguuccaaggaacagauugaugggguaucaaauaaaugucaaaucacaaaauauuaugccggggaaaaaaugagggaacauagaagccuccucucugucaaguucauugaccugcccuagcugccuuuguucuuuuccauuucucccuaaucuacuuauuuuuuauuuuuuauuuuuuucucugccaccagcuccguuacuugccuagucucuggccauaucgacugaaaaaugagaugcugauuuuuagccucuguaggcccuacugucuuggaaauaaauacaauccucagcccuuuuauucuacaaagugauuucuagcuguuagcugagcggcagggagaauguauagaaaacauuaggaaaguuauauagacucaagaaaacuacaaaguaguauuuuuuguaguccuaggugugcaaugaaauuuaaauagugcuguuuuguucuucaucuauagcccuuuucguaacuucuuaaauguguucuggaagacuuucugguuugcuuguuagucauuacaaucaaacaauaccaagucacuaaaauuaugacauagauugggugaguuuggguuugccacagguuccaaaaaagauucucaguuuuuaauaaucugcacgucaucuucuguaaagggagaauuuccuuauuaauccaagaauuaucaggucauuccugcaaaguuauucagaugccugugcccaaagguuccaaggcugucagccucugcaacuccuuauuuaacauuaacucauuuuucagugucccacuaagguuucccagagcacaaucaacaacuaauaguuaaaaagcugauucuaugcacacaugauguucacauuguuaacuuaucauucaaagcuaguuaugucaugggccuaaagaaaacaaccccaaacuuucacucaguaugucuuaugcagacuuuuacucacuauucucagcaguucugcaaaaauagaaaucuccuuuccaaagaucacagccuguuccuucucucacuaacuuucacugucuaguuaugugacagccuuacuucucaauuauuuugcuuauaagagauaacuaaaacaacuugaaugugaugacuauccaugcuuucuuuuccaucaaguccucaugccugucuaguuacuccaccuggauauauuuuacuauagcagaaacaaagucgagaacaauaccuaccagggaagaaaaugguaauucaaagaaguuuugcugucucccagccuccuuuuuuucauauuuuuuuuuuuuacuagaauagcuuucuccaguuaacucauugcacaaauucgggauuuuacuucuagaaguuuccaugaauaguuaagagucacucauagcaugauggaacaguucagacugaggaaauuguugguucgcuaugguaggaggcagggauggagggagggagggagguuugccucaggaaccauaccuagcccagggaagguaaaaaggcaagaggguucucuuaccaaaacuggacuuuuucuucuagacuuucccagaacugcaguuaaccaccuaguucaguuuucccagaaagacaccauaaguguuauaauuauuauacuaacagaauuaguauaauaauugugggaucaucccaaaauaagcaacaagcaaauuuauuucucuucuuaguuaaggaaacugaaguagaaauaauaaaauuaagaggaaaacaagaguugcaagaauguggcaagggcgguggggagcccuguacacuguuaauaggaauauaaauuacuacagccuuuacaguaaacaauauggagucauaaaaaauuaaaaauagaacuaccauaugguacagcaaucacacuucuggguauauagucaaagaaacugacaucaguauguugaagcuauaucugcacccccauguucaucagcauauuuaaaacaggcaacuuuuagaauuaaccuaaguguccaucaacaaauaaacagauggagaaaaugugguauauauacacaguggaauaaucuucagacuuaaaaagaaguaaauuaugucaucugcaaauacaucgaugaagcuggagaucaucauguuaggugaaauaaguccggcacagaaagacaaauacagcaugaucucauguauaaauggagucauaaaagugucaaacuaacagaauuagaaaguagaaugcugcauaccagagacuggagggaagggacaagguuugggggagauguuacucaacagauacaaaauuucaguuagacaaugggaauaaguucaagagauugauuguauaucaugguaauuauaguuaauaaaauguguauuugaaaauugcuaagaaaguguucucauuaccccccaaaaauuaugugagguaaugcauaugacaauuagcuuuauuuauccauucuacaauguaaacauauuaaaacacaauguuguauaccacaaauauauauguuuauuugucaaaacguucuuaaagaaaggaaaaagaaaauguauucuguuauaaaaaauaacucagcaaacaaaugaguaaaaacauuuauauuuaacagaggaaagagaaaguucaaggcaauucuaccuacauagguuauuaugacaggauugaaaauaaaaauccauauauuuuuuauuaaauauuaaguauuuuaaaaaagaaauagguuuucuaaaauuuuaaauucauaagaaaaauauugauuuccagccucucccugcccuggugggccuuaaacuuuuacaggccaaauaaauauauauauauuuuuagaguaagcaggguugacuuuucacagagagaccuaacuaguuuauuaucaagagacauauuucaaaguccagagaauauaaaacauauucagacccaguuuagccuuacuccagaguugagcuacuucucaccuucuagauguuuaucaaagaaguguuuagcuucaugauuuaaaauucaauaaaaacuugcaauacaagauuccgguugauguuguuuggcuauguccccacccgaaucucauauugaauuguaguacccauaaucuccacauguugugggagggacccagugggagguaaucagggauuuccuccacgcuauucgcaugauaguaaguucucaugagaucugaugguuuuauaaggggcuucccccuucgcucugcucucauucuucuucuugccaccacgugaagaaggacaugcuuguuucccuuuccaccaugauuauaaguucccugauuccuuccuagcccuguggaagugugagucaauuaaacuucuuuccuuuacaaauuagcagugggagaacgaacuaauacacugauaugcuaaaaaaaaaaaaaaaaaaaaaaguuuggggccggguauaggugcucacaccuauagucccugcacucugcacuuuggaaggcuaaggcaggcggaucacuugagcccaggaguucaagaccauccugggcaacauggugaaacgcucuccacaaaaaaugcaaaaauuagucaggugugguggcgugugccugaagucccagcuaccggggaggcugaggugggagaaucgcuugagcccaagaauuugaggcugcagugaagcaagaucacaccacugcacuccagccuguacaacagagcaagaccaugucaaaaauaaauaaauaaauaaaagccugucaaauuuugguauacaaaauuaauauugacauaguucuacauaaaauaucuuaacuauuccaaucugcccucaaauuuuguucuuucucuuuuggggcuuguauaacaauggauuauuccuacuuauauacugucaugucuaaaguauuguaaacugguauggguauaaauuuggagggguggguauuuccagauauuaugaaaaacuucauuucaaaaucacuuaaacuauuggaaacauaaggaguagagaucauuggaaaaacaaauaagucuaacuccacaggucagucauaaaaacuccuuccucaucaucuuccaugguaacuuucacaaguaauaucugcagcuuucauuugaaccugacucauuguguggcccuguuagguuaauugaacuuaauguacaaauuccuauaaauuaaaauaacaaauaacccuuugaaugacaucuaggcaggagaaaugacaggcaaucaacaauagccuccugaauggcauguaacuacagcaugugaaaugaccaaggaucauugcugucaugagcaaaugugguaaauguggucuccgggaaauguauuuauguaaaucugcaaaccaaucuacucacaaggagcagaaaagucaaggcauuuaccauuauauguggaaguagacaugucaaucaagagaaaauggacccagaaucaguuuacaauguuauuaaagccacugggucuaaaauuuucagauagcauaaagccucuacagugaacuacaacuaguagcccaucucuucauucuaguuggaaaguaaaauaagggaggucaaauacaguuuaaaggcaagauuauuggaaguccauuauaaauugugagaaaaaauguacugcauuaaucaaaggaugccauaauguauaagcuucuaaaaaguaaauugcuaugcuucucagauaagaauuagaaaauuuaucuucuuauuuaugaauguaucaaaggaauauuuuacaaguuaaguauuauuguuaucucucuaagcaaauaaaaaccuuuuuucuuuguuucaguuaccuaauauauauuuaaaaaauaaaauauuuagcaugcuaguacugaucuaagaggaaaggucuacauuuugcaggauauuuauauacauauauauacacauauauauauguauauaaauauucuccaaaacuaacagaaccccaauaaaggaauaauuuccaaacuuuagcaaaauguuuguguaauaauaaugcgacuuuuaauucugcagcauugcuaucagcauauuaguuccacaaaacauuuuaacugacuucauuguugacacagaaaaaaauguucauuuuuuaauaauugccaaaucaaguaaacucuaauugcaaucuacuguaucuuugauaaugcuuuauaauucuaaccuagaauuaauaauuuaguaacaguaauugaaauaauaaaauaaaaaccauaagauucguuuaaaaauacaauagaugcuguguuuucuugcuuaauaucuuauuuuaaaauaucauaugauuaaauuuagaacuuuuaugaaacacuagaaaaaugaaguaugcaaguuaggaaaguuguugaaauguugugaguaaaauuauacauuuauuucugaaaggaaaagaacacauuuaugaaauauauuuuguaaauucuuaacaaaaccuagaaauuaacuaaacacuauuuuccccagaaaacugagcaguagaaauauuauuuaauacaugcuguaguauauuuuaagaaaugaucuaucaugugucagggcagggaugaaggggaaaaaguaugauaauugaagauauugagcauuuaugcugugccaagaacauucgggaauguuaacuuaucugaaauuugugacaguacaguaagugauaaucuccaauuuacagaaugaugcaacuuaaaaucuuaguggucccuaaaucugccuuucugagauacucauuuuugccuuugcuuauaggugaaacuacauaccuguccaucuaaucucucucucucucucucucucucucucuccucuaucuaucuaucuaucuaucuaucuaucuaucuaucuaucuaucaucugucuaucuagaucaucauuucauuuuacuuuauauucugcuccuacguggaauuccuaguuguguugcuauuugugaacuugucauuguaguuauuuacaucgaaugcacuuuuuaacugucuugguauuuacuggcauuaaucuaaggugauuuagaauauuagugcugaagguaagcacaugauuuguucaauucauuucccauagcaauaguuuuaaacugugaucuggaacuauuuagugccuauuucuaaggaugaggaauacugggagaggagggcucaccuacccccauccugaauagggaugcaacaaaaaaaacuauuuagcacuauuauguguugagcauguaauguguacgcaguacuaacuguaaacuaccgcuuauuugaaaucaagaauaauaaaauggcuccccuucccucugcuucuggugaaguaguuaagacucuggcauuggacucccuggguuugaaucccacacccaccacuuacuagcucugagccucagauuccuuagcuguuaaauagaggugauaaaaguuucuauaaaagauaccugcacucauauguuuaccgcagcacuauucacaauggcaaagauauggaauccaccuauguguccaucaguggaugaugcgauaaagaaaaugugguauauauguauauagaucaugaaauauuacucggccauaagaaagaaagaaauaaugucuuuuguggcaacacagauggaacuggagaucauuauugaggugaacuagcucaaaaauauaaagucaaauaccacaugcucucacuuaugagugguagcaaaauaauguguacacaugaucaucgagaguggaaaaauagacacuggagaugcaaacaggugggagggggugagagaugagaaauuacccaguggguacaauguacgcuguucugggaaugguuauacuaaaagcccacacuucaccauuaugcaauauaugcaugaaacaaaacuguacuuguaccuccaaaucuauaaaaagaaaaagaaaucagacaucauaaaauuugugugaaauaaccauacuaauauuagguguauaaagcacuuagaacauuuuguaauacauauaauaaaugauauuuuuauuauucauggggagauaagacaaauauagcaaguaaacuuuauuuaaauacucucaguuugccuccuuuaaccucuguucacuuaaccugucaugaaaguguauacaggccaaggucauaacgaaucuguaaacaguaaugagaaauaaaacauucuauccaaauuucacagucuccaaaaaagacucuauauuuauaaaauguggaaacuagucuugugcucuggcuugaguaauaaaggauagacugagauucuuccuugcaaucugauccagcugcuagcaaacucuuaggccugucuuaucuuccauguaucuuuuaagucugauauaacauuauuuaaaaacuagcauuuaguuacccaccucuccccuagcgcuccuuuguuucaugacuauuuccauagcaggucucuacuuuucuuuccuuuuuuggauuagucagguaauccagaugcaauuucagauaagcuuaucuacaccuaaauaaugcccauggcaauccacaugguguacuaacccuggcucuaaaucucauucuuccaaacacaaauugccaugggucagccagaaugcuucauacacaucuaucaacuccuuuggauaaagcgacaacaagcagccuuugaaaagaucugaagaaaacuaguugcugacuggccaacugugucauagaauaccuguuaacaauauauuuuugcuucuuagucaacaaauauuaaauuuauguuacacugaauguacacacaucuuugaacaaaauauggaggcuacaugcagauaugcuuaagcuuaugccucuuuuaaauuacccuaucuuuaaaugauuauauuuaauaaauuuuuauguauucaccauccagaaaaaaagaaacauuuucuauaaggcuaaccaggaaaaaaaaaaugauuaaauggcauugccugccagccacaucuaugaagacauuccagagaauuaagcaaguaucgagagauaacaaacuaaacaaaugaggacccaacaggaggcuuucagcuccaguggaggaucuacccauccuauaguaacuugaguuagggaggcuccauuagagaauucccaaaggaauuagauaggcuguuucaggucuauaucagcaaagcagggauaaaaugguguaaaggugaaccauaauucauccccacugauugguccuauuaaccucacaaugcaagacaccaucauggccacauuaaguugcauuaucaaggucucuacugccaaagaaaaauuucccgaaacuaguauaaaugucacugccagguggauuuauuuauuuagcaacucuuagcuggaaugaggcaucuauuaugucauaccuaauacacuuucagggugaaaacugugaauaugccauuauguuuccaggugggaagaauaugaaagaacuuugucacuggaaaaacacuucaguagaaaaauuucuaagcaccugaguagagucuucucaguacagaugcuguuagccuaaguauuugacauaaaccauucuguggaaaaauacuaacaauguaugcacguuaucaguuagaagauaauagaagcgcaaaaagcacuauuuucuucauuucauugaugcucugucauucggaggcugugaagaugaucccacagacucauuugcugucauuggucuggguaccacaguugucaguagcacuggauucuucuuuccccuuuucuuuaacuaaaucucaaauauuuugcaaaacucugagugcaaaugauuacucagcagucacuuucuuucaacggaagauuugaagaugauuggaaauacuagccugaggucauuuucuaagagucuuuauaugaaggcacaauuagucuuucccacaucucaacgcuucccaaacucauuccuucuucagucgauagugucguuaccucaaaccauguuuuugugggaauguuaagaaacuguuccaaaaucagggagaaaagcagaagaaaaaauauauucuugugugaugcuuaggguuuuacuaggaaagaggaauauugaaagaagguugcaguuaccagaaugagcauuuaguauuauccagugucacauaaauuccgaauauuuucuccaacaucugaaauuuccacuuucuuucucugugcuuucaaccgaaaaagagaaauuuuaucugaaggagaaauaugaauucugauuuggucaaacguuuagaggauuauuuguaauuaauuuugauucauccuucuuuauccuuuacaucauuauaaugcacauuccaauuuuggguuuuguuugauuuuuuauuuguuugugaaacaucucuacuuucugauacuucucaaugauauuacaucauugaucauuaugaagauaauauuacagaaaucauaaaauuuauuaaugucauaagucauuggcauguauuauuucucaaaaauaccaugaaauauuuauaauuauuauuaaugacauuuaaaaguugggaaauugaagcuuaaggcauacaccaaucuccaagguggaccuuaaccaaaguacuaaauucuagguuauucuaacauaccugcacacaagcauuuaaccauuaucauguaaauacauaugauuucuuaauacuacucaccaaaauuuauuaaaagcaauuaaauugguaugaauuucuuuuuucuuuaacuuuuauuuuaaguucggggguacaagugcagguuuguuauguaaacuuguuucaugggguuuuguuguacagcuuguuucauuacccagguauuaagccuaguacacguucauuauuuuuucugauccucucuuccuucuacccucuauccuccaaaaagucccaguguguguuguucuccuguauguguccauggguucuaaucauuuagccaacaacaacaacaacaacaacaacaaaaaccguguucuuugcagggaaauagauggagcuggaagccaugaucuguagcaaacuaaugcgggaacagaaaaccaaauaccacagguauguauuuuguugaagugaauugauagucauuugaaccuuugacuagaaauuagaauuagcuuagauuuaugcuuaauguauaagaucaaaguuggggcuguagaaaagaaguuacauccuuaaaaauauauuugacuuccauuuaauaagacauacugaacauaaauuauuucucccucuggcaaucucauaaaacuauaauaagaauaauauaaacccacaaaaaacacacaggggaggcuauaguauguaagauaugaggagagauguuuugaaagauaaaaagcagaugguuggguuguagaaaagcucacaucaucuaagugcugacgaugcuccagcacaaaaagcaaggcuuucuuccaacagaaucacaguaggcugcuuuguuuauugguuacucaccccagaucaugcuucucagccacuucgucccaggaucaaucaagaagcaggcaucacauuuacuugucauguccuuuuaacuauaaaacauccccagccuauuuuauauauauaaaauauauaauaaauauauauacuaaauauauaauauaauauauauuuacgauauauaauaauauauauauuuuuuagacagagucucacuauguugccaggcuggagugcaguggcgcgaucucggcucacuguaaucucugccugccagguucaagcaauucuccugccucagccuccugaguagcugggacuacaggcacgugccaccguguccggcuaauuuuuguauuuuuaguagagaugggguuucaccauguuggccaggauggucucaaucucuugaccccuugauccgcccaccucggccucccaaagugcugggauuacaggcgcgagccaccacacccagcuaaaauacguauuauaauauguauaauaauauaauaauauauauuaguuuauuucaugaauagcacacuugaagaguuuaagugagucgcuuuguagaauuugccacaaucuagacuuauauauauauuuauuucaugaaaaaauauauauauuuuuauuucaugaaaaaaauauauauuuuuauuucaugaaaauauauguauuuuauuacaugaaagaauauauauauauaguguguauauauauacauauauuuuaauuucaugagugacauacuugaagaguuuaagcagguugcuuuguagaauuggccacaaucugaacuugucugauuuuuuccuccugauuagauucgguuuauguugugacacuuugcagucgucaaugggucucauccuacaguccaucauguccauauguuccauuaguggugauacuaaguuugaucacccaguuaauguggcaccuaguuucuaaugccuuguacuauuuguguauuuacuaaaaguaaaauauuuacuuuuuuaauuacuaaaaguaaauuuacaaauauuuacaaaguaauauuuacuuuuguauuuacauauuuacgaagagcaaaauauuuacuuuuuuaauuacuagaaguaaauuuaaaaauauuaacaaaguaauauugcacaauuacuuuuggaauauuuacuaaaaguaaaauauuacuuuuuaauuacuaaaaauuauuaggcaaguuuagggugagaccagaauacaauaugaaaggcagagaccaaaacuaaagaaauacggggcugggcucuauggcucacaucuguaaucguagcacuuugggaggccaaggugggaggaucaccugaggucaggaguuugagaucagccuggccaacaugguggaauccugucucuacuaaaaauacaaauuuagcugggcgugguaguggggaccuguaaucccagcuacucggcaaacugaggcaggaagaacugcuagaacccggaaggcagagcuugcagugagcugagaucuugccacugcacuccagccugagugacagaguaagacucugucucaaaaaaaaaaaaaaagaaaaaagaaaagaaaaaagaaaaaaagaaauauggcucagagaaaagacaaugcagggaugauaaaaauguuacauguauaaaaauagaacagcugcuauagaaaaaggagggaaagaaaacaaacaagaaaaagcucuuauuuuaaaauaaaagcuauacaauuuaaaauuaaaaauaaaaguugauaugaauuggacaaaauuugaggaaaauuuccagaaagaauaacaaaaagacaaagacagaaaaaaggauagaaaagauaguaggaaaaaguaauucuaggaauuacaaaaagaauuaagacaaugguagagauaagaagaagaaaaauuaauaaaauuuuccagaacuuaagaacaucaguuuucaguuuugaagcaaaacuaaaacacagauguccucuuuaggacaguccucuuuagguuuauauagggaauaaaauugugugugugugugugugugugugugugugugacuauuuccuacaauuugcuccauaauaaaaauaauguugugccugauuuuugcuauauugaugucugaaaauaagucaagccuuuugcgaauauaauaaucacgugacaaagacacuguuauuucaccacagauaggaugaguaaacuuagaaauuuuauaguuuuuuuguuuuguuuuggccuuucaacacuugugcuauuaauuuguuuggaaagccaguucuucugaagucaggauccccuguaugcuaugugacuuuucuuuccucucuagaugcuugucucugcaucuucuucugacaacagauugaaaggagccacagcaagaucuacaaucaagccaggcacagaaagacaaacaucacacauucuugcuuauuugugagaucuaaaaaucaaaacaauugaacccauggacauagagaguagaaggaagguuaccagaugcugaaaaggguaguggggggcuggugaggaguuagagaugguuaacagguacaaaaaaauaauaggaagaaugaauaagaccuacuauuugauagcacaauagggugacuauacucaauaauagccuaaauguacauuuuuaaauaacuuacagagugugauuggguuguuuguaacucaaaggauaaaugccugaggggauggaucccccauuccccaugaugugcuuauccacauugcaugccugcaucaaaauaucucauguaccccugcaucaaaauaucucauguaccccauaaauauauacaccuacuauauacccacaaauauuauuuuuuuaaagauagaaucucacucugucacccaggcuggaguacaguggcacagucauggcucgcugcagccucaaccucccgggcucaggugauccucccaccucauacucccuuguagcuggaacuacaggcaugcaccaccaugccuagcuaauuuuuugcauuucuuuuuguagaaacaggguuuugccauguugcccaggcuggucucaaacuccugggcucaagggauccuccugccucagcgucucaaagugcgaggauuaccaacgugagaccucaugcccggccaaaagcauucccgagaagaaaaaauauaaaauaaauguuaaaaauuaaaaaaaaaauaaaaagaaacuaaaacauaucaagagaagauaccaaaagcuuuuagaaaauucaaauaaagaauacacacacacacacacacacucaugcacacacaugauauaaaaaaaucagaacucagaauaggucaucuuaaaaauaagaugacagaaaacuguaaaauaaauaccuuuagcauccugaagaaaaauuauuuuucccuaaaugucuagauuuaucgagaggaaagguaaacuaaaggaauucuuugacauacaagucucagaauuuugucuccugggugcacccuuucuuaggaagcugguggaggcuccugccucagcccaggagguugaggccucauuucuccaccaaaaugaggaauaaaacagccagaaacauagaugccaaagaacaagguggaaaagaaggugcacagccugauggaaauauuaagucccaucuacuaugcaguaggguuugggcacaaccagucuauuuuugaacacaugagcuaagucucaaggaaucaucucuuuaugaaauaagaaagcaagaguaaacauauuacuucaugaaacugaccauuuguccuaccaaaaugagaaaguacuaggaagacuggcauccucuuccaaggucuacccauccggaagaaguagagaagaaacaaaugaaagggaauaaugaauacauaaacugagacaccucuagggcugaaggggaguaggcuguucuaagcuuguuucugugagucaccuggggcaggaggcagcugacaaggaucuugaaugucugcucuuguucucucuggugguuuuggguugaauaguuucugcucuaacuaugaccuccagugcaggugcucuggaaguuaaauccagaaaaguuaaagcccaaaagccccagaccucacuuggaaaguaagaaaaacacaugggcauuauucacuucucaucuuccucaaagaucaagggcugguaaauuacagcuucaaagauguuuuccucaaauucuguuuuccuaaacgaggcuugacuugggagugcuuuuuauaggguagggguggggacugugauuugggguuuguuuugggugagagugucuuuggcuucucuauuuuaggggcauucucccuucacuuggugaguucuugaaagcaaacaagaacuugaguccagucuucccucuaucucaaaccacaaccuuaaaggaaaaugucaagguauuugaggggcacacuauuucaaagaggaaauaacaugcuagauuacagauuucaugaauuauaucauucucugaagcauuauaugauacugcuaaaauuuuuggaaaagaacuaaugauacagagaaaauauagccaauaugaaaaugaggcaauuauuuacaauaaagacaauaacaaguuauaugaaacagaauguggaccaggcacgguggcucacgccuguaaucccaacacuuugggaggccaagguggguggauaacgugagaucaggaguucaagaccagucuccaacauggugaaaccccgucucuacugaaacaccaaaauuagccaggcaugguggcaggcgccuguaaucccagcuacucgggaggcugagguaggagaaucacuugagcccaggaggcagagguuucagugagccaagaucaugccacuguccuccagccugggcgacagagcuagacucuguuucaaaaaaauaaauuaauacaaauacaaauaaaacauaaaacauaaugugaaguuacaguauuccaagugauuuaauuuuaaacaguagcuauguacccaaaauaaugugagcauugaacauugcuuuaauucaaacuuuugauauauucuauaaugggacaaauggaggggaggagggaugagcaugggaguuuggguguuggaggauagaaaauaaauacauguauaaaauauacuuauucagaaauacuaguaaauauauuuuauuuaugaauauaagaguaaacaccagaagaaacagcuaagaaagugaaagcuauugacccagggagcaggacagcaaguuguccuguuggggauaaggccagcagggaaugaggccaguaaucugcuauuuuucauuauaagccuguuuuaguacuaucugauuuuaaacuacuuguaugugauaugcuuaugaaaauaaaaauucaauaauggaaacacauuguuugccauuuacuaccuagaaggugguuuacuuuaucuauccuuuaaaacaguuguaauacaaugacagcuuacuauagaaaccucauccagggaaggauagaguuaacaacccauuacuguaagcauuuuaaaacauauaucuuugcaacggaaugaaaacuauuucaacucugauauuaugagaaagcagcuucucugaaaccccaagggaucaguaaucagucaaucuccagccauuugguucuccagugaggagacagcagaaaagcaagaguaucccuaauuauaaauggaauuuaggugagaagaucaaauaaaucucauccaaauucaaguacaagagagauuacuuggcuggacuuuaaauuaucuuuuguuuuguuucauauuuugaaaugguuugcacuuaaucaugaggcaugacgugaauuaacuauucuuagcugaauuauaaacaaacauucauauaugucacuugauugggauguguggguauucuuugcauuuuguuuuguuuuguuuuuucaguuaccaguuuuaaaaccaagauaaacccaagauuauuccccuggggcagcacuacccaugccauggcucuguacaggugggaauacuguagggaauuaacuuuaaucccuaggcaagcccuuuaggacuuuucuagcccuggaagagcaacaagauuacaagcaauaggaguuaugaauaauuuauaucaguagaauuaagaaauguuagagcuggaaggaaaccuagugguagaaaaaaaaauggaauauggugauuucauacaauggaagggugcagcacaaauuggaucagugaaaaguugaguucagcuuaacauguauaugcugcgccacuuugauugacaauguauagucuagugacuauacaaauaaggacuuauucauucaccaaauauacugaagaccaacuauguuucuggcuugcuccaaacacugaugauaaaauagugaaccagaucaucccauuuaccgcccucaauuauuauuaugcucaaucaggcaaauaaacuacugaagugugaugacauuaugguaggggaaguaauaauuacaucgaaaaaagacuaacacagucaaggagucaaaaggccuuucagaagacaaaaggcauagucccaacuuuaaacccaauucuguuucuucacugaggaguauguguguauguacauuuuuuuuuaaccauuagucuuggcugucucuuguaagaaacauugugcuuauuaauaaacugaucaauuacaaaguacucuuucucuacauaagauuacacaaugauacuugauucaaaaagacauggagaacaaauaccuuuugguuuauuuucaaauauuuaacuacuaauaaauuuaauacuuacagaggauaugguagcucaaaauaaaaucugaaauuucauauaauaaauuauaacauacaauucuauuaauaaguauuugucuuugaugacucagaaaaggcuaaacucacaaacuccuucagcaugguuuuaugauucucauuuuaugauaugcuggauaucuucacugcuugaucaaauguuucaagcuaggagucuugugcuccacugaucuucauaugucaauaagcagaaauaauuucuguacaacgaaaguucuaacaauaugauuggguuuagaauggcauuaacuuugcuaauuuuucugggaagaggagcacacaauucacuuuauguaccacauuuugcauuauuuuacuuuuacuuucugauauauuucuuuggguauuuucuaagaugcucagugaauuucagaaauuucuuuuuuguuccuuucuccgcaggagacuuuggaugcccagagucuuguauggcccaucugucuaagccaucugagcaugagccaaagcucaauaucgaaucagugacacucuuuuacauuacagcuaacaaacagguugaggguaagauuuuuccauucucuaugaaaaaauuaaccuaauucauugauacuuauuaugcuaucaaaaaccuugcugaggcuaacacauaaaaaagccagagauacugacucuagauaugauaacucuuccaaaaaaggcaucuccacuuucauagugauaguuaacauccaaaugaaaacaagacuauuguccaaaugauauauugugccuuuacucaaaaugucuauggucagaauuuaucaaaggaaaucaaaauuauaaaaacaaaacuaauaaaacagaagaaauaagaaauauaccaaguuaauuuccuaccaauuagcagugggaaauguguaaguguaaaguuugaaacuaguaauuugaaagaucagauucaccuaggucacaccaaaaagugaaucuauauuaaauuauauccuacaauuuagaauguaugggguauuuaaaaucauguagcugaauuuuuuaugaaauaaauaauacguaaaugcagaaagguaucccaaauuuuccaccagaucauuuucaucagaaaugccguuaaaaaccagcuaccugacucccauuuugaggaccuuuccaguaugccauacugcuugugaagugauauacaguaugugaaacugcauggaagaccuaauguuaaauagauauucaaauccaguuuauaauuuuuauuaauuggauugaaauugauuggaagagcacauuuuagcagucaaagcaacacagaauuaaucagucuaugauacugauggcuuccuuaaaaucagcaugcuugugcagcauauuauuuuuacauuucagaauaaaguacaccaacuucucucacaaucuguagcuauuucacacagauucacauuguuuccaugauacuaaauuaaucaaugaguucaaugaaaaugccagcuaugccagaaggcuuuacagcuauaaugguauuucaaaagguugaaagagauuuuuggagaaaauuaucagugaaggggaaaaucauauuuuuuaacuaaaaauaaucucauagguuacauugggaguuaauuuucaaagguuuuauguagucguuucaaauucuucaucuaugguuugauauuuuuuaaaaauaauuuuucugauuucauuuggcuauagaauacauuuuucucgguuagucauaacucauggcagcaccguucuaaaagcaucuaaguacaguucacagcacuaaugaggacugcuaacuuuauuuguuuaagcagauccugauauggagauuggauuaucaccucuggcuuauuaagugaauuauccuauuuacagaauucuaugcaucuccauggucagguuggugucaaaauuuuuaaauguuacuuaucuauuuuauuuguuaaauugcuagauggagcuaccugaaaaguaauuauauguacuuuauaaaguaauuaugcaauuuuauuaauaguaaguuugguguagccuaaugaacauugacauaguuuucagaaaaccucagaaauuaccuuguuuucaagcaaacuucucuaucaaaaauuagauaaaaaugaaauagcacaggaaaacauucagcaaaucaaugcuuuccccaauuacucuucuuccugccuaucaugaaaauuauuuuauuccuuucaucucuucaaguagguuaccaucuuccuuuuucuaugcacuauucuuucuuguuuuucuguucgauugcaccugcuucugcaauguuaagaugcaaacgucuggaagucuaggugacaucuacuuguucccccauugcaucuucuuaguucuugccucauauucuuucagucuacccuuuauuucaugcauuacuuugucauaaguuuccaacagguuuaaccugacaauaccuugcucaagcuuuccagaaaaauaucuugauauuuucaauaggcuuucuuuaaugcuaccaaaacagcaaccugaagaaacucaaccacaacuccuuuauuaacaacauucaaguuccaaagaaguuauuaucauaugggggcaaaccuuaaucagggaaggaugagagcucauggauaaacgcugccuucugauuuucccugggacaaaugguucuaagucgcagucuacagagcccuaggcaagaucaagcccagcggaccagcaguaaaaaaauacgauuguauuuguguuucccuccuucuuugucucucuaguccuuuacuucugucccugagauuucuucccaaaauaaaaugaaucuuauaagcccuuaucuuuagcucuucuuucugguacuuuacucucuauguaacugauauaggucuuugaacuuuuacaaagagcuuguccucauaaaaccccgaugucuaauccuucucuguuuauuugacaacuauuauauuuauguacccccuauaauauuuuaagcacuguaaaauauuaacucauuuaguuccccauaaaaaccuuacaagguagguacuguuauuaucaccauuuuacaaaugaagaagcaggcacaaagaguuuaaaugaccuccccaaggucucauaucuggaaagaggagacagaauucuaaaguuaguagucuuucucuaggauacauggucucauccaauuuaaaaaagaaguuaauauauuuuugauuaauauuguaacucuacuauggcaauucuucaauaagauccuuauagauuuguucucaaauuugugaacaaaagccuaauagauuugauauuuccuauguagcaaucucaggucaaugauuaaaaaagcaugucccaaugugccaaagugcauugagucucugcuugugacauguucgcugauaucucaugggccaaagaaacauggucaagcccagagucauugugggaggugaguauauaagaacgugcaggccgggcgcgguggcucacgccuguaaucccagcacuuugggaggccgaggcgggcggaucacgaggucaggagaucgagaccauccuggcuaacacggugaaacccugucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaaaaaaaaaaaaaaaaaagaacgugcauaagaagcaagaaauauuuuuuuucuuugaaguuaguaacauauguacuuauguguaaauacaguaagaaaugauacaaacaaagaauaauuugucccuguuucucaacaugguauacauagguagaguaaugggaaaugcaaaacaaauaacugaaaaaauauuuuaaaauauuuugguacauuuaauacaccagaaauuuuuuaugaugguuaaagauaagaucaguuacuaugauggccaagaucuucaaaacaucuuugguaauugugccaagaauaaugaagagacaaaaccagaaaugcuuuccaugguaauuuuguucuucucuuuucuaaaaagacgacaucaguuacuuuuagagaaaaaaaaucacuucuaguuuugaaauucuuauuuaaccgaucuccauuaccacauuuuuauugaaguccuucauaaaaauaugagauauaacgcuuuuacuaauauuucaaaauacucaaauaaaaaagcacugcuaaacaguaauuaaguguacugcaucauuaccuuucaugguagcuaugggcaauuugaguguauuuuuugcaguauacagggauaugcucaguuaaaaugcaaaaucauuaugagacugauuguucucaacauuuccuaagcagaaaauuaauauuuuuuauuuucauuuaagaagucagcauucucauaaagcacauuaaguucaacauauucagcucuuuuuaaguuaccugaaaaggaaagagaauacacuuucuuguucuagaaaaaauaauugcagaaagucuguacauaauuuuaaaacagcuuacauuuauaacuucaggcucuguaaguguugauuauucaguaggaaacaaaugcuuagcuaaauuugaaagcuacaaaaaaauucuguuauggaagugucuuuuuuuuucuuuuacaaagcugacuccucauugcacuuuugaaauuuauuuaaaaucucaggacgugacccaaauuaucgucccacaugccuauagaaagaagaaucccaagugauccuaagcagauuccuuugucaaucucuaggucaaacagaguuggaggaggcaaaggaggcuucuuuggugagaauguaauguccacaagaugacaaacugcaauauugguucuccuaacacaggaagagugaacaauggaagccccauuucuaucuuauagcaacuuaacaugaguagcguuaccuauugccaaauuccucaaggagucugagaauggaauagggaagaaguugccauuggucaaauaccuaagauaacagaguauuucuagagucucaucuucaguucaagauuuacccuuuacuuucuuaagauuaacuccuugaccuuaucucuggaauuggaauuugaccgcagaugcaccuuuagggugagaaugcaaguagauguccaaagucuguaccccaauuuccucccugauaacaucccucaaauacauaugccaaauaagccucugaaacacacacacaaauuaguccccaguuaauugguccaaauuacaauuucacccuccucucaaacaauuaccuuuacucuucacugagaaaacauacccaggaaagaggcacccauucugcagaaaaucccaagguucuggguacuaagagcauugguuuaaaagagguguguagaggcacaggcucaagauaggcaagucuccuaggccccacacacacugugccuugugggaugcaggcaaaggagagccagagaagaccagaacaaucucugcgaagagcagggcucaugucuguugcucuaguuguucaaaccaagcacaguaauucuugaguuauugauaauucaugaugguccuuguauuuuuaucucugucucucugcuuucuugauuucucuaaaaugauagcuuugggaccuaaaaugauuacuuugcuucagcaaauguauaaguagucccaaagucgucauuuuagggaaaacaagaaaguuuacuccuucauuugccauauuugaguauuguguuucacauuguuuagaugagugauauguuagaaauaaaaauacacacaauuuuguuucccagugcuuguaacauguaugccaucaucuuaagucaauggcuaaggguauggacucggauugccuugguuuaaauagugguuaaaugcuggcuucaugauguauaaauugguugaucuuaaggaaauuauauaccauuucuacaucucaauuuccucaguucuaacauaaccauagcaguaucuacuucauaggauucuuauaagaauaauauaagguaaugcacauaaaguacuugaaauagcuccaagcaaagagcaaaguggaugguagguuuguugucgucauugucaucaucaucaucaucaucaccaucaucaucaucaucgucaugaucuaaggcagugguucuuaacuuugcuggcacauuagaauuaaccugggaagcucugcaaaaggcaacauuucaagccaauuaauccagaauuuugagagugaaacucaaauaucauuuguaaucucacaaccaagauuacaaaauucaguuucauggcacugcacuaacaucuacaccuauuguucaccuguuauuauuuccuguauugcccuccauaacauuguuauaaauauuuauaaagcaccuacucuccaagcacugagcuggucugauguggcgauaaguaagacauauacaaugcaugcccuuauagggagaaaggcagaaaauuaacaaggauaacagauaaguaagugcagauaaguauuaugaaauucccauuaagaaaauaaguagcauaguaacauaagaauuguggaugagguaggagguacugaaagcacaaagcuuguuugaagugcagcaucucaggccccacguugggccuauugaaucagaauuugcauguuauauuacucauaauccaacuucaacaauuaauaacucaugaugaauguuucuuuuauagccccugcccuaauuauuacaaggcaaaucuuagacaucauauaaguuuacucuaaauauauuaguauauaucauuaaagauaaagacucuuauuccaggcuuuuaauuugagcaacuggguagacagagauaauguuuacugagacagagaaguuggcaagauaaaaaguugaucaaguggcuguagagaguggccgguagugacugggaggggucuagaguuacuccuuggacauaguauguuucagauucucauuagacaauccaguagaacugccaagcaugcaguuggauauaugacccaaaagauuaagggagccaucagggucagagauauauucuuaauagucaucaguauauaggugguacuuaaaguaagagagcaaauagaaauugaaaggagccuaaaccuagacacucagcagguagacggcagaaaacagaaaaggaccuugaggagaacaaguaagcaagaaugggagaaaacgagaagcauguggaacacuugggcuaagauggaaaaacuuuuauaggcgaaaauccuccacaguauuguauaauucaaaguacaaaagagagcacauugcucuguguugaauuuggcaacuggugacaucaauaaaagcagcugaagugaggaagccaaaaugaaauggaacuuagacucaguggagagccuagaguuuuucugaguuucauuacauugccaauguguguaugagaccauuugugcugcuaaaacaaaauaccggaggcuguauauuuuauauaagaauggaaauuuauuuucucacauuucuggaggcugagaaggccaagaucaaggaaccugcagguuuaaugucuggggagaacccagucucugguucuaagaugaugcuuugaaugcaguggccuccagaggggacuaaugcuauauccugacaugguggaaaaggcagaagggcaaaagggcuuagcuaguucucuugagcccuaaaauuaggauuuuaauacuauucaugagggcagauggagccuucaugacauaaucacucccuaaagucccuaccucuuaauauuaucaaauugggucuuugguuacaacaauagagauuuggaugagacacaugcauuuauaccguaacaauguguucagauaagucauggggcaugagaaauauaccaaagucugggaauuauuucuugauuaaaauauaaacuggaaaaaacaauaacaauacaugcagaugaaauaacagaaaauaaaaauagccaauauagaaaacucuuacaagaaguuuugauagguagaaagccaaaaaaugagggaaacugaaaacccuuaugguguaaaguuuuuuuuaacauuucuuuuuuuauuuauguguuugcuuucgaugagaaauauuauagcauguuguauucuguauauucugaagagaaugauuauuuagaagagagaugagcagugaagaaaaagaacaaagguaacgaauagauuaaaucuguaagacucuaagagaguaaggaauucggagcacaagaagugcaauuaaacuuaaaaaaagaagcuacaauuuuuuuccccauuguauccagagguaaaaagcaaagacuauagauauguguacuagcaaacuucuaaauuagguuguggagagauuaugguggcucgcucuuauaguuuuguuuuuacugaaacauaaggcaagcagccaacuaaaagagugggaacccuaucuuacuggggagagguagcaagauacccuacaaugcugagugucaauuugguggcaguuauacgcucaugauuuuaaaguaaaaccagucaaccugguugugugacuuucuucagcaaacuuuuuuucuguuagggugaaggcaaagagaaggugaagguuuaaccuaugggagauuuucccacguaucuggcauacagugaugaagggauaguuuaagggaauuuacauaagaguaaguuauaggagauuauaagaauuucucaucaggagaccuugcuuaauaucauucaguguuguacacugggucacacgaugaaaucgaaucuacaucuacaaaaucaaguauguuuaaauaacugacuuaaaugggaaaaauauuuauuucauuguuugguugccuuuuuaaaagcaaucagaguuauucauuaaacaugccucaaaucucacaaaauuugccauaagaaacuauaaacuguaguaauaacuaauuauaauucggagaauaggaacuguuagauucuuuaugccaccaaucuuuuauuauucuuucaucauaggaccauaaggcuaggauucaauccagccucauauuagaugaauguaauucacaccgcaaacagcaaaaggcacccacuaaucccuucucugacaggacuggugcugaagcucagugugugguuuuagcuggaagaagauuaucugugauuguuugggugagucugcucuggucuccgcaugucucugcagaugucacagagguuuauucuggcuggaguccauacuccugcaauaugacuggugacaguagugcagagaaagagcaaaagcauuucuuuucaaccaggaaaguaaaagcaaugguugaaauaauuguugagagauagucugguaacagagaagcaaugaacuaguuaguaaauguauuguuuauugaaacagugaaaugagggaaaugacauugcuuuaagaaguuuuguuuuugugaacacaagugaaguuuuaaaaauaaauuuuccaguguaucuuucaaaggcaauauguaauguguuucuuugugguucuaucagcaguugaaauaauaucugaaucacacuuuaauauauuuucuucagggaaauauauaaacuagcauaugagaauuuuuaaacuagcauaucagcguaaauaucugauaauacuucaucagauuuuaaacaaauucuguaguugcacauucacuuacuuaguuguaaauuccauuuacaaaaucauaaaauuguugaaaagacgcuuaaaauaaaccaaaaccacauauauucaaguacuauuuauuuuaauccguaugaauggcaucaacucacaaauagauuuuaaaagaugccucuuguuugauuaucuuuauaggcuuuagaaaaagcuagaacacaauauuuaauuucccauauccccucugacucugaugagcagcccagaagauuugcuuucauugucagugucaauuaaaaagguuccacucacaucaguuacacacuuauucagcuacaucaaaggccuccuacuaagaacaggcucuuuccuuaaauccuuccucacagcuaaagugaauuuuuaaugauaauguggccucuugugaauaucuuucuagucaucccguuuuucuuagcuuuuguagcauauuuauguaaguauaaggauaacugaucuuuuaacagcaaggauauacaacacauuuagugagaagacauuaaauauuucuaugacuaucgagauugcuaagauuugugagugaauuucugguaaaaucugugcacuucauaaaugcuuuaaauuuggaagcucuuuaucauuugugauuuuagauauuuuuaauuaacuuacuuuugaauuagaacauuuaaagccacuuuuuuuuucauaaucacauauacaacuuuaaaagccaaauuugauuaaaaacguaaacaaaaaaacaaagccaacccuaguucuguaaccauuaucuuuuuugucuauuuugcuucccaaaggcaacaacuucaacuauuucauauaccuuccucuuucuugguugacaccccuguuuaaaugaaauauauccuuggaccagaaaaaguacauacacacacauuuugaaaaacuacaugauugaaaguuuuaaaacauucucaaaccuguuuaggaaugugauuaaaaacuauuuuucuucaacuuuuugaaagauuucauccaguuacuucgaauuuucagaaugguguuucugauacaauuccagauaacguguauaugaccuuuuauuucuggaagccauuguggaucuuccguauguaccccaauucuauaaaauuucucaauuauguuuuaugucuggagacugaugucugucagucuugggaauauuuucucuguuauauuuauggcaauuuuuuaccaucauuuuauuuuuuccuuuauucuuccaggaaucuuaauucuaggauuuuggacgcuuugaguuuauacugcuucauauacuccauccuuuuaucuuucugguguauuuuaugggagauugccuccauuuuuuucaacauauuucuaauauuuguuaaaaaagaaaauucugcuuucauaaagacaucaaaucuucucucacuuugcuuccuuugaugcuuugaccucaugccuaaguguguguguguguguguguguguguguauguguuaaguuccuuuuauuuuucuguguauaguuacugucucuccuuauaugucugaagguuuccucaaaugccuggagauacuuagaagucuuguuucuggcuuaaggcgaggcaccaaauagcuaaauagagacucugugauacugaagagaaucguguccacuucacgguuucaugguuguaaacguuaguuaguuacuuagauguuuguggaagauccccaaaugucugcaguuaaaugucuuuucuccaagguggaucuauuugcccugagaaggauuuuucaaugucugccauguuucugaaguacagcgaaguggauaaucuuaccauucagcaugcugacuuucccuuaauguuuuaauuuucucuacuaguuucacccuucuuauuaucacaugccuuucuccagagcuccucacacgauuuuuucagguaauaugugaucugucucauagacagcuggaagauggguagucaucugaaugaacaagguuuguggugagaacccaaaguucuauugucucuuauacaaacaugagggaaaagaguuuuucuguaccuccauugcuuuccaauugccuucuuuuuggugccuucucucucuucgcauccuuagcauuuuucaaaugaucauuugagcugaacuccuguggagaauccuagaguagauguuccucaacucuacuaaguaaauuaccaaccuucacucacuccuggucuucauuuaggguacgucuagguuuauuaacaauagagcuuauauuccuucuuacucgccucuuacucgccucuuugaagugaucauuugggaacaugaaaauaacauuacuucuuagaaauuaaaauugguuucaguugcuuuuaaaacauguggugaacuuuucaauaaacuuuuauuuguucauguaaauggaggaaugguaauauagguaaucaaauaaauuaaaaaguagacaaaucucagagaaauuuuguaugaaaugguucaaguguuuuaucugucuaucucuuuuugguuuguuaucuuuuuguguccauuuaaguguuagaaaaucugcuacucugaaaaccauuuauaauacauauaagccauucuauggcauuggcugaaaagaaauuaggaauucgcgaaacuucuuuagcauaacugcauaggucguauucuacuucauuaguuacucaagauaaagauauggccaggguaaaaaugaguacugagagcguuauaaauggaccuuuaagugugcuucuuaauuaagauagauuuuaacaucuguucuuuccacucauucuguccccaacuaauauccucuucauuguccuauuuuguaaauauagggucuucuuuacaauuaccuuuauuucucucugacuccucuaauuaaaacgauaacauauuuuuaaaaauuuauauaugcaauuuuuucuuuuuuuuuuuuugagauggaguuucacucugucgcccaggcuggagugcaguggcgcgaucuuggcuuacugcaaccuccccaucccagguucaagcaauucucccgccucagccucacgaguagcuuggauuacaggcaugugccacuaugcacagcuaauuuuugcauuuuuuuaaaguagagacgggguuucaccauguuggccaggcuggucucaaacuccugaccucagaggguaauccgcccaccucggccuaccacagugcugcgauuacagccaugagccaccacgcccagcuggcaaaauauuuuuaaaugacacaaaagaacuaauacuggccuuugggaggccgaggugggcggaucacaaggucaggagaucgagaccauggugaaaccccguuucuacuaaaaauacaaaaaaaauaaaaaaauuagcuggcgcgguggcggguaccuguagucccagcuacucgggaggcugaggcaggagaauggcaugaacccgggaggcggagcuugcagugagcggagaucaugccacugcacuccagccugggcaacagagcgagacuccaucucaaaaaaaaaaaaaaaaaaaaacuaauacuggcauauauuauauugcaaaauaacuuacauaaguuuaaaaggauagauauguaaauauacacauggaacaagagaguuauauuuuaacacuguauguuguuaaaguagcaaaagccucauuauugaggcuccuaucaccauuauuuaacauuuugcaaggguaguccauaggcaaaaaagaugaaauagcagaugcacaccagaaaauggauggagcagaauuauaaaauuauaaugauaauuaugguaugauuagcuauauagaaaauugaagaggagaaaaaaaucauuauuacaucuucuagaauaauucaucuuagaugcuuaauauaaaauuaaaauuuuaaaaauucuuagcuaucauauacaaacaacauuuacuauugcaacauaauuaaggaaauacaauuuauaguauagcucuaucaagcuuuuaaauuaacaauaaauuugauagaucacaaagaaaucuuaaaacuuuauuaagguacauauaaaaaugggcuuuugcacguuuuggauaaggauccauauuauaaacauaacaaauauaaaucaccaaauuauucuauaaguacacacauuugccauacaaauaauggggaguucuuucauuugucuuugucuuuauuauuuugugguuuccuuuggaacaaggcacgcugauauuaaaauuuacauaaaaauuuaguauucaaaagaaaaaaagauuaaugaguggcgacuaguucuaccaaaugcuucagcauauguuaaggcuauauuaauucacaguuuggugcuggugucugaauagacaaacaaaugauacaaagucucgacaucuuguaaaaugcacacauauuuaauuaauaaauaauaauuuugacagugaaaaucauuaaggaaaaauguuuuuuuuuuccuuuuucucuuuuuugaaaaggagucucgcucugucccccaggcuggagugcagcggcauaauuucggcucacugcaaccuccgcaugcuggguacaaacgaaucucuugcaucagccucccaaguagcugggauuacaggcacaugcugucacgccggcuaauuuuuuuuuuuuuuuuuuuuuuuuuuuuuaaaguagagaugggguuucaccuauuggccaggcuugucuugaacuccugaccucaagugauccaccugccccggccucccaaaaagugcugggauuacagucguaagccaccuugcccagcaagaaaaaacuuuuuuuuuuuaaucauugguuuuuauacaacuagauaacaaaucuggaagaaaaacaacaauaagaacaaaacaaaaucaaaguaaaguuagaacucuacuucacuucuuacuccagaauaaauuccagauuuagcaacgauuuaaacaugacaauaaauuaaaaguacacaagucuuuguuuaggauaaacuuuucuaagcauaucccaaauccaggaacuaacaaagacacugcugauaaaaagaguaaauaugagccauuuguguaugucaaaauucaauaagaaaacucaaagauaaacaguaacuugugauaaaugugauauauuauaaaaauauuauuuucuuaacaagauaggggcaucaaaaaucaguaaaaaauaaccaacagccaauaaagaaaaugaguaaagcacagauuacagauuuuaaaaacucaaguagcuuuuaaacauaugcucaguguuccacuauacauaugugaagguaaauaauaauuuaauaaauaacuuacuauuuuucaucauucagauggauagaaaucaaaaguccuuucuguuauacauuuuauauaacaagaacuguuauacauuuuaacugaaaacguaaauuccuaugacuuauuagaagacaauucugcagcaucuaucaaaauaaagaaugcccguaucauagguuaagggacaaagaaugcacuuuaauuuuuuagaacauaucccauagauguacuugcaaaaugugugugcuuauuucuugcaacuugaauuauuguacgaaacaucaaaacauuccuaaauguccaucaaaaagagaauaacuucauaauauuauuagauccacaagaugacuuccugugugaaagaaaacuaaaauuuagguuucaaaguuaggagacagacuucuugcuguuuuccucuuauggcccuuuuaaaacacacauacacacacauacacacacguaaugcuggcaaaggaaaaugauccaaagaaaaaugaagauuuggaaguacaauaaaacuacgaaugagacugauucacaaaaaugaaugaagaguuaugaguauauauauauauguauauauauauauauauauauacauaaugcuuuuauuccaaauuuuauuuuauaauguuaaaaaauauauuucauaggaaaauacuauguuuaauuucaagcuuuugacuggcuggcuuaauucaauaacacaaguuacaguauuuaaaaguauggaagaauggcauaucauuuaggcaagcaucuauauauauauauauauguauauaauuuucuccacugaagaaucaaguaguagugaauuuguuaccauacuucuuggcaauuacuuagaauauaacaauucuuguucuagguaaaugcagaggugcacaaauaaacaaaacuggggauaggaaaugacuuugugaaaacugaggacucacugggacacuuaucugaaugaaccguggugcaucuuacuacauuaguaucauguaagguucauacagcuuaucaaggucuguaucauaaauuaacauuuuauuuuugacuggaacagcaacucugaguaacaagggaaggcuuuauuauggaugaagaaacugauuuuguaugauuugaucaguaucaaagggauagugacuggcagagccagcucuaaacacuagaccuugugguaccaaaccauaccauaccacaccguaccguacaauaccauaccaaucugggauguuuaucucaucugcuaauucacugacuucauugcauauauuuuccaguuauuuaucuuauuuguuuuauaugcauacauacauauauauguuuaugucugugugugugaaaauauauauaauacuucaagcuaauuaaaucacuuacuccuuggagacaucuauuuauguugcuugccugggauucugaauauaaauagagcaauagcugaagagggauaugucaucaagggagaaaacacacacauacaaaggucagcaaggacagaggaucagguaugcugaggagggaaaagggcauuggggaugcagaggagaaagugauaucuaauauagauguaccuaagaacucaaagcaagagagaauucagggaugaaguggaauguucaaccuuugaugaaauggauucuuuucuuacuuccaugagagaaaagaagguaggcagaagagaugguagagaacacuggccagggaguccucacucugcuuucuuuaaaaggccugugcaagcuaauguuuagaugacacagaaucauaguuuguggaaaauucauuuuaucuccucauauauugauauugaaauagucaucuagaugcauauucauauacauaguauauaaauuuuuauuaguacuaaggaagaagauguaauuaaaauguccauuaauuuaaaaauuuuaauggauuucuguguuagcaaaggcaaaaaggcaauugaguuacauacagaauagacugaaaggaauagauaacuuagacaugaaaaauuugauacaauaaaauuaaagucucucaaaggacucuguaaaauguuaagucuauacagagaugaggaauguaugugcuuguuuuauccccauuauuugauugcaagcauccuaauaguaacaaauuuccuuucaaucugucuuccauuacacuuuguuucaucuacaguaguauuauguacagcuuuuuaaacucuuauauuaaagaaauugguuuuugauauauaaguacaccaaaggcuuacauguuuuuguuuuauuuuucugaaucaugcaggcauagaaugaaauguauaacugcauuugcucugccgcuuacaagauaagugaguagguuacuuaaccuaaaauauauuugauaauaauuaccccaugguauuuuuaugaggauuaaauuaggcgauguguauaaagcagguaguacaaugugugucaauacaguacuuuccauaaaugugagcauccaugauauuagucaucaacaaugaaucaccauggcuaaaggaugaaaucaugcacucuccuugaaaacuuuggcagagaugagaauguuguuuguucauugguucucauacaaugcuggaguuuaacugauauuucucaaggcagcuauuuucauauacugucuauuuugaaauuaacuauggucuuucaaggaaagauaugauugagaaaacuuauguaagauucuguuucauaauuugaccugacaaaauguugaggucugucuaaagauggaucaggggauuaucuaugaaauuuaugucauuuuccaaaaguaaaucugagcuggaagacuccaaaaugccugugaaguacaacuucucuuuucagaaaaaaaggguguaucuuagcuccaaaauguuuuccacaauucuuauauucagugcaugacugaaaugaagaucaguucggacuuuagucucucugcacauaaauaaaugauggacaauaucuccaagacagguggagcccuugauggauggacaagcugaauacacaaacacacaucaaagaacaacuuugaccacauauccuaaaucccuuuggucuucuugggcccaucaucugauuucaaaaauacuuuuugugcaggauuuuuuuuuugaaguuugguguuuguagguuuauuucuuaugauuguugucugaagaguaaugugacacacgguuucuucccugcagauucaaagcaauugacgugccuuguccggauaaaugguuuuuaauaacguauacuuauuaaaguauuuaauacucuaauaacuuauacuugauuagaaaaauguuauuaucagaaauacaucccaaaaacucaaaaugaauuuauaauucuggcauuuaaaaaauucuagacuaacggauaaaaaaaauuauuuuaagaaaaaacucucaggucuaaauucucacuaugucacagaauuuugagaaaaugauuaaaucuaguagaaaacacauuaucacuuuuucaugcacaaaaaucaccaucaguaugcaaauaucuauguguauauauaucuauacauaucuaucuauauccauauauacaucccucuuuauuucaccugagucugacacagcaaauuauaugaugagaggaaaauugaaguaaaaauaaggauacucccauuauuauagacacuauuauugccaauacacguuuuaauguauagcauugauguagaccauaagaauucuuccauuuagugugacugcaauuaggaauaguaccacugguuuaacuucaguuacuuugcacacuuacucucauuuucacuuccaguggaagcagccccuuuauuucuggcuuauuaaguuaauagacauguuuucauaucuaauggcagauaucaaaaaauauuugccccaggcucuuuugugaauuucauuugaccacgugauuaauuuaaagaaaacacaacugacucauugccauauuauaguucacauuuuucauuugugcauaaugaguuaaauucuaauauuuuaacuaaucuaaaacauuuguuuuauaaaaucacaaaccuagacaaguaguuguaaaacacugacauaaaagucugugugugugucugugaauguuuugauaagguaagauucauuuugucacuuagauaugaaaaguaaagacacauguaucuguccuuuaugcuucuccagguagaaauuuaauuacuauaaguguuuuagugcuuaguucauuggaguuugccauccuggagagcaugugugaagaaugagggaaugaaaaggaaaaagggaaaccaaaacaaguuuuauuauuaauuuggccaccauuuugaggaacaggggcucaauccugugggcccugcugaggguccuuagagagaggcaaagucugcaggaucugagcagaggugcugugaggugacaccuguauuaagccauuugaacucuggguagacaugauuaugauaacacacaauggcuagaguaaaagacaugcauaugaaguggugcauuggaggcaguuggauaaaagaaagaaaacaaacaaaaauucugcaagauaccacauuuacauaauuagagugaaaguauacaauaaauaauaagacugaauaaaaaccauacaguuuucuuauggaauuuaaaaguucuccugggauuuuauaguaagggcuuguaaauuugacaaccauuuauaagaaaaaaauugaagauuaaaaaacgauuacauugggaagaaauauuuaacaaacacacacauguaacuuuugaaauauugccacugcuauuuuuaaucagauuuguuaacagaaggauuaaacuuccucugaauugcauguucaaagguuccuguaguguaugugucuuccaaaaagcagaacacuguccuucauuguauuguuccauacauaaacaggcugugucuaauuaucuuugcauucugauuaaaaguuaauaaagaacuuggaaaauucuuuuuuuaaacuaauuguauauacuugguguucucacuaggagaauuuauaguagucauacggaguccuuuaacuuauuuuuuucucucuugaaaaccaauuauauuugauucuuauaauuuuaaucauuacaguuuccucccuuaauuaccacuacauuuucagugaauaaaguuuauaauuaauacucauauauuuuuacuuuaaaauguauacugccucuaaagcaauugaaaaaaauagauaaguacagugaaaagaauacuagaguaggagugaagagaacugcauucuaaacgaaacucugucagcagugaguugcauauacucuguaagucagccuuaguucuccgggcuucaaauugacuggucaauaacuaaguaaauuuuuagcucucugaucacgcuuuggagugaggcugauugccuuaauuuuucagcucugguaauuaguggauuugcaguugggggcaaaucacuuaauucuucugagccuaagauccacugccuguuaauuaaaaauuuaaaaaauaauaaugauuuaaaauuuugaaagaauuacuugaaauaacauauguaaaacauuuagcauagagugugguuccuuacaaacgguauuagaucuuacucaugauucgcccuuuuccauccuuuaucaacccugcaagcaacuuuuuuucucuuguaugaugaucaaagaaugucccucuuccaucaaaggcugaaccuuccauuuauucuuugaauucucucuugcuuugucccuucaagaaggucuacauagccaacauuuucauuaucauuuucucuucggcauccccaguggcucccuguucucccucgacccaauauucuucuccagcuguuuuucucuuuuaucacaacaccaaauucaaaagagcugccucccuguucuaagucagcauucucucucauccacccuugauccugucugucaacuuccuacuucaugaaaacccuucucagggucauggacacaucccacaauguaaucuagcaaauauucucgugucauuugguucaacucuccgcagcauugaccucugauuuugucuuaggacucuccccuaugucagccaccucuuccucgccaccucuuccuccugaguuuccucuuauuacuggguuacuaauuuuaauuucuuuugacaguuucaucauucuacccagucucuacuguuagagucacuuagagcucaguccuggguguucuaacaaugauuucucugaaaaauauaaucuguucccaugaacucaagugccauuuuauggugcuuaugcacaaccuuuaacaguuaaauuauugauguaaauagauuggaaauacagaaguuagauagacgauagagacagauucauagaacacuagcuaccacacagguaagugacugcccagccuugaauccugguucagcaacauccuagcuccacaauuuuacggaagucaucuaaucucucugugcuuuaguucuaugucauaagauuauuagaaaaaauuaguacauguugauuccuuagaaaaaugccuggccuauuauaagugcuauguaaauauuuaauaccauugcuacucucugguauaaauagguguuaugugggccaggcgcgguggcucacaccuguaaucccagcacuuugggaggucgaggcaggcggaucaugaggucaagagaucgacacuauccuggccaacauggugaaaccccaucucuacuaaaaauacaaaaauuagcugggcgugguggcacacgccuguagucccagcuacuugggaggcugaggcaggagaaucucuugaacccgggaggcggggguuacagugagccgagaucgugccacugcacuccagucuggcaacagagcgagacuccgucucaaaaaaaaaaaaaaaaaaaaaaagugcugugugaauauuuaauaucauugcuauuuuugcuauaauucaguuugugucacuccccuaccuaaaacccuuccuccacuagacuuagaauagaauucagcuucuuuauuuuuagcuuacaaggccuuacaugaccugacaccaacuuucccuccaucugaacucauaccacccagcuuguucuagucacauggguauuuuugaaguuccucagauaugaaaacauauuucuugccucaagggauuuugcacuuaaucacuugaccccacucugccauucacaggcugcuccuucacacucuucgggaugaagcgugucuucuuaugaaugaggugcucaauggcgacuucaucuguggcugcuucccaccucccugaccccaggugcugucuaccuuggaccucauaccuuaccuguuuuccuccuugcacuuuucacaauguaauaauuuauguguguagcuuuguuuucguuuuucucguuagaauguaaagcucaagaagucaggauuccaggcuuuguuuucaccguguagugcaucauacuuaauaggcacucaaaacuauuuguacauuaugagcaaauaacauauaguaaaguaguuuuuauuucaaaauaaaguaaaauuuccaaagaguaagauccauagaaaaagcacuguguuuuaaaaucagugagaguauucaagcaauacacacaaaaccaugcauaaagaggaggcgagaguaaaaguuuucugcaugucuauauaucuauuuauauauuuuuuaauaaaugaagagaggaaugaauacuauuugugguguuuguggaguaccacuaauagucuaugcuucuaaguaaagauauaaaauuccagcucaugauaaaauacaaaucucacuugcuuacaaaacuucaaauaugcaguacugcccaauauuuuguuucaugccuucauauuuauuuacugucuuuuugagcuuccauaaccgacauuuaugucuucaauaggcuaaucgugacuauuguaugacacaccucagaagcuuuagcuugccaaucagaugaaaucuaauuucccacuugaaaauggauccugaccuauaaagaaccacugggaguaaucuacucuccaccagagaggaacauaaccauucgacacagaaucagucuuccgaaagcugugggguaccauuuagcaauuuaccuccucuggggcauuaauugcuacccuagagcacuggaagaguuaauuuaccucauacagugaacacuugaauccuagagaagcauacuuaguuuaguucaaaacaggauuaagacagaaauugaaaguaguuuaaaucauguacuaugacacauauucaagugaagaaaauacagucccuugguacacgugggggacugguuacagaacccccagguaugaccaaaucugcacauacucaagcccagcagucagcccuacaaaacacacauuuacaaaaaguaugcccucugaauaugcaaauuuugcauccugagaagauuguauuuccaaauggcauuuagucgaaaaauaagcuguauguauguagagcugcacaguucaaaccuguggaguucaugggucagucguacuguaguuaagaugucauuuuucuuccacagguauuucaggaauuugucguucuuaagggaaauguccuuuucucuugcuuucaaaacccagaauuccugcuacaaaauauugacauguuugcaauuaacauaggguacuaagcuguucuuaaacaucacgauguuauauguaauuucugauaaauacuaauagaagaaaaugaaugcaccugacaaguguauagugucuugaguuaccucaguaucacuuaaggccacgaauugaugaaucacuguuucaugucagugacuggggaaauaagugccacuucaaggggauacguuuguuauacaucaauuuucuugauagugaaaaacaccuggagaauauccauuagugucauaauauaccauuauugcagucgaaacacagugguuuucaaaauuuaagccccagaauacaguggagcugcuccaucugaacuggaaucuggggauccaagaccugcucacuugauauuuggccaaaucacccaagagcagccugagagguaccuuucagagcuaaaggucuuuagggcaaauacagcuugcaaacuuugaauaugguaacauccacauaaauugcucucuaaauucaacaaaauguaacucccucuauucuaaaccuucauagcacuuggauuucgcaugugauauucuauacuauuaauaagucuguguuuuccacauuucuauuuuaaacaaggguuuauaucuuguucauauuuauguuuccuugugacguuuuuacacaguaguaguagaugcucauuaaauaugaauuaguuaacuaaucaauuaaaaucuuaggucuaucuuugugcucagauguagaacugauaucaugaaaggauuauaacccacucacugaaagucaaaugugucuagcugacaccugaaugaaaaggaguuugcgggcaaggaggcaagggaaguguacuucugucaaaggagagagacacuggaaaggcuuaacacuggaaagaaaauagaaaauucaggcauucgaaaguaggucagaauggcuggauuucagauuguaucagguagagaaacaguggaccuaaagcuuacacaggcuaacagaauucugguacugagguguacuuuauuuuauguuaagaaguuugcauuuuauacuaagguaauuugaaccccuuaagcaaagagaaguuuuuucagauuuauaaaucaaagagaucagucagaccacaauacuuuacucuggauuaaaagggaagaauauuaaagucacugaauuuauuugagauaucaucacaacuucuauugcugcugcaaaacuucacacgcccacacaugcaugcgcacgcacgcacacacacacauacacacacacauauauucacauagaauuccuuuuacaaagucacuugggauacuuuugaauuuaagcucauaaaauaugcuauuacauuauaauaagauuaauauuaacauuauuuaucagagccuauaauuccagaauauuuuagcaaaauagugaaauguucauagagauguuauguuuuccuacaacucuaccauaaauaaauaaagcccuauauccauaauaacauuggagugaagagcagcggcaaucagccauggcaaucugucagugaacaagggcuuccccuaagguaauaagggacaauaugcuguuucuucauuagaauguucugugguuaccaaaaauuucaagaguuagaaugacagcauaguggaguuagauagacuuuagagaucguggaagccaagugccugauuuccacagaugagaugacugaagccuuaggaaugaaaguaacuugauucaugucuucauaucuauuucuugaacacagaagagaaaguuuugaaagccuugagagguuuuccucaacuucccagacucauuacauaaaaaauuauauguauuuccaaguggcaugucuaugccuuaugcuucauuacaauggcauugugcccagucucacacauucacuucugaaaauuccuauucucucuaaauuauagggucaacccucugauuuuagaauuucucauguaguauaaucaaaauaaaugggacuauacuuccuccuaccauaaaauagucuuucuaauuaagaugaaccacagcaaagagaagauaacagcagcugcuuugcagacaagauuuaggacuaacagugaaaucuuuauuguuggcaucauccuaguaaggcgauguaucaagccccugauuuucuucaccuauagaaacagaauccaagaccuccuucccacuccagccucauaacccagcaaaggaggaggauaaacuacuggcuuucuuucucauuuguagauucuguuucuuaaccuaaaaucauaucaagcucaguuuauuuuaaauuuagugauuaguugaaucaucauuuuagacugcuuuaaguuguuggauucuuuugaaauuagaaaaagaccacucuucaaacugguuaacacucucuagaauaaugaauucuaaucaacaaucuuuagcuugcuguuauugaaauucuauacauauuaauacgaucuuuccucaaccuucauaauccagcuggaauaucuuccuuugaucuuucuuucauuagucuccacaggucugcguugagugaaagaaaauuaaguuuuuaaagaauggaaguaaguuuuauuuagaaguuuucuugaggacuauagacuaaagucuacaguccaggaaaaucuuuuagacagguguuucuucagacucuuuugacauaggguuuuacuuuauaucuauaucugaugccuacggaucauaaaucaagcugcccaggccaggcgagguggcucacgccuguaaucccagcacuuugggaggcugaggaggguggaucacgaggucaggagaucgagaccauccuggcuaacacggggaaaccccgucucuacuaaaaauacaaaaaauuagccgggcaugguggcgggcaccuguacucccagcuacucgggaggcugaggcaggagaauggcgugaacccggcaggcggagcuugcagugagccgagaucaugccacugcacuccagccugggcaagcgagcgaggcuccaucucaaaaaauaaauaaauaaauaaauaaauaaaauuaaauaaauaaauaaauaaauaaagcugcccagaaaaugguaugguguuugaguuugcagaacucuuuaaugugugguuguauaguccuguguguggcggggggcggggugcauucuuuuauguguauacuucuuauuuguuuccuugaugaagacuuuuaccuggagaugauuguuuuucuuguuuaaauauucaguuaagucaagggaucaauuuuugauucugauguuuacauauagguaaugggggguuaguaccuguaaaauuauauuaaaguuuggauguaacaguguaucuuaccuauaagauauaacauauuauuuaucagagccuauaauuucagaauauuuuagcaaaauagagaaauguuaauagagacauuuuguuuuccuacaacucuaccauaaauaaauaaaauccuauauccguauuaacauuugaaugaacggcagcuggaauuagccauggcaaucugccagugaacgagagcuuccccuaagguaaugagggacaagaguauaucuuaucuauaagauguaaucuauaagcuacacucauauagauuauaugauaagauaugaucuuauagauuauaugauacugauagauuauaugauucaugauuacagauuauagaggcauaauuuuuaauccuaucagacauuauuuuauguuagaaaaaagcaaugauuagggucauuuauuuuuuaaggaauacugacucaugcaagagacguagugggguauguuuuauuuuguuucgaccucuuuuuuuuuuuuuuuuuuuggagcacuguauguugucacagggccaagcgcuuugggaaauuaugcugggaagcagaaaugagcaaagguggcuucuuauguuugcuauuuugucccuucaauaucauuucucucccaaccugagccugagcaucugaccuuuaggcaaaccauguucuaaggaacucagcugugcuuacauugaacaagauguuauaauaacuucagucauugcacguuggaugcugucguuuuugcagaaaggaagcugugcuugaugagaugagggaaauacuggcaaaauuguuuucuguguagaaguuguaaccauaagcagcgaccuggagaaaagucauuuacagugggcucccagguugucaugcuuaggagcuuaaaggaaaauggaaaguagaauguuuaaagaaagugcguguguguguuugaagggaggaggaaagguuugccaagaucuaguaaagcugaaaaccaugugaaucaauauuuuacaugaaaccaugauccacuucuccauccaaacucuagaaaaucucuaacugcucaguuaggaugaauugaauaacaugauaaaacaaaauggucacauuuauccauuuugcaucauuuucuuucuuaauaaggauuaaucuuacuucacauucaaauugaggugaaagaauuuacuuuguauugauguucauuagcuuauugauuccacugucuuacacugucuuguucucaugucaauguuugagagaggauguuccuguagcuggaauugagaacaggaaguacacaccucccacacccccacaugaagaagaacuuauccacaggcuauguucgguuaaaccuugaagcuauuaauuaaugggcaauaaggauaugaaauggggaaguacaauggcagggcccugucagaagaccucugaaagguaaaaaaccagcaucuuaaagguuagaguucaagacuuugcauucuaaaugcaaagauuguuagaauuauaaacacagguuaaaagccuagaaucucuuauugaagaacuuuaaacaacaauguacgguuugcgaguacaucugaugucuacagauagaauuguccagaaaauggaaugcuauuugaguuugcagaacucuguaauguaugguuguaaacucccguguguguguguguguguguguguguguguguguguguguguauucguauguauacuucauauauguuuucuugaugaagacuucuagcugaagaggguuguuuuucuugcuugauauauuugguuaagucaggggagaagcuguauguguaagaauaugcauaccccuuaucacuacagugugcaaagaugagaucaaugcuuacaaaauguagaguacuuaagacaaacaaugacagaauggaaaaaaaguaugaaaaguaccaguugggucaauagacauuucucucuuuuagucacuccuauacccaccaacacauccaaaauuuaaaacuacuugaacaagacaaaagcaaaaaucaucauaauaaaaugaaaugauauuucacaaaaguauuguggacuauguagauuuaugcacuuauaguaucuaacuguauuuaaguaggaauuaagcaggaaguagaacaucccugcauuauuuucuuauggaaucucuaaccaucaucugcaugagcuuuauaaauuauggaagagacuuauugucacaaugcaggacaaauagcucauuaccagaggccauuuugaaagauauccaacacccaugaguaacaugauuaacugauuuuaaauaugcacugcugcgaccacaggggacuuuauggacuugaaugaaauaaagccuagaagguugcuccuguguucuccuguguuauuggaaccccaugcuguuaaauaccauuuacuucaguuaucugacacuauuagcacacccccuguuggucagcuaauuagacauaaaccuacuaaacaaaaaugaauuuuuauguacuggcuauggcuuaaaucaaguuuuugauauguaaauuaucaucuuguuaaaguuuaugauuucuucuauguggguacagaagaagaacauauaaagaaaaacaguccacaagaauaauuugauuugauguguaugcaauuggaacaaaagaggacaaacagcuaaaacuacaaacccauuuuuaccuuacuuauuuuuagaaaucacaguguccucugagacuccuguuauacuguacauuugaauauguaacaaaacugacacauacaaccauguugacuuguaccacugccaaguaggacacaccugaagcuagugccaauccuuuggccaacuacaccacucaaaauacaaauauuuaugccauugauaugccucauauuuuccuccuuacuccacugaauuucauuucacaagaauauacccaaagacacaacucaauuucuuucuccuccuucgugauuagaaauugaaucuguagagaaagagaccagguugcccacuauauuauaugauuauauggucccuuaaaggacuaacaaaauaggggccgggcacaguggcucacuuccguaauccuagcacuuugggaggcugagguggguggaucaccuaaggccaggaauuugacaucagccuggccaacauugugaagccccaucuuuacuaaaaauacaaaaacuagccuggcgugguggcaggugccuguaaucccagcuacuagggaggcugaggcaaaagaaucaccugaaccugggagguggagacugcagugaacugacauugcaccacugcacuccaggcggggcgacagagugagauucugucucaaacaaaaaaaaaaaaaaaaauacuaacaagagaggaacugaagaauaaaauauaccugugucuacaauaauaauuagacugugucuacagaaauaacuauaaugucucacauuuagguguuuucaaguuuaauuuuauguauaucuuauaaaaaccuugcaaggcagaccacgcaacaggaugucuguuuacgcauuuagaaucuaaagcucacaguggauaaguggcuuuaucaaagucacauaacugguaaguagcgaaaaaugaacaagaauagauuucucugacuccuaguguugaauuaucuucaugaguaguuaucuaaauguggagcacagaguucuggagggcugcagauuaucucguugaguguaaagcagaagucuuacuaauaguuuccucaauuuaaguuagcaguauaugugaagggccuauggugacuuagcuaacguuaauaaauauuaucuauuuuuaugccuagcaauauuuuugaacaaauacagcuuuuauuguaauuaaugcauuauaaacuuaaauuguaaaucaauuuaaauaaagguuuguugccauguauuaucuuauucauacagaucaauaauuauaacucuuauccuacagaggaguuuauuauuauuauuauuauuauuguuuuaauaggcccuaguaaucuaagagguugcaaaucccagugcugcuacuaccuuugucagguguauggauauauaacauacuuuccagguaaaguuucccaaggagcuugacugucaugcuuaguucuuauuuaagaggauuucaaacuaccuuaguagauuugaaaauuuuuuaucacucagaugccuauuagucuacauugccacauaagcaguugggauacaagucugaggcuuucaggagaagacaggauuagagauauaaauuugggaauacucacugaaugggugauuuuuaaaugcauaaaacacuaugcaauccaugaauguagauaaagaggcccaagcacugagaagaauggcaugucaacaauuggaguucaagaacacugggaaaagagugaaauaugauccauaauguaaaaggaaaaucaagaucaaguaaugucugaagccaagugaagaccguguuuuaaggaugcaaauaguucggccaugucaaguacuacuguugagucaagaaagaugaggacuaagcaugagacucagugaggaggaggcauuaauauguacggcauugacaagaauaguuuuuguagaaaguuggagacgaaagccuaaucagaguaaauuauuaaaaaugagacaagaaaaauuaaaaccauaguacuaacaugucuuuuuuaagaguuucguuguaaaguuugcagagaaauaagacauccccuggccgggcgcgguggcucaggccuguaaucccagcacuuggggaggccgaggugggcagaucacgaggucaggagaucgagaccauccuggcuaacagggugaaauccugucucuacuaaaaauacaaaaaauuagccgggcgugguggcgggugccuguaguccuagcgacuagggaggcugaggcaggagaauggcgugaacccgggaggcggagcuugcagugagccgagaucgcaccacugaacuccagccugggcgacagagagagacucugucucgaaaaaaaaaaaaaaaaaaaaacagaauuaugcuaauugaaauuauaagagaagacuauaucuauuucauuuuuuuuuaccucaguugucauuguuuauaauaaaucucccaaagaugaggaugauuucauagaaauguuauagauuuuacacaccaugguaccaaaggaguaagccaugggccgauuaaugauuaugaaaucauuuugaggaaaaacaaagaaauguauuauucaggcugguuguauauuuuaucuaccaagucuguuuucuaugacuguuaggcuuauuuccaaaaauucaaaucuaauaucaaacaauggaaaucuuacaugcuuaagauaauaaaaggcauaugauaaauuaaaaagaugacuauucaauaaauaguuucaauuauuuuuaaucaauuacaucauuguuggaauacgugugcaagauccaucuaagacuauucuaaaagaaagauguuaaaaguauuaaaaacauuguuuuauguaauuauuuuaauuccagcuauauuuauacaaaaauuuuaaauauaauaaaauguuucacuugaaaaacugugacgcuguuacaagaugaauaguguacaacauguaaauacauggaaauacaaauaaauuccucuuaaugcgauauaaaaaaaguaaaauugguuaaaaauuuggacucugaaauucuguaugugugccccaacucugccauuuuguagugucaugaccuugaaaauguacuuaacccuugaagucuucuuuccucuguauguaaugucuauguuuugacacuuccuaacacagaccaauauuuagcaaggucuuuuaacuccuccaaauacguuauguuguuuuaaaacucaagagagcaauagagacuggacuuuaccuuucacaguuggggaauagaggugaugauuuacaacacagaccucacagcaaagaagucauaaugucauuuuagaaagcaguauuucuuccucauuuuugucacagcaauaaaguuuagaagaacuuagauaaugcuaaugacgauggcaauauaaugugagagccauuuaacuuagaaaaagcacaaaguuaaaacaauaaacaggaacugaguuuuuguaucauaacaaaauaugguuaauucaacugucugaacauaaaguaaaaaaauuaagaagaaucaaagagguuuaguugagggguuuaaugauacagguaaacuuucuaagacauuaauaagaguauucauguuacauggauagacuucuaaggaauaaguaggcaucauuuaaucaaugucaauuuaauauaaauacaacaugaagcauuuuugcuguuuugaaauucuuacaaauugauuuuucuuuaaaauaagcaaacauaaaaacccaucaaacaaauucuuagacugauguacacuugguaaccuugauaauuuugcauuguuuccuuaaaauacacauuauguuuuuauuugaucagccaauucuucugcaaucagauuucauugcaacuuuuuuuucaaguaaacuuauuuuauuuucucaauucuuuugacccucagucuucuguucacaugaaaauuuuuuuuaauuuuauuauuauuauacuuuaaguuuuaggguacaugugcacaaugugcagguuuguuacauauguauauaugugccaugcuggugugcugcacccauuaacucaucauuuagcauuagguguaucuccuaaugcuaucccuccacccuccccccaccccacaacaagccccagagugugaugcuccccuuccuguguucaugugcucucauuguucaauuuccaccuaugagugagaacaugcgguguuugguuuuuuguccuugcgauaguuugcugagaaugaugguuuccaguuucauccaugucccuacaaaggacaugaacucuucauuuuuuauggcugcauaguauucuaugguguauaugugucacauuuucuuaauccagucuaucguuguuggacauuuggguugguuccaagucuuugcuauugugaauagugccgcaauaaacauacgugugcaugugucuuuauagcagcaugauuuauaauccuuuggguauauaaccaguaaugggauggcugggucaaaugguauuuauaguucuagaucccugaggaauugccacacugacuuccacaaugguugaauuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggacagugaugaugagcauuuuuucauguguuuuuuggcugcauaaaugucuucuuuugagaagugucuguucauauccuucgcccacuuuuugaugggguuguuuguuuuuuucuuguaaauuuguuugaguucauuguagauucuagauauuagcccuuugucagaugaguagguugcaaaaauuuucgaucaacuggaagaaaggguaucagugauggaagacgaaaugaaugaaaugaagcgagaagggaaguuuagagaaaaaagaauaaaaagaaaugaacaaagccuccaagaaauaugggacuaugugaaaagaccaaaucuacaucugauugguguaccugaaagugacacggagaauggaaucaaguuggaaaacacucugcaggauauuauccagaagaacuuccccaaucuagcaaggcaggccaacauucagauucaggaaauacaaagaacgccacagagauacuccucgagaagagcaacuccaagacacauaauugucagauucaccaaaguugaaaugaaggaaaaaauguuaaggguagccagagagaaaggucggguuaccugcaaagggaaacccaucagacuaacagcggaucucucgguagaaacucuacaagccagaagagagugggggccaauauucaacauucuuaaagaaaauaauuuucaacccagaauuucauauccagccaaacuaagcuucauaagugaaggagaaauaaaauacuuuacagacaaacaaaugcugagagauuuugucaccaccaggccugcccuaaaagaccuccuuagggaagcacuaaacauagaaaggaacaaccaguaccagccacugcaaaaacaugccaaaauguaaagaccaucaaggcuaggaagaaaacugcgucaacuaacgagcaaaauaaccagcuaacauccuaaugacaggaccaaauacacacauaacaauauuaacuuuaaaugaaaauuuuuauagaugcauaaguuugcaauuagcucuucguuuuuguuuucauuaugccauaaguagcucagacaggagagaaguuagaaaugagagcuacuauguuccgggugaaauacugcuguugaauucguucuuagguaguaaugagaauucuaugauggcaucugugauugucacaccuuaguaccggacaccuauguaugaccucguuccccacccacauccuaccaugaauauugacagaacuugugauuuauuucuggcgaauagaauuuggcagaauuuuuuagauguaauuaggaacucuuacaagcugacucugaauuaaucaaaguggaaaucauccugaauaagccugaccuaaucaggcaaacccuuuaaccaagggcccaggccuugugguaacuuacuaugaacuaacagaaaagucacacauucugauuuuaagcucagcuauauuuaaaacugcuuuauuaacacgacaauaaaaaggaaggguaauacaugcaagauuauuugaaacugaugaacuuauaagaagaaagucuaucucuuauucaauuguuuuugucuuugaaaauuaugcacuauauacaauaguuauaaauuaaguauauuauauauaauauauaacauauauuauauauaaucaugagaacaaggaauuuuuuuaaaaaacaucuuaacacccauuguuugguguuaacgagacaagauaucgaaaucuguuaacauuccuacugauagcagguaaaaagcagaugauauuaauacaucagaaauguuuagugaaaacaaacuuguuauuccaaacaagugugauuuaaauauauaccaugacacuuaacagcauaaauaagaagaguuauaaaugcuagagaaaaguuuucaaguaaaacuucugaauaaauuaauuguaaauuaauauacacuuuggggacuauuuagaauccuaguuuguuuuaacuuucacuaagguuauguguggaaauuuugcuuuaauccauguuucuguggcuucuuauuuauuuauuuugaggcagaguuuugcucuuauugcccaggcuggagugcaguggcacgaucuccacucacugcaaccuucacuucccagguucaagcgauucuccugccucagucucccaaauagcugggauuacuggugccugccaccaugcccagcuaauuuguuuuuuuauauuuuuaguagagacaggguuuugcuauauuggccaggcugaucuugaacuccugacuucaggugacucgcccacuaggccuccuaaagugcugggauuacaggagugagccacugcgcccagccuguggcuucguauuuauuaaaagccaguguggaaaaauaauaucauagagugguaguaaguuuauguuuuuagcaaccacaacucaucucauucccaguucucugaacuagcuguaaaggcccacagauuuuuguuuagucucgcagggccguuaauaaaacuccaacugaugauaacuguuucagaugcaggcuucuuagaauuuccgaaguucacauuuaaagaauuuccuguggugggcauguaauguuucacuuugaaagaaacaagagaagaaaaugcguggcucacaccuguaaucccaacacuaugggaggacaaggagaguggaucaauugagaucaggaguucaauaccagccuggccaacauggugaaacuccaucucuacuaaaaauacaaaaauuagcaagguguuuuguugggugccuguaaucccaacuauuugggagucugaggcaggagaaucgcuugaagcagggagguggagguugcagugagcugagaucacaccacugcacuccaggcugggugacaaaacaagucucugucucaaaacaaacaaacaaauaaaaaaagccaaugcugacugagaaauuuaacagagaaaaauaacuuauuguaagcauuuuuuaaaucucagaauuuuggaggguaugaccagucaguaggauccaugagauaaaaaagaugcagaagcuugacaagaugacuucucugggcccuucaauuucaguaaccuaugauucuggucucugguugagcuguugcuuucccaacagggaaguuaggacuuauggugagacugauucacauugauaagaucugccugggcucuacucccuucuugccucaaucucugccugaacauucuuccuauuucauuuccuacuuugaaaucuuuuuuucuccuccaucucuauuuuuauagcauucaaaauaauugaacuaagcaugccaaauggcacaggcaggguuuuuuuuuuuuuuuuuuuuuuuacagaguauggauuccuaaccacacuauccuggcuuuccauugauacaugccaaagcacuccaaacuacggcugcuuacgaacuauaggaacauuuuauuccaccucgacccuuuuagucuugguucuguauaggaggcauauuuuucaucgaucccuuucuuucuugcccagaagggggcuccaaaaaaaaauaaaauaaaaaacaauaaaaaacaaucaaacaaaaaaaccuuauucucccaugacacagauuaauggucaugcacuaucgguccucuggagcagcagcccccauccauuuuuggcagcagggauggguuucccaugaaacuuggguguaggguaaauauuucaggauggaacugucccacguuagaucaucaggcauuaguuagauucucucugucucucuuuuucuuuuuuuuuccuuuggaccgagucuugcucugucacccaggcuggagagcagugaucuucugucacccaggcuggagagcagugaucucugcucacugcaaccuuugccucccgggcucaagcacuucuccugccucagccuccugaguagcugggauuacaggcaugcacaaucacucccagcuaauuuguguauuuuuaguagagacaggguuucaccaugcuggucaggcugauuuugaacuccugaccucaaaugauccacccaccuuagccucccaaagugcugggauuauaggcaugagccauggcacccagccaguuacauucuuacaaggaauacacaacccagcucauuugcaugcacaguugacaauaggauucacucuccugugagacucuaaugccacagacgaucugacaggaggccaagcucaggugguaaugugagcaauggggagcggcuguaaauacagaugaagcuuuccuggcucaccgcugcucaccuccugcugugcagccugguuccuaacaggccacuacagguaccagguccacggcccagggguuggggaccccugcucuggaagaacucauguguucuuuaucguuuuuacuaugaaguuucucucuuaugaucugugucuugcauuaauguuucccccagcuccuuuauaaccuuccugugagaacagugcuuucaucucacucauuuauacagaggcagagcuuugcggaggucuuaauaagcacucaauaaauauguauucauuuauuauucauggggcugcaugaugucaucaacuagauaaagcucacuuuucaguagaacugugagacuagugacuaguucgugucuuacauaccguuucuugcccugcuccucugccucugccauacuacuaagacauagcuucauuuacccuuuacauuuuguuagugucuaaagcaaaauaccauuuucuuuugguuucuuuuuuggacacaaagcaauuagcagacauuuuuuguaacauucuggugguaaaaauuaugauguuuaaaauugcauauugaaagugaaguggaguggaaagaaaugaaugguucuaagguaucaugcugaccuugucaucaacaaaguguguggcaguuugggcuucucagguuuuguguggguguaagaaugagagagagaguguguguuuucucucuucagcguagcauuuugugcuauaaagauaguggaaaagcucuaucugccuuggccuuugcugaguggcguauugagauugaagagacgucaacaacagaaugaccucaacggucuuaucaggcgcugucagcaaaccuuguauaauuaacccaaaggacccuaacaugccuuuaagaacaaucucuuuguuuggguucuuccuuucaccucgacucucaaaucccacacaguacaggagaaaaaaugcaaagugauuagaacauaugagugaaaaacauagcuuaaauuaugcauacacauaaaaaaugaguaccauuaucaggccaugguaucucuugucaauuuuauaucuuauuaucuaguccacauccaguccauaauaaucaaguacaaccaccaagccacuuagaaagaauguaugccucucuuucuuaacaauuugcacuugaagaacucuguuugcuaaauuuuaaauccauuccaauuaguaguguuagcuauaaaaaugcagaaccaucuguucauugaccuugcauucuaacauuucauauuauucuccagacuguuccaacagcucuuucucaacuuaguuaaugccagacuuucauaucucuagucauggguauuaauuuuaccagaauuuuuaguaauuuuuugguguuuucucuaaauguucuuaagguauguaacuacuggacuaaauuguuuaacugccaggcugaagauaauauucuaguuaaagcuaguuggccgggagcaguggcucaugccagcaauccagcacuuugggaggccgaggugggcugaucccuuaggucaggaguucuagaccagccugcccaacauggugaaaccccgucucuacuaaaaauaugaaaauuagcagggcaugguggcccaugccuguagucccagcuauuugggaggcugaggcaagagaauggcuugaacuugggggcagagguugaagugagccgagaucaugccauugaacuccagccugggcuacaaagugagacugugucucaaaaaaagaaaaagaaaaaaaaaaaaagcuaguucaauaagauauaugggagaauuaacagauagcaacacugcauaaggaaguuugaaauaucauuuuaagauacauaugagaaaguaauuguauuucaacuauguuuuuuacacuaaaugaccuuuaguuuucuaaauuaucaguuaggauaacaaaaacuugucauaagagggauaauuuaccuugguaaauauaauaugcuggaguuucaaaucuaguaaagauaguuuagagcucacuguuuggucucuggcuaugcugauuuggugauaugguaaccugaaaacauucucuucagaauuuugguauuguagugaagaaucauugcaacaaaaaaaguuuucuguuucaaaguuaaauagcaggaaaacacugcuuuucaauucuuuuuacaauagcuucuucucuauuuccuuuccucuuuuaucuuuagucauuuauaauuuuuuaugauuaaacagggguuauauccacaaauaugauauuuugaaaacuacagaaaacuaugauaaaauauuuauauuguucauaauuucaacagaaaaauuacuguacaauuuauuuaaaaaucauaucuuauuuugauuuuagauuucucacugacauuuucuccauuuaccaauuauauauagauaagaguaaaaacuaacauuggucuaaaacauagccuuuacuuuauuuuaugcuauuaaaaaauaagcaauaauuuaacaaugcaacaaaugaaauauccuauauuuuacauacauugauaauuuaaaaauucuaaauugccuuuuacacaauuuauaauucagucaucucagauugucuuaaauaaauucauauuuuuaauagcauauuuuuaaaaaauccucauuuuaaauguuucaaguauuacugcaaauuccuuuucuuucuuucaaaauaaauuaauugaaguuggugauuucuuuaaaauuuugccauauacuuuaguuugcacagaugauucuaacgcaugagugugguuauuuuuacuguauugaaggccauugcagcaaaggcggaacguaucagaugagucaaacauauuguacauuuaagauuuuaaaucuuaugcugaugacuguuuucuuuacacgaaaaaaaaaagacagagagagaaggugugaaauuaagucacucuugucaaaccucagauuucuagucuggucagagugggaauguucucuaagcguguguuuccaaauaagcaaaugcuaacaucuaccaaaauuuucauccacuauucuuacacaaaucuucauaaaauuuguuguucaucuuucagcaauaagcagaagaaauaaucuauuagagaauaaaguuaacauugaaagauauauagcccagagcagaaaacaaaaaacaaacaaaaaaaaaacaaccuucuuuaccaaacacaguaacguuugaaaaacagaaaaaauggaaaggcaucuuguguuucuagaucccaaguguggaaaaugccuauugcucaugacuccagugcaguuucacuugcugcacaguguggugugcuugagaagcaauucugcauucuaauucugcaguuacauuugaaaaacuaauaugaaauaauagccaagcgaauuuugcaaaugaagaauaauagagaaauaauaucuuacccuaaaauguuagcaugucuuacaggcauaaaauaauugaaauguugugguacuagcauaagaauugacagacagauaaaugggacaauauagcuccaaaccagaacucaagauaguaaguauuuagcacagcauuacucaaauccuacacgucuuuauuacauagauacaccuuauucuguguaacaagaaggaaaacaucuauucaauuaaaugauaugcuuuuuaauaucuagaaagcuuauuuuuguugcaaguuuuuuacccuuaauuagugauagauuuuuaucaugcauauacauacaaauuuauaaggcaaauauauuaacagucuauaauuacuucacauuuggaauuuaacuugucuaaaucacuuuuagguuuagaguucuugauguuugugcuuuuccacacagugucaucccuuggguuacaaagagcauugguuaugugguauuuuugaagagcuuuugauguuggcaucugacaucugacuuugcaauuauguacgagcagucaacuuuugauuucaacuuguaguauguugguaaaacauauuagauucaccagguccuucaaauacuucugcagcaauuugguaccuaggguuuucaagaguacuccacuaucaucucugaagaauaaucuuccacaggaacacucauucuccaaguuuuaaggcugagguauuugagguuugcacaugcacagguaaauggcaagcauaaucugacucaaccuccgugaccaugauuuuuagaguuuauuuuuagaguuauuuagaguuuauuucaacaauccaguugaaauaaauuugucuuacaaucaauaaaauucaaugugcuacaaacauuaagaaugaaggcugcaaauauaggauuuucaauaaaguacuaaaauguuuuucuuaaaaauuuuaaacuauuuguaggaaugaacaauagugccugccaaaccuaccccaaaagaugcuuugagaaucaaaaugcauucaggcaugggcauaaaacuuuuuaaacuacaaagcacuguacagcauguaauacccuaaaaggaacauuucaaccugucuuuguguucuuuuguuuuucagggguuuuuuuuguuuuuguuuuugaaauuaacacuagaauuaaauacuaaaguugcuuuuucacagcuugcuuuucugccuaauuauaaagcagauuuaucauuaaaauaauuaaaauccuguuuuucuagcaauaaguaagcauuauuacuauguuaugugugauuaaauuguuuuacuuguauagcagcacgauaguacuacugcacaaaauugucgcaacuguuuuucuaucuuuccuucauuuuacaugcugauacauugcaugcauccugucaucuaugcuaaaauauguaauaaucagaacuuguuccaagucuucaguauaauggaaaguacuuacaauccuuacugaauccuuuaauugcaaugaaaauuaguauuaaaauaauuugauucgagauauguaggauuuaagaccuauaauuuuugcaugaucuaucacauuucuuguaaaauuuguuacuuaacaaauuacauucugaauaugauucaaauuaguggcauuucauuuaggacuuauaaucugaucauucuguaaaaauugaucaggcuuagaaaaauaacaugaauaaaauaagauaguuaaaaugaaaauaaaaugcggacauguaucaaaauguuuaaacaaaaggauagauaaguucacuuuaauaacuauuaaacauuauuaucugaacucuuagccuuuugcagaaaggcaaaagagaaaacguagugaauuacacuuucuugcugauaaaaggaauuucaauagauaaucuaggaagagauauuuucuucuugucacuacaacuagacagacuuucuggaaaaauaucagucaguauauucaauugccuuuugcaaaagugaaguauucuuuuauuaccacuuuuauauuaucaucaauaaaacauuaaagcacagaauuaaaucuuauuuuagcaaauauuugccuucccaaaacucauaaaauaugauguagggacaggucugaaaccaacccauaaggcuaauauuuuucaggcggagauaaaauaagaaucuuaguagauccgauucuacuuccuuagggcaugaucauggcaauuuuaucgcuaacauuuguuaaccuagaccaguuuuugaaggguugccugcuuagcaaauaaaaauacaggauguccauuuaaauuugaauuugagauaaauaacaaauuuuuaguaagacccaugcaauacuugguacauauuuauacuauuuuuaaauuauuuaucuaaaauucaauuaagcuauguucuauauuuuaucugucaacccuagcuuuagcauucuguuuucuuucauuauaagaauaaggucaugaugagauuauucaggaaaaaacaucauuaauuugguuuucauaagcagcaaacaaauauggaaaacuuugaaaaguauuagauguuaggaaagccaaguugcuuaaccaaaaaaaaaaaaaaaacaacaacaacaacaaacaaaaaaagguuauccugucuccugaguuaaaauuggcuuucaauaugauucauuucucucuucaacccuauguauuucuuuuuuuuuuuuuuuuuuuuuuugaggcggagucucgcucuaucgcccaggcuggagugcaguggcgcgaucuccgcucacugcaagcucagccucccggguucacgccauucuccugccucagccugcugaguagcugggauuacaggcacccaccaccaugcccggcuaauuuuuuguauuucuaguagagacgggguuucaccguguuagccggaugguuucgaucuccugaccucgugauccgcccgccucggccucccaaagugcuggcauuagaggcgugagccaccaugccccgcuguauuucauuuuauguauuuaauaacauuauauuacuccgaggaggguguuuugugguuuuuuuuaauuagacugacaaauggaccauugcacgaaaagaguaaaauccccuguuacugguucuaaacaaagcuugaguaaagacuucauguuauaucacuaggaguuucuuggcuucauucacaucuacuuuuguuuauucauaauuuccauauagaccuaaguuaucugccaguagcucuaguuacauauauuuaaauagauauucuugaaauauguaaauacaaaaaacuugguauaaccaaaugacccuauuuccagagaugguauuaauagaauaugcaaguucaauauacaaacauucaacauucauguaacuauuaucaaagauucacaaaauccuaccuucagccuccucuaugaauaugaaaauuaucuuaggacaugucacuauggaauaauuguauaucccauaaaagaaaaaaccucaacgucuggguaaaucaaacuuuugguuucaucaaauuugaagggaauuuugaaguaucuuuuuaaauagaaaauuuaaaagcagaauuuauuccucugcaagcccuguguauguaagucugugugugcaugcacguauguacacgcauauguguacauauguacacauagcauuauacuagauucuauggagacaaauacaaacacaaugaaauuucuuuccuuauggaguuuuguuacagguuugaagaagagagagauaaugacugagagagacagagagaccucccagguucaagggauucuccugccucagccucccaaguagcugggauuacaggcaccugccaccacgcccagcuaauuuuuguauuuuuuuauuagagaagggguuucaccauguuggccacgcuggucuugaacuccugaccucaggugauccacccaccucggccucccaaagugcugggauuacaggcaugagccauagugccuggccugaaaccuuuuuuaaaaaaaaaaucuuuucuguaucuaauauagauuuugcuugugguuacuaugaggcuuauauaaaauacacuuguaacaggcuauuuuaaacugauagcaacuuaauucugaccacauuaaagacucuauauucuuaaaaagaaaaauaaaaaaaaagaaguucuguuuaacucugacugggcaguggaacaugggguaauuauuuucaucuaaggaauaagaaggcuucguagguaaacaccagcugagcaaauguugagccaugaguggguauuaacuagguaaggggaguggaggugaagcauggaagaggaggaaaaugcauuccaggcaaagaaaacagcaggcuguucaccucacaccagaaaacuccucuauuguuuuccaaaauuagaugggcuacgaguaauccucuauugauggucuuuggacuccauauaacuuuauaucugaugcggagaagcaucagaauaaucacucuuuacacaggacugauauucaauuuaaauacgugcaggucuccaucuacaguaguuaaaugcucacacauaaagcacagagucucuguuaguucuuggcuccuagauccagugauugguuuguuccucagcauuugcuaccaagcagauugacagaaaaugccagcauuuuagaguaauacgugugcaaugcuaggacuauagaaauauauguguguacuuuggacagguaucuguaaauguuaccuaugccugccccagaaaacacaguuucucucugucucccccagcccccauauaucuguauauccauuuguccccucucuccucucucucaucucagcaaaugagaugauggugagaggguugaaaaggccaucuuugcagugauaggaaagcaaauccuucagaauaaauguuaccuggaaauaucucacuauuuugcaaaagucauugccuauauuauuuucuauuuucaaggaucaaauaccugucuuuggcugucauagucuagagguuugccguuuuaccauuucaaacucauuuauguguaagguauaauugugcacacaugcaagauacaaauucuucuuuuaaauauugguacauagacuaaugaauaaaaucauaaucauaggcugggugugguggcuaacaccuguaaucccagcacuuugggaggcuggaaagcaggagaaccgcuugaacccaggaguuugagaccagccugggcaacauaaugagaccucaucucuacaagaaaaauuaaaacaaacaaacaaaaaagccagguaugugccauauuccaguggucccagccacucaggaggcugagguuggaguaucacaugagccugggaugaggagguugcagugagcuguguucaugccacugugcuccagccugggugacagagcuagacgcugucucuaaaaaguaaaaaauaaaacaguaaucgugugcauuccaagauaaaauaauuaaacaugauuugaauguuaacugauuuucuauuuacugauuaggaucuagcccuuucucaaacuagcaguaguuucuucucacuuuuaaaaacacucuuuacguaguuuguuuuuuuuuuuuuauguuagaacaaccucauguaaaaucauggagacacuaagaggacccaaauuuguacauaucccagaaguaauaaaguaauccacuuguguaagugcuaacauuuaagcuuuaaauuuuuuauuuugaaauaauuaugaauucacuagaaggugcaaagacagggggguccuggguacuuuucaucaaguuucugccaugaauucauuuaacguaacuauagcacacuauuuaaaccaggaaauugacauugauacaauauauguauauaguuuauaucaguuaaucacauguguaagguauaggcacuaccacaaucuaaaugcaaaacuguuccaucucagacccauccucucccugcacuacagccaugguuaacccaugaccaccacuaaucuguuuccaaucccuguauugucuuuauuucaagaagguugugaccuuaugagauuggcuuuuuucacucagcauacugcccuugagauccauccaaguuggugcaucuaacaacacuuuuguuguucuucuuguuguuaggucuucuuuuguuuuugcugagcaguauuucaugauauagauguaccacaaccuguuuaacuauucacuuauugaggaguauuuuaguuuuuccaguuuagggccguuaaaaauagaaaugcugugaacaaucauguacagauuguugugcauacauacauuuuuuacuuucguagaugaaauauuuuuaguuuugauaaaguccaauuaauucuguuuuuuuuuuccuuuauggauuaugcuuucgguaucaugucuaagaacaugucagcaggcccuggggcucaaaaaugugccucgauguuauauucuaaaaguuuguaguuuuauguuuuccauuuaaauuacaaucaaauugagauaauuugguagaacuuagagaaaguucugggugaaagaaaaaucuaucuuuaaaucaaaaguauuucuguggaagcauuucuaguaaauuaccgagagcuccuggaagaaagggaccuauaucuccaagccuccauauuuugguuuugauuacuugucucacuauagauaaauauuuacauuguuuuuacuuuuuuuuuuuuuuuuagacggaguuucacucguguugcccaggcuggagugcaauggugugaucucggcucaccacaaccuccgccucccagguucaaggaauucuccugccucauccucccgaguagcugggauuacaggcaugugccaccacaccuggcuaauuuuguauuuuuaguagagacaggguuucuccauguuggucaggcuggucucaaacucccagccuuaggugaucugcccaccucagccucccaaagugcugggauuacaagagugggucaccgcgcccuggccaauauuuacuuuuauaucauguuuuauauuuuuaauuuuguguuccuuguuuuaaggaauagagucucccucuuccccgaccccuaaauaacauuguauaaguauccagucucuaacaccuucucuaugguguaggaaacauucagauuguguguggaaaugcaugugaccuaaaaguauauaugaacacuuguaggaacaaaaugacacaaagaagcuacagaguuagaaaaucauauuaaaagggagacuuuuuuuaaaaaacgugaaggauggaaaaggguuuuaacuguuugcuucuauuagaccuuucuccagagaaaaccgucaaaagcaaagcuaucaaagagauucuccaguagcucucagacagaacaacaguccaaagggcucuucaagagaaaaucuaauguugggaggcuccuucuuauagugagggcacagaggagggcuccuucuuaagagaaggucaacuacucugcaagugccugaauuuggucgucagcucaauagcaagaaucucgagggacauuuuucugucuuguuuagcauuucaguagcucuuuuuuaaaauuacaucucuuaagaauuuacauguaauaaaauguauucauuuucaaugugcauauggagaaauuuuagaaacgguauauaucaucauaacuaacacuacauucaagauguugaccacaguauauuuuugucauaaugaaaacucucaacauauagguuuugaugugaaguucagaacaggguagaccagcauagucaguggaaaucuucaaaucauuuaccaguaauuucugagcauuuggccacuggcagacauuuugcuagguacuagggaugcaaagauaaaaauguaauaagcucugacuucacaguuuaaugagaacucaaagucuuaugggugagagacacugacucuacuacaagugaucaaaguggagggaguuugggaugugaucaaugaggguugaaaacuguauaacauuuugccugcauggaaggggugcaagaauagaaaaggugagugaggauauuaaccuacaugugcagggaagcaaugaggaauaauacugauaacugaaguggggcaugaacagguucacaaaugugugaauguuauucuuucaagucauaauccaagagagggaaaguaauacauugcuuccacugaaauacccucuucauuacacuugcagaggaggagcagaaguggugacauugucaugggaccugagaucucuuggaggagaaauggauaucuacagguagaaagaauuccaucuuugaugguuucaugcauacaauacagaaaaaaaaaauggcaugcauacaauucauaaccuuuuauuuuucaaacucucaggugccaugaaagaagacaggagaacuagcuagugacagauuuuaguucuauaagaaucucacaaauaauucuugaguguuggagacugauuggaugcuuuuuuuuuuuuuuuuugagacggagucuugcucugucgcccaggcuggagugcaguggcacgaucuuggcucacugcaaccuccaccugccggguucacgccauucuccugccucagccucccgaguagcugggacuacaggcgccugccaccacgcccagcucauuuuugguauuuuuaguagagacgggguuucaccguguuagccaggauggucucgaucuccugaccuccuaaucugcuuuccucagccucccaaagugcugggauuacaggcgugagccaccgcgcccggccagggcgcuuuaauuaagcugcuauaggacuuccaaccuucucuaugccucuugccuacugaguuuauuuugccgaucucugaaucucaaauagaaugggcuucuucugcuaugguggagacuggguaacuauucaucaaacuuauuuuaucuucuuccuagucauggaucaggauuauauuuucuggaaccuuggcagauagguauggucaugugacugaguuuuaaauaaaugcauuuauuccaggacugacccuugaaaacuuuccaggcacaauucuccauauuucuucagucuaguacagauaagcauggugauccuagaagccaaugaugaggauuccauagacauuggggaaaugagcuagagucuuugaauuauugcuuugaaaagaguuaccaaccgaaaguaccaguuuuguaaaugagcaagaaauaauuuucuaucauguuugagccaugacaccuuuaggaauuuauuuuuuaacacuuguugccuuaaauaaaauacuccuuaacugauauuaauaauaugauuacuaagagagaaaugugacuuggauuugaaaauggauuuuuccucuccuuacauaaaaacaugcaccauggaaaacuaauacucagugagaaauuaaauguguguuauagucuaagaaguuaacauacuuaauucuuacuuuuuuuccgggcaugagauaacaggcuuguguuucuacucugauauucacuggcuucucugagcagugcaucuuuacuuauaguuuaggucaacaaaacauuugaaaauucaaaaguaaauuacaaucaucacccugaucacccaacauugcaagaauagcugcaucauuuugacucuuaaagcaguuucagguugauguaaucuauucuucuacaagaagaaaugggggccgggcaucguggcucaugcuaguaaucccaacacuuugggaggccgaggcggguggauuauuugaggucaggaguucaagaccaggcuggccaacauggugaaaccccaucucuacuaaaaauauaaaaauuagccaggcaguaguggcacacgccuauaauccuaccuacucgagaggcugaggcaggagaaucacuugagccugggaggcggagauugcaguaagccgagaucgcaccacugcauuccaaucuggguuacagagugagaccugucaaaaaaaaaaaaaaaaaaaaaaauagaagaagaaaaagaagaagaaauugcccucagguucuaaucccucugggagcacuuuaauucauuuaccccucauaguaaauuuggacaugcauagaaugauacuuucuggguuagggauauguuucacaaguaaaaaucagacaagaaucuaggauccaaaaaaguaaaacugaaaaauuauuuucauguuaaauaauauuuacuguuggcuucaaaaaugaagcauguuaaugaacaguuaauucucaagugaucauuguuuauagacaauggaagccuguauuaacgauucacuuugacuuucauagauauagcuuucuauuuggaaauuucucuaagaucugauaauucaugcuuggagauaauagaauaugugacauauuucuaaggauaacugcugauuucggauugacuagauaaauaaaucagaaauuauucaaugaaaauaacaguuggcucaaaguccuacaacaaagggcaugcauuuucaacuuuauuacugcucacauaauaguuaagcuauuauauuuaauuuaaguuuuccuuuaggcaaucaauuuccuguuguuuccaauuuuguuuuacagcagaaacaaacaguaugaaugugugaguuuuacuauuauuuuuauauguuuauuuuugaauaaauaguuuuaaaauuaaacaaucccaagauaaaaauaugcauucgauuauaaaaguuaacaguuugaguuacuuugggccuucaauaauaaaaauuuuacuacauuuuuagaaauuuaaauuuaguuauauaauaaauuuaauaaauaaaauagauacauguauuuaucagugggaucuuugcauaaauauaccauauauauuuguguguguaucuacauagacaugcacacauauguauauauauuuuuacauaaauacacauacauauauauguacgugguaauaaauaacugagaauuuaaagauuacuuuuaaauuuuucaaugaaaaucuuuuaaaaauaugugauagccugcuuccuuuagugaaacaguucuuugaacaugcuuuaacuuguucucagaaacauuaaaagcaccuucacguauguaauaauuauauucuacugcauuaacauuaaauucugcauuaucugugugaccaguuagagaugacugcacauucuuuguuacuccuuccauugacaaguagaguccaauuucuauuuaugaaacaugcuuccccaacagaaugcagcaggagugauguggaaugucagaggugaggucggcagagacccugcaguuuuuuuuugaguuuccuuggaacacuggcucugaggccaaucagcagccauggagaaaguaugaugcccagaacccaccaucccacaacaaacccagaccaccuggaggaccccuggaggaugagauaccaaacagcaaugagucacuagaccuguaauaaaucccucaucugcaaguagauucuccaguucugacugcucucugauguucaaaguccucuucugcuuacucugaucugagccuauauacugaauaacugagacagccagaaaucacacugcuggauaaauggaauauacucaauaaagggccgaauaauuuauaugauaguugguuauuuuuauuuuuuuuuuuuuugagacggagucucgcucugucgcccaggcuggagugcaguggcgcgaucucggcucacugcaagcuccgcuucccggguucacgccauucuccugccucagccucccgaguagcugggacuacaggcgcucgcuaccacgcccggcuaauuuuuuguauuuuuaguagagacgggguuucaccguguuagccaggauggucucgaucuccugaccucgugauccgcccgacucggccucccaaagugcugggauuacaggcgugagccaccgcgcccggccaugauaguugguuauugaacaacaccuucugaucauugcuuauaucuuacaggcaauuugguuauauuuuagaccuuagaaucauuaaagcauaguauuacuuuucuccagaaauccucaucacaauuauaauugggcuaauugaaaagaaaggaugaggucccuguacuggcccggacauguaauauauuacuagcacauacugccaauaggcaaauuuaaaaauuguagcugccuuuaacauuuccccccauuuuugucgcuacuauccuaauccaagccaccauaaaaucgccacuugcuuuuccuccaacagccaaguauaaaccagccucaggguuuuuggucuuucuguucucuuucgaugaaaaguuuaauaaccagauauauguaugguuuguuucucccuucauugaaguaugagaaaggcuuuucuugagcacuuuaaauaaaauaaaacccuccauguccccauuauucucuguccuuguaucauacuuuacuuuucuucauagcacuuaucaccacuugacauauuuuaguaauuuuuauacauacaauugauugugugcucugugagaacagguuuguuuuauagccacccauaucaccaccuucaaaaaagauacaggaacuuugugaugcuuccagaaucuaaaacagugcuugucauauuacuggugauaagaaaguacuugucgagccgggcgcaguggcucacgccuguaaucccagcacuuugggaggccgagguggguggaucaccugaggucgggaguucgagaccagccugaucaacauggagaaacccugucucuacuaaaaauacaaaauuagcugggcaugguggugcaugccuguagucccagcuacuugggaggcugaggcaggagaauugcuugaacccgggaggcggagguugcagugagccaagauugugccauugcacuccagccugggcaacaagagugaaacucugucucaaaaaaaaaaaaaaaaaaaaaaaaaaagaaaguacuuguugaaucaauaaaugagauuuuuaacgaagaaaauauuucagcauaaugaaaaauaaaguuggagaaaaauaaaaaacuaaauuauggggguauaaaauuugggaaauaauuuuacacuuugaugcaguagguagugaagacucguuauauaaugcuugagcagggaaguaauguggcuauucaguaccacaguuguacauagaaugccuucaaguuagaagaaccuuagguugggcaaggaggucagcuagaaaguguugcaguaauaccgauguguuaaaagaaaaggcugguuggugagaauagaacugacuuaaaauaucauuagaauuugguacauaacaagagaguagagaaacugacauaauaaaaaucgaagcugagguuuucaagugaaagugacuggcaauauauuggcaaagacacuuggcaacauuaaaccaaauuaaagccagcaaguauuuauuuaauacaugcuauaugcaagacuucugcuggacucccaaaauauauuuuuaaaaaaugaguaagaugaacacucacgcuugaaguaauacugggcaaagauacaaaugggcagcuagccuccauauaugucagaugugagcacaaauaaaaagggaaagaacagaaaagaagaaauaauuuccauagccacuuauggagaggaugguauuuuuuguuuggaacaugauagguuaaaguuauuuuaaaaauggucugguuguaauuuuggcaaggagaauaugucuuguuauuaaucaucagggaaacgcaaauccaaaugacaaugugauagaaccucacaccuguuaggauggcuguugaccacgauguagagaaaagggaacccugguguccugcuggugggaauggaaauuaguaaagucauuauggaaguuucuuaaaaaugaaaaauaaaacucccauauggucuagcaauccuacuucuggguauauggucaaaagaaauaaaaucagugucuugaagagcuauuugcacucucauguucacuguaacauuuauucaugauagccaaauacauaaacaaccuacguguccuucagcagauaaauugguaaagaaaaugugguauagaaacuuuagaauauuauucgguaguaaaaaaggaaaucauaccacuugugacaacauggaucaaucugacaaacauugugcugagugaaauaagccaggcacagaaagacaaauauugcgugaucucacguagauguggagucuaaagcaaaaguuaaauucuugguaacagagaggagaauggugauuaggaggagcugggggcuggagagaagaggagauacuggucaaagaguacaaacuuucauuuauaagaugaacaaguucugaggaccuauauacaauguagugacuaguuaaugauauauuguauacuucaaauuugcugugagaaugcauuccaaguguucucaccauacacacacacacacacacacacacacacaggucgcuaagugaauuauggauguguuaauuaacuugucguagucuuuucacaauguacaaauuuaucaauauaucacuuuuauaccuuaaauauauacguuguuucuuuauugaucauaccucaauaaagcuggaaaaacaaaggagaagauauuuugauagaacagugguccccaaacuuuuuggcaccggggaccaguuucauagaagacaauuuuuccauggacaggaggggauguuuuaggaugaaacuguuucaccucagaucaucaggcauuaauuaguuagauucucauaaggagugcgcaaccuagaucccucgcaggugcaguucaccauaggguucgugcuccuaugagaaucuaaaugccaucguugaucugacaagaggcugagcucaggcagcagugcucacuugccugcugcucaccuccggcugagcagccacgucccuaacaggccauggaccaguaccggucuguggcccaaggguugaggccgccuuuugaagacacagauuaaacugagaaaaacacuucaguccaccauacguccuguaguuacugucagcuagugugaaaaucuuuccucuaacagauacuacauccuuuugugccucuuucuagcaaugucaaauucucuuguucuccuuauguuaauguccuagaaaccaauucaaagucuugaaucuuagguccugcccaauuuauuucauggaauaaagcucuuaauccuucuacuuaaaauaggacaugcuuaauauucuuuuuguuuccguaucaaaaguucacuuuaguuaaggggccauuaauuuaucccuuuuuauuacaaaagccacugaggaugagcuaguuuaaaauuaugccaccauaaaaauugaccuucaaaaugcauugggcauuuauagcuuucucauuuguugauaagcaaugaaacaauguauggacugcuugcuagaugaacuguaagucauggauguggcuuuucaaauuuuaauuucauuuguaguauuucaggaguuacauucuauuacaguugugaaauuuugcagaaugaacagaagagaauuuguguuuaucaaaguuucauucuuucugugcaaccagauauacaauuguguuuauuacuuaagaguugccuucugccaucugccugaugcuaauuuucuuguaaauuuaauguuuaaccaauauuaccacuucauuguauacaaacaguuauauagcauauuguuuacaguacagucuacuauuugacuaguucagauugcucuuaaaucaaaauuuuguguaagcuccacugaaugaaauggaaccauggaguccuauaaauauuaaauaucuucuuuuuuuucuucaaauacccuugaauaauuaaguuuagggaauuagugaaauuucucccuugaucccuccaucccagugagauuuuacuaucuauauuauuaccaugucagauuuuacuacuugcaguauaaaauaaguggcaccauggucuugaauauucuacagggcaauaguuccauuuuuauacuuuucucugggggaauaaaaauauaucagauuacuuauuugcauaggaagagaaauauuuucuucgacauaauugacauaaaaauauaauaaaugaaaugugaauuuccuuccauaagaacugaacauccaauuuacagcauguuaaccaacugguuacauaguuaacaaauuuuagaucaagcuguuucuaucacaaaggugauaguaaauuaguucugugaguuggcugccaguagugcugcccagagcugucauaauuuaaaauaaaaagucgccacucuuuucauccacggagaugcuuuucuguggcaaaaguuugauugguguauguaccugucuaugcacuuuaauagcuuccugcggcuguggugugucaucaacauacacaaaauuguaaaugggauauuaaaugcucaauuaccucaauuuuauaacacaaggaauaguaccaagaaguauacgacagucuuguccuacauggauugagggcuauuugaauucauuugcuaucagcaaauggcauucacugucauguaacugauucaucaaagcucugacauggaauaaagauucaggagcauucaggaaaagagauaugcaaggcuagcuccaaaacuuugaaaugcauuaauucguuuugaagacuuugagaaaacaaacaagaauaguuuauugauuuucugaaucguguauauaaaugagugaaaaauuaaugcaacaguccuuccacuggcaucacuacaaauauguuuuuuccucugcauuaucaggcaugugugugugagagugcauguguauguguaugcgugugugugaucuuuaguaaaauaggauuuugagaaauugaacagugagaauauuuguuagaucuaccaugucugagcauugcauuaagcacuuaauaauuaccuauaauuguagauagaaucauuaacuuagaucuuaauacuguuaguuagaauauaacuuuucaggguuuaagcaacauaaacagggaaauuaacauuuuucuagccugagcaauucuuuugaagacugguaaaguaagcucaguuuguggccagauggauagcuagacaacaucuuaauaaacaugucugaugucaucauaucaugucauauuuaaccgugaaguuaauuauuauuacccaaacuaugugcacaugaugugucuuguugacccaauuuaaauguuaaaguuuuuuuuuauugaaaaugucuuaagcagggaaaguaggaaugaaggaagauggaaagaaauauggaaguaaggaaaugaugcauuaaauaccugucaugugccaguccugccuauguucaccuccauauucauauuuaaucucucucucucucccugugugugugugcauguguguguguguauaggggggcguguccaucugucugucuuuuuccccuucaguuuuucaacugagauucuaaauagaaauuauacaaggggcuauaaaaacauauguaaaacaggacaaaaggaaagacaauauucaguaagccauguagaucugaauauuguagguuuucauuggccggagaaauaccuauaugcaaaauggggaagaaugcaaguugaauacauuggcuuugauucacaaagucagaaauaugacuuuuuuacuacuucuuaauauuguacauauauuguacauuuuaagaaacuuauguuauaauuuuuuaaaacucaucaagauuuuucuacuuucuaauugucuuacauuugauguuuugcaaauauaaauuagaaguauauugucuguaaucccagcacuuugggagguugaggcaggaggauuucuugagccuaggaguucaagaccagccugggcaacagagugaggcuuccucucuaaagaaaaaaaacaaaaaauugguaguagugugcaccugugguugcagcuacucaggaggcucaggcgggaggaucgcuugauuacagaacguagaggaugcagugagccauugcugugccacugcaauccagccugugcaacagagugggaaucuguauccaaaaaaacuauauugucauuuuuacuauuuuguuuuauuaaguaaugauccaugauuuuugacuuccuauuuucuuauacuaaaauugcauauuccuauauaauugauuuucaaguucguuuucguuuugguuuugauaaaauaguuuuauaucagcacauauauauauauauaauuacucuuccaauauuuuuguagccuucccuacugaaauaaguuaauuuuuggaaggacaaaggaagaaacauuuucaaaguucaugauaucauuaaaagaggggaauauauauuuauuagaaaaagcaaagcaauuaaaaauagaauaaaaugauagaugauucaacuuuaaucaaagaacccugacugaaagaugucaggaaucaauguaauacugaaaggaaguagaaauccucugccaucuaaguauuucuacuacgucuagagaaaaguaccagauacugcuaauuucaauuuaaacaggagacacaggggaagcuuuugugagaguggcuaggaaucacacagcaaaacuaccaccgaugaugugucuauuuauguaccuucauggucuuaacugaaugagagcaccauugguuacaauaccccaugauaacucucccuacuuagguuucagaccucuuagguuaagccuuacucuuuuucuuuuguuuuguuuuguuuugcuuugcuuuugagacagagucucucugucauccaggcugaaguguaaucguuccaucucagcucacugcaaccucccccuccuggguucaagcaaaucucccaccucagccucccaaguaccugggauuacaggcacccaccaucaugcccaagccuuguuaucuuuuuaaggguauuuuaaauucaaauaauucccagaguggcaaagcaugaugucacuuuaagucuucugagaguuaguuuaccaaugcacaguccuuauaagagaaaugucuuuaggccauaugacgagaaauaaauacuugagacaaaaagaaucuggggagaauagaaagggauguccauuacaucaaagauaaacuuuauuaacuucauaauugcucuuagggucaagugauacagggaauggagcaauguuaauaaaugaugcauuuauuaugaaauaaggaacucuauguguucuagauaccaguuuucccuagaagccuucaacuguaagaauagguacaagcuauuccuucaggauuuucuguaauaaauguuuauuuugaugccuuccuggaaauaugcuuguccuauaguuucuccuagaagagcaauaccucuucuccugaacaauauuauuuauggaccuaucauagauccauauuauggauaauauuguguaccuauuuuaugaauuuauuauuuuaaugugucuguuuauguuauguaaggaugcaaggauguuuagcauagaggcacucucacaguuuuguuuguuuugauuuugucauuucaugccuauauagccguuaacuuucauagcuguuguccuuggucucugucaaaaucaguacuguagccucuguuuggucagcauuauacucggagucuuuugaucucaagaauaaagauauugcauaacaccgagagagagaucaaagauuuuacuuucuuuuauucccuaucaauuacaauuucaaguacuagccagagcuuugacaaagaaccuuuagacaaagcauaauuaaugaaaaggaaaaaaauaacauucucaagaaaauaccuuucaacacugcauaaucacuugccuaauggggacgcugguaugcuuugcugaagaaaagcaaucagauuuuuaucccuuccaguucccaugaaaagaaaaacuucuuacacggcauuuccaaaaacuuuaggucacauauagguaauuuuccagaaaaucuccccauacacauuagaaauaagacauuuaauuagauggcauauaaggcucuuuuggcucuaaauccaaagacucugaugaugcuauauuaucugaaagauaauauuuuguaagaaaaugacucauuuucauuauuuucuaaugcucaucagcuccucucuccuacuauaauaaaagcaaauucacacccucugauuuccaguucauaacccauuauauguaucaugcgauaaaccauccacuagaaucaaauuuucuauuuuggccucaaugucauuaacaccaccucuauuauuauccguuuuuguguuuaugcccugcuuccuuuccccacuguacuuucaucuauucacucaacaaauauugagggaagaccuacugagugucaguuaccgucauagccagcaaaaaaaaaaaaaaaaaagagaaugaacacaacagucuccucuuauucacaggagaaaaaaagucccuaaaaauaaaagaggauccaauagauuucccaaauuuaaauuuguauguuucauucugagacugcaccuaugaaugaaaucauucuaggauacaagcaacaauaccuggaagaaaaccuucccugaacauuuagauaacugcuacguuuccagugaaaacauuaugcuuguaaaaaucauaaaaugccucuaaacaucaugcacauuuuuaauggaccagcugagguacuaccaaagcucauacaucugaguuagccgucccuuguccuguuaaaaccuggaaaggggaauucuuuacugugaagcaggcaauaucuuuuaucugacagugcaaauacuggcuguuucaggcagcuaucagugacaugcucuaaaaugugcccuaacaugcaugucacuagauugaaaccacuaguauuggccuuaggcagaauaaaaagugaagguuaccuaauaccuuccuuccccucaacccacuccagaucccuuuguccuuacagcaugguuuucccuaugaauuuauuuccauguggccuggccauuaugaagacuccaagguccaugaccuguacuaaaacaauaaaauuacuuuucccugaauuuuuuuucauauuuaaaugauauaucuaaaaacugaaaagguuuagauuacaaaggaaagaauuucagaucucauguaaaauugcugugaaaaaaagaaauaauggagccacuaaucccauacagaggcugcuuuccauucuagauauuuuaaacuagauuacuugugccuuugugaccacagaugaaaaacauuuuccuucuugagauuuuaagcauccacacucagaagaaccucuuuguguguguguagaacaucucuuuuccuagcuuuguccaucacucccuugccccaugguauguccugacuuagagcuaugucgcuuuauucuggagcaaaaucacacugagguuaagucugcauuccacacuccauucucuucuguuuuuaaggcggcugcagccacuguuauuugccauauucucaauccaaggggucuguuaggagguagugcuucaaaagguaauucaguagccugcuuuuguucucaguguggaggaaggugcaagcucagugaagcacucaggcaaauuaaacaagagggaucugagauccacacagugaguucucuccacuccaaaggcucagagggauguucucgauuuuaaagugaaaaccagauagaauggcacuaaucuuuccaucccuaaaaaguaaaacaaauuuaaaaacuucucguuuuaauucuuucauaauuuauaucugauucuaugacaauaaaaauacucaaaggaaauaaugccccauuuaaguacuugauaacuugggguuuguuuuauuuuguuuuuuaaucuuugguuucauuucggcuacccuauuuuaccccacuguuuuccuaauaagcgcaucaucaucuuuaagguaaaaauauuauugaccuuaaaaaucacaucauguuaccuuauacuuuacuuuacaauauuuuuuugaaaauuauuaugaaauuggucuguuagucuguuuguaaacacugaaaaacuugguagagcuucugauaagaacucuagaacaaaaguaauuuuaauagcccuuaacugauaucuguucuuuaaaagauauuauaucuuuuauuuaauacucaauauuuauuucauuguucagaaaaucuuaacaauauuucauuuuuucccuguuccuuggaaaucaaaccauuuagaaaauaacuuuuauuuucuuuauaaaucaagaauuuuuuuaacuuuaauguuugaacucagcaacucaaagaaacuugauugaauuguaucaguggaaauaaaaaaucccuuucuguauuauuuuauacuuguauaaucagaugacuacucccugcuauguuuuggucaauuaaaucaauccaccacuuugaaaaccauaggagcuaucuccaaacccucaguaugcuuaaagggaagaaaaaaauuaguucugaucauagagucagauuccuaggggaagaagggaaggaagaucaauucacauuguaaccguaacaugaaaauaaaugaaacauuucaagagguacuauuuagucuggugccauuuucuucuucuuauguauaacauucugccucaguauaauaaugaauuuacguaacuuguuccugaagggaaagaaagugaacuauuuauaccccuuauccuauaagcauuauauuuuugcauuaacaucuuuuuuggaguauaacuacaacagccacucuaggacaccacacaaaacagaaacaaaaccucaaacuacagagguauaauaucugcaaaguucagguuauagcuagaaaaaaauucaaaauuaaauauaugaugauuuauuauuacaaaaaugacaauuucaaaacaugaugucaauuuuuuaaugauauaauccucaucaacauuuuaaacaauuuauacucagagucuuuuuuugcugcaguaauggagaaaaaauauuaauucagaugucuguuuccaaauaaaaccauuaauggaguuuuaauuauuuuuguacuaaaacugggguggggggggcgacaguuacauuauuuugcuuaccuaugaaauacauuaagaggaaauuggcauguuuacuguguaaaaucaaaagaaugaacucgccuuuuccucccuucauguagcagaacuguggugucacucaagggacauauuagucagcagcugacaacacagccaugcccgaacgaugggaaugcagacacagcccagacacuugcuguccaccuacauuagaucagcuacacagaaaucuguuuucacuaacacacacuaaaauaaacacaaucagauucagugccccacucaaauuauuuaauguuaaugaacaucaaacagaauaaucaauucauguuugaagccgaucacaucuuaaauaugcauccauacgucaagccuggcuucaaagaguauaagaaaucaaaacaaugugaguucaaauuuaugagcuguacacuuuuaacacauuugcuauaagaagugaguugaguauauuuugucuucagcauuauuuucuaacauuuguuuguccaauuuguaccccggucuacuaaaaucucucuuguugagaaagucuuauccagacacauagauucaagcuuuuacuacuauauuuuaaauuauacuaauaugauagccucugaaaaugaugauaugacagugaaaucccuuuaucaauguguaauuaugacaaguuuuuuaaaguauuuuuauugcuguggaucuauauacaugacuuagaguacaauagcaugauguauucaaaauuaaaugcaugcugagaaggaaaaauuaucauuuaagucuuagaaagacauuaaaauccuaagcacaguaaaaguuaucugaccuagaggauaaggaggguucugugaugccacaucuuaucauggagaacaaaaagauugaggcauucgagaccaacaccucuagagccagguugccggagcucaaaucccaccccuaagacauguuggaucugugacagugggcguauuacucuaccuuuugugccucaguuuucucaacugcaaaaugggauaauagaagagauaucugucuccaaggacuguuuuggcugucaaucgguuauauuuacaaagcauucauaagaguuaagauuauacauacauauuauguauugcauuacuuuauuauguaagauuauuauauauaacauuucuauacugaauucuaagguauccuaacaauuuacauauuuaaguauucagguauugccaacuguguuacaaaaauuuuauacacucccuccacaccggcuucaccauuacuccauuugaggaguaauggugaagacauucacuguuuuaaaugcuuucuucguaucuucucucuugaaacaagaucuguuucuuuuacauauaccugcauuuugcuuaagguguguguuuuccaaacacagaguguuuguaaauagggagagaaggcauuaaguugaacaaucauucuaaauauuaaagacuaucucuuuuuauuucacaggaaaaagugauaguaugugccuaaucauuuucagaagccuauaagacauuuuuuaaauuuuuaagugacguauauuuugucuuauuuugccuguauaauauauugacaaugaaguaacauggcauguuuaucgguaugaaaaucagaucaucuacaaugauaagauuguuuuaagaugaaagcuuuuuauuuuauagcuuuaguagaauucucaacacuuuauuauuuuaaauaugaaaaacaaucaaaacagaacuaaauguguaaaacucugauccauuuugcuauauauuucauaaucauuauaaucacuaguuuacauccaauaauaguaugauaaaaauguuaauuucaucuuuuuuuuuuuuuugagauggagucuugcucuguugcucaagcuggagugcaguggugcgaucuuggcucacugcaacauccaccuaccggguucaagcgauucuccugccucagccuccacaguagcugggacuacaagugcgugccaccacaccuggcuaauuuuuuguauuuuuaguagagaugagguuucaccguguuagccaggauugucucgaucuccugaccucgugauccgcccuccuucgccucccaaagugcuaggauuacaggcgugagccgccaugcccggccaauuucaucuuuuuauuggaaacaaugccucaaaaaacaagcuuuacauugcuuugauugaguuaacuguguguacuucuucaaggaaagaugacauguguaauguuagcuugaacuucugcguauucuuucugccaauaugacagcaucaguaauugcauagcaugcuuugauccaauacagaagaaccaauuaaaaaagaauagcuccaguuuuuaacuuguagaaaauggagagguuuagaaaccuccuauuuuagaaaacaggauggcuaaccauggaaacagaacagcuuaauuguauuuguggcagacugagacgaaaucaguaguuuccagaucaugugaugagugccuauuuauuagaauaaauugcuacugcugaaagaacuauacaaaaggagugucagaaaaggaaaaaacacucucagguacaacaugcaggaaaagaaaaagagggauuuauuucucuuuccacuugacauuauugucaaauuauacaaagauucucagaaagaugggacaaaaaaauacaaggcaguauacuggauuuagccugucuuggaacuuauauuagagcuuaguauagaugauuaccuauuugcuuguguuguuugaauaauuauaaauuuuguaaugauucuuauaaagucaacugcuaacuucuaauuuuaauguauugcauuuauaaagaacauuauaaucaaaggaaauucaaacaugauaaucagauauuaaaauguauaugaauaaauaaaaagggacuaagaaaauacaaauguuuaucaaucuucauaacucuaugacguaccaaguugugguauuauccaucaugguaugcgguacauaacacaauuuucaauugaaaguguuuaguuugagugauuuguaaauauguauugaaugaaugaaugaaugaauccccauugaacaaggccccuaugcuucuggauucagugucccuccucugacgaccucccguaggugggugagaagagcagcagugccccucugauagagugauagcucuuggaaagaguaggugugcuuggagaagccacacagugauuggaguaguaguuuuuauuaaaaaaaaaaaaaauuaaaaaaccugaacacauuuaaaacuucugucauacaggacacaguuauaaauagaaaacauccugcuuauccuuugcguaaacguaucuuauggacguauguuaaguauguuccaccauggagucuagcaacuucucaugaccaaacacagcuucaugaaaguuaucucccaccacggguggacuuaugacauaauuuuuuuuaauauguaauuuuuuaucacccccgggguccuaauucucagcccuauguuuugguuuaagucuuuuaucuaaauaaccaauaugacucuuaccuugucucuacuugacucaucaggaucccaaacagugaaaugucugucgguucaagacugcaggguucagcauuugcauaaaaggcucuaaugagacauuuaaucugaccuugcaucuguuguucagccucuuuucucucuccuuuaauuucuaaaacugacaagaaagggaagcaccaggcuuuaucucuuucacuugaagaucaagaaagaaaaauaaaauaaaaauguuaugaaguaacauuugggguauauaggaacaaaaaaaaagcugcuuucaaaauacauuaucauuaucuacaaacaauuacagaugacuugauaaacaaaauaauuaauacagaaggcaaauggccuuuuuaacuuaaaaugaaauaaaaagauuaaaaggcauugucuaaaauuaaaucaugagagaaaugaucauguaucuucuguguauaguuuacuugauuuguuucaaaaaacugaaagaaauaagcaguuaugucuuaauuuagagacuuuuuauaauuucaaaugggcagcaauaucucaaauuauaagcacuuuuuaguuuuccuuuuuaugaaaagagagaacagaugaaugucugucuggcccauuucaaucuauuuucuuuuguugcuagaauuauuacauucuaaggcaauucuaagccacaagaagcuauagcuguaacaggaaauuaaauauagcaauuaaccuaaggcuacucauaauugauagcauaaagcagaauucaugaauuguaguaucacuaauugaaaaaauacaaauguauaaacaaaauguaaauaaacacaagucaaaaauauucaacacaggaagucagcaagguggcagagaggagacucuugaugcucccuccucccacagacacaccaaguaaauagccaugaguggaucaguucugucccagagaaagccagaauccagcucaaagacuccuacacaccugacaacuaugaaaauacacccaaaugaguagaaaaaguggagauacacucaggcauaaccccacccugagcacagugccuuacauuuggaaagaaaccucaacucccagcuucuuccugagggguaacaggcuugcaccacaccuauaaugcccaacuuuuaccaucacugcaagggggaggggcucuuagaucaccccacuugcagaaugucagagacagcacauugggagauuucccucaagcacaaaaacaaagaagaauuugaacugccucugagggcacucucagcagcgguagccccuagaucuguccagcuuccacccuuccccuggagaggguuuggcuucacagcaguucccugugguuuuggccuuuaacaggucagucucugggagccuacaaagcaauaaagaaaaagccaacuugagccuaaacaggaagcacagcaccuacgagggccuucccuggcuuucuccagugcuaaucccagcccugcagucucucugugaagaguugaagucuucucccagcaagacugggagggacagcacuccugugccuucucccucagcuugcucuagagauaaacuccgcaaucucuuauuggaaggaagcagagagaccucuucaugucuuaaaggaaagugggcacuccagaccagaagucuccccugcuaugagggagggcgucuucugaaugcucaagcaggacugugggcacucucugcaccuucuuccccagcuugacccagcaguaaauauagaucugaagacccucccuggaggcaguuucuacaugcaucaaauacuucaacuuuuacagucuuugcuugggacuggcuccuaaaucaccuggcucugggaguugacagaacuccacgcuccugaaucuccuagaccacagggaacaaaaggugacuuuuaaacuugcaaacauucaacaaguaucuccccagguucaaagugagcaguaugaucaaggguacaggcaucuaucucagcuucauuccuuggaguaaggcagaauggaugagaaagaaacucuggcucucagcuucucugaaaagagagacagaaagaacuggaacacgcaucuaacaccccgaccucuccagccacauuccuagggacuggcuucuaucaaaugucucucaaggcgauagcacaacuugauacucucccauguauuggggccacuaagaacaaagacagcaggcuggacaaacacaaaacuuagaggcacuuagaaucucugacugggcugauuaaggaggaacacugacgaauggaacagguuagaaagcccagaaaauaagcucaaguauuuaugaucaauugauuucuuucaaaggugacaagaauacauaauaggaaaugacggauuuuauucaacaaaugcugaugggaaaaccgaauauucauauucagaagaacgaaaucagaccccauaucacuagaaauacaaauaucaauuuauauauauauacauauauaauuuuuugagauggagucucuuucuuucauacagaccggagugcaguggugccaucuuaguucacugcaaccuccgcuucacggguucaagagauuccccugccucagccuccugaguaacugggacuacagguaugugcuaccacaccuggcuaauuuuuguguucuuaguagagacggaguuucagcauguuggccaggcuggucucaaaguccugaccucaggugaucugcccgccucugccucccacaaugcugggauuacagcugugagccaccgugccaggcccaaauaucaauuuaaaauugauaaaggacuuaaauauaagaccuaaaacuacaaagauacuauaagaaaacaggggaagaucuccacagcuuuggucuggguaauuauuuuuuagauggaacuccaaaggcacaggcagcaaaagcaaaaauagacaaacggaauugccucaaacuaaacagcuucugcauagcaaaggaaacaacucgaugaagagagaaaccagauuuaaagaaaauauucgcaaacuauacaccugaugagggguuuauauccacgucauaugaggaauuuaacucaugacaagaaaacaacccaauuauaaaaugugcaaagaaucugaacagacauuucucaaaagaagagauaugaauggccaauagauauaugaaaaacugcuccacaucuccaaucaucagagaaaugcaaauuaaagccacagugggauaucaccacaugcccauuagaauggcuauuaucaaaacgacugaugccaacaaguauuggcaaggauguggagaaaagguaacccuuguacauuguugaugggaaaguauauuaguacaccuauuuuggaaaauagcaugggaguaacucguaaaucuaaaaauagaauuacuaugugauucagcaaucccacuucuggauauauuccaaagguagugaaaucuguaugucaaggagauaucggcauucccagauuucuuuuagauuauucacaauagccaagauaugaaagcaauauaaguauccaggaacagaugaaugcauacagaaaaugcaguauauauacacuauggaauacuauauacccuuaaaaaagaaggaaauuuuaucauuugcaauaacauggaugaaacuguagaacaauaugcuaaaugaaauaagcuaaacacagaaagacaaauacgguaugaucucacuuauauauggacucuaaaguggucuauuucagaaacaaggaauagaaauguggauaccagaaacuaggaguggagggaagagaagauguuaaucagagguacaaagaauuaguuagacugaaggaaugaacuuuagugauguaaugcauuguauguugaccacagauaauaauaauguauauuucagauuuguuuuuaaaaaguuuuaauguucucaccacagaaaagugauaaauuggugaggugaagggcauguuaauucacuugacugaaacuuucuauaaugccuacauagauuaaaugucacauuguacagauauauguaauuacagauauacauaaauauugucaauaaaauauguuaauuacacacauaaaaaaucgccaacacaccaaagccuaacagugaaaugaagcuauguugcaaagauauguguuaccaguuauuccgagauguuagagcuucgaauccucucaucaacuaacucucacccucucaucaacuaacucucacccauaaucacagguuccuaacauucaaaaucuccuuauuauauagaucuuuagcaguaaauugauguuagaaaauucaggaaguuccucaaugagaucgagguuaaaaaauaauggugucaacacuuuuuaucccaaauguuaaggcagcaaauaaggggauuuuacauugcuggcagcuuauguguugcuaauagccucuuccagaaaaacgcuggauagguuggguuguggggaaaugauacggucuucucucauugaaaauccuuagaaaaacuuaaagcagauaauacuaaccagacuuugaucaauuuacuagaguaguuguuuaaauaugauuuauauugauuguccuuccucugucuucccuaguugguauaucucaaguaauagauaaguacuuaauauuauuuguauguucuacuuuccuucuuauaaaaucuaauauauauauauauuuuucuaguuaaaugaaggaguuagguguagagaugggacaaauaaaucucuguaacugguugugaugaauuaguuguaaacaccacugcacucagaucagccaaucuuuuucuuucuuuauuucuuucuuuucuucuuuucuuucucuuuccuuucuuucuuugcuuucuuuccuaauuucugucuuucuuucuuuuuuuuuuuuuuuuuuuuuguaaagacaaggucuugcuuuguugcccaggcuggucucaaacuccaggcuucgagggauucuccagccuccgcuucccaagggcuagaauuacaggucugagccaccaugccugaccucuauaaaaucucauauuuuuaauaaacaauguugauuugucauaagaagcaaucacuagaaacaaugauuuagucauuccucucaaccaaaaaugauguguaauauuuguuguuuuagguauuuguggcguagaaaugaacaagucacuuguuuuuaaguuaaacuaaacuguacaaacccaaacuugaguacucagacuuggauuugggucacagaaauuugcuuugucuucauuuguccaacuaaacagauagacguauauacuuuuuaaaagggaaaaauguuuauuuguaaaauuugaaaucacauuuauuggagcacaaaaacuguguggugucauugcuuuguuaucaauauaacaauaucugaccuaaagagaaagcuucagaaucacaaugaauugauuuuuuuuaacuuccucaagaacaauguaaaucacuagcauuucuuccuguuucauuguacugaguggugcuuccuuagaacuaaaacauagauacacauuuuugccagagugauuuuacagauuaugcuauauuguaauagucaauagagguaacuguuaaaauuccaaguauugugaaugucugaauugccucuuaaggguuuuauauggcuauuaguaaaauagaguuuuauaauacuuaauuccaauugacuucagugcaaauccacaguacauaauggauggaugggggaagggaagaaaaguaggauggauaaauggaugaauggauaaauugauagaccgugaauaucacugcuaucugacuacaaguugcuacuuugaucguaguaaguaaaaguaaucacaaugguaauaauauagggaaagacuagucaaagauauauuaacaauuaaaaaauuaaucuuaguguuauaucagauauuaaacuguacaucaacagggggaugcauuaaaaggcaucaaaauagccaaagaagacaaaagaaaaaaaaacaggaaaauaguacaauuauaguuacacugaacuacaugauuuccaccucuaacuuuucaaauaagaggaaaauaugcucuauccacgcacaaugcaauaguaucuacuccuuggcuuuuaaaaacaacugaggaaucagaaauaauucaguucauaaaaaacacugauacaaauucaauaucagcuuaauacaauauuagaauaauaucaacauaaauaauagcuucuguguaguggguaacaaugauagguaauuucauuuuaauuaaaugucagcaugaaaauucuauucgcauuuaucauacuaacuaugcagaccguguaccaaagagaacagaaacagcaguuugaauguguuauuuucauucaaagauauuguaccugcuggcauucugauuaguguuuacucauuuuagcauuaaaaauaccaaguuuaguuuuuugacacacuauguaguacugucaauauuauauaagacaaacauacagaaaagcaauuugcacagucauuacacaauaacauauuugcacuaacucuaugucacaauugcauuuugauagcagcaaaggacuuuauuuguauuuaguucaaauuguuaaauucuauucccccuuuuuuuguucaaauuguuaaauucuauuuccucuuucccuuccuuccuucuuucuuuccuuccuuccuuccuuccuuccuuuccuuucuucuuucuuuuuuuuguuuucuuugacagagucucacugggucacccaggcuggagugcaaugggcugaucuuggcucacugcaaccuccgccuccaggguucaagcgagucuccugccucauccuccgaguagcugggauuacagucgcccgccaacacgcccgauuaauuuuuguauuuucaguaaagacaggguuucaccauguuguccaggcuggucucgaacuccugaccuuaggugauccaccugccucagccucccaaaaugcugggauuacaugcaugagccaccgcgccccaccuauuucuccuuucuuaacagaagucugauuuagaauuagugugaauaugagaaggcccgugaaauggcuuugagaucuacuugcugcugucaggaccacuggccgcuaagaugccuuacugcagaugagaaaaugcaccucugugcugcuuggagagugcuucauuuucagcguacucauacccccuaacagagaccccuucuucaggacacagccuacauaaacacauauggcagcccgagagcaccguuaaaacaaaucacacguucugaaaguccagcaaaauccuucaaaaugacucgcuccgaaguuaaaacaggaaauguauguaagauaucaauggucaauggaaacauccuaaaauuacuuuaaccaaaacaaugcccuuggucauuuccaauaauaaaaaggugguucuucucauaucuaguucucccaccugcacucaauauuuaaaacuaagcagaguaaaauggguuuaaaagauagucuguuguuugcuguucaguaaguacaaaguuucuuucuuucuuuauuauuauuauuauaauuuagguucugugguacaugugcacaacaugcagguuuguuacauauguacacaugugccauguuggugugaugcacccacuaacuugucauuuacauuagguauaucuccuaaugcuaucccucccccgucuccccacccuacaacaggccccgguaugugauguuccccgccguguguccaaguguuuuuauuguucaauuaccaccuaucagugagaacaugugguguuugguuuucuguccuugcaauaguuugcucagaaugcugguuuccagcuucauccaugucccuaagaggacaugaacucaucauuuuuuacagcugaauaguauuccaugguguauaugugccacauuuucuuaauccagucuaucauugauggacguuuggguugguuccaagucuuugcuauugugaauagugccgcaauaaacauacaugugcaugugucuucauagcagcaugauuuauaaucuuuuggguauaugcgcaguaaugggauggcugggucaaaugguauuucuaguucuagaucccugaggaaucgccacacugucuuccacaaugguugaacuaguuuacaaucccaccaaugguguaaaagcauuucuauuucuccacauccucuccagcaccuguuguuuccugacuuuuuaaugauugccauucuaacuggugugagaugguaucucauuguguuuuugauuugcauuucucugauggccagugaugaugagcauuuuuucaugugucuguuggcugcauaaaugucuucuuuugagaagugucuguucauauccuuugcccacuuuuugaugggguuguuugauuuuuuucuuguaaauuuguuaaguucuuuguagauucuggauauuagcccuuugucagauggguagauuguaaaaauuuucucucauucuguagguugccuguucacucugaugguaguuucuuuugcugugcagaagcucuuuaguuuaauuagaucccauuugucaauguugacuuuuguugucauuucuuuugguguuuuagucaugaaguccuugcccaugccuauggccugaaugguauugccuggguuuucuaggguuuuuaugguuuuaggucuaacauuuaagucuuuaauccaucuugaauuaauuucuguauaagguguaaggaagggauccaguuucagcuuucuacauauggcuagcgaguuuucccagcaccauuuauuaaauagggaauccuuuacucauuucauguuauugucagguuugucaaagaucagaugguuguagaugugugguaguauuucugagggcucuauucuguuccauuggucuguaucucuguuuugguaccaguaccaugcuguuuugguuacuguagccuuguaguauaguuugaagucagguagugugaugccuccagcuuuguucuuuuggcuuaggauugucuuggcaaugcugacucuuuuuugguuccauaugaacuuuaaaguaguuuuuucaaguucugugaagaaagucacugguagcuugauggggauggcauugaaucuauaaauuaccuugggcaguauggcaauuuucacaauauugauucuuccuauccaugagcauggaauguucuuccauuuguuugcguccucuuuuauuucauugagcagugguuuguaguucucuuugaagauguccuucacaucccuucuaaguugcauuccuagguauuuuauucuuuuugaagcaauugugaaugggaguucacucaugauuuggcucucuguuugucuguuauugguguguaagaauacuugugauuuuugcacauugauuuuguauccugagacugcugaaguugcuuaucagcuuaaggagauuuugggcugagacgaugggguuuucuaaauauacaaucaugucaucugcaaacagggacaauuugacuuccucuuuuccuaaaugaauacccuuuauuucuuucucuugccugauugcccuggccagaacuuccaacacuauguugaauaggaguggugagagagggcaucccugccuugugcccguuuucaaagggaaugcuuccaguuuuugcccauucaguaugauauuggcuguggguuugucauaaauagcucuuauuauuuugagauauguacaucaagaccuaguuuauugagagcuuuuagcaugaagggauguugcauuuugucaaaggccuuucagcaucuacugagauaaucaugugguuuuugucuuugguucuguuuauaugcuggauuacauuuauugauuuguguauguugaaccagccuugaaucccagggaugaagccaacuugucuuugguucuauuuauaugauggauuacguuuauugauuuguguauguugaaccagccuugcauccuagggaugaagccaacuugaucgugguggauaagcuuuuugaugugcugcuggauugaguuugccaguauuuuauugaggauuuuugcaucaauguucaucagggauauuggucuaaaauucucuuuuuuuguuguguuucugccaggcuuuguuaucaggcugauguuggccucaaaaaaugaauuagagaggauucccucuuuuucuauugauuggaauaguuucagaaggaaugguaccagcuccucuuugucccucugguagaauucagcucugaguccaucugguccuggacguuuuugguugguaggcuauuaauuauugccucaauuucagaaccuguuauuggucuauucagugauucaacuccuuccugguuuaguccugggaggguguaugugugcaggaauuuauccauuucuuuuagauuuucuagguuauuugcauagagguguuuauaguauucucugaugguaguuuguauuucugugggauugguggugauaucgccuuuauaauuuuuuauugcgucuauuugauucuucucucuuuucuccuuuauuugucuugcuagcggucuaucaauuuuguuuauuuuuucaaaaaaccagcuccuggauucauugauuuuuugaaggguauuuugugucucuaucuccuucaguucugcucugaucuuaguuauuucuugccuucugcuagcuuuugaauguguuugcucuugcuucucuaguucuuuuaauugugauguuaggaugucaauuuuagaucuuuccugcuuucucuugugggcauuuagugcuauaaauuucccccuacacgcugcuuuaaaugugucccagagauucugguauguugugucuuuguucucauuggcuucaaagaacaucuuuauuucugccuccauuuuguuauggaccucguagggugccccucugagacaaagcuuccagaggaaggaucaggcagcaauauuugccguucugcagacuccacuggugauacccaggcaaauaggguauggaguggaccuccaggaaacuccaacagaccugcagcugaggguccugaauguuagaaggaaagcuaagaaacagaaaggacauccacaccaaaaccccaucuguaugucaccaucaucaaagaccaaagguagauaaaaccacaaagauggggagaaaccagagcagaaaagcugaaaauucuaaaaaucagagcgccucuucuccuccaaagguaugcaguuccucgccagcaacggaacaaaacuggacggagaaagacuuugacgaguugagagaagaaggcuucagacgacuggcaacaacaaacuucucugagcuaaagaaggauguacgaacccaucgcaaagaagcuaaaaaccuugaaaaaggauuagacaaauggcuaauuagaauaaacaguguagagaaguccuuaaaugaccugauggagcuaaaaaccauggcaugagaacgacgugaugcauggacaagcuucaguagccuauuugaucaaguggaagaaaaggugucugugauugaagaucaaaugaaugaaaugaagugagaagagaaguuuagagaaaaaaagaguaaaaagaaaugaacaaagccuccaagaaauauggaaguaugugaaaagaccaaaucuacaucugauugguguaccugaaagugagggggagaauggaaccaaguuggaaaacacugcaggauauuauccaggggaacuuccccaaaauagcaaggcaggccaacauucaaauuuaggaaauacagagaauuccacaaagauacuccucgagaagagcaacuccaagacacauaauugucagauucaccaaaguugaaaugaaggaaaaaaauguuaagggcagccagagagaaaggucagguuacccacaaagggaagcccaugagacuaacagcagaucucuugacagaaauucuacaagccagcagagagugggggccaauauucaacauucuuaaagaaaagaguuuccaacccagaauuucauauccagccgaacuaagcuucaugagugaaggagaaauaaaauccuuuacagacaaacaaacacugagagauuuugucaccaccaggccugccuuacaagagcuccugaaggaagcacuaaacauggaaaggaacaaccgguaccagccacugcaaugacaugccaaauuguaaagaccaucaaugcuaggaagaaauugcaucaacuaacgagcaaaagagccagcuaacaucacaaugacaggaucaaauucacacauaacaauauuaaccuuaacuguaaauugccuaagugcuccaauuaaaagaugcagacuggaaaacuggauaaagagucaagacccaucaguguguuguauucaggagacccaucucacaugcagagacacacauaggcucaaaaaaaagggacagaggaagaucuaccaagcaaauggaaaaaaaaaaaaaaagcaggguuugcaauccuagucucugauaaaacagacuuuaaaccaacaaagaucgaaagagacaaagaagaccauuacauaaugguaaagggaucaauucaacaagaagagcuaacuauccuaaauauauaugcacccaauauaggagcacccagauucauaaaggaaguccuuagagaccuacaaagagacuuagacucucacacaauaauaaugggagacuuuaacaccccacugucaacauuagacagaucaacgagacagaaaguuaaaaaggauauccaggaauugaacucagcucugcaccaagcagaccuaauagacauuuacagaacucuucaccccaaaucaagauuauacauucuucucagcaccacaacacacuuauuccaaaauugaccacauaguuggaaguaaagcacuccuaagcaaauguaaaagaacagaaauuauaacaaacugucucucagaccacagugcaaucaaacuagaacucaggauuaagaaacucacucaaaacugcucaacuacauggaaacugaaaaaccugcuccaguauaaaguucaguuaugcaacaggaauaaguucaacagaacugcuguacaacauucuaccuauagcuagcaucaauguauugugaacuuaaaauuuuaaaaggguagauuucauguuguaugcuuacuacaauaauuaaaaaaaaaacuucuguuuuguauuuacuuuaaaauaagguuuaaaaacugaggaggguacaugauuugagacuggcaaauugcuuauaauugaggcaaaugagagguacaugaguguuuauuaugucauucucucaauuuuuguucauguuugaaaacagauuuaaaagcuaugccuaagugucauuuccuauaguguucuuuucucuuguuuccccaucacuuuugauuuucucaaucccuuugugaaucccuacccaugucucccaugacacguguucauguaugcaugcgcacacacacacacacacacacacacacacacacacaugcacacaaagguguaccuaguuucucccaucucugaaucucaauaccauuacuuuaguaccuauuacuuuagauuuaaucauguacuuaccuguuucuaccagccaaaagcugugucugcuauacuacagaaaacugguaacucuuguugaauaauacauuuauuacaaaggucauauuuuuauggggauaacuuuuucaccuguuugaauaacaaauaugucuccagagaugaauuucuaguaacagaaguauagcacaugucuguaagagcaaaguaauaacauaguaauaauaagaugaugauggugaugguaagagcucuacauucaucacuuuuauggcuggaauuguaugguuugacccacauuuuauucugagcuuaucacucgggacucaagaggccauaugccgugcuguuuaagaguucggccucuaacguugaacugucuuuucauaucucaacuccaacacguuuuagauacgcaauauugugcaaauuacuuagcuuuuuugcuucaguuuuuuccuuccauaaaucuugaagaaucuuugucaggauuaaauguguuaauauacaucaggcauuuaauacuaucucugaaauagaauagauacuauaugugucagcuguuaauauuucugccauacaauaggcacuuaagauuuuugacuaagugaaugaaagaucacauauauaaaccauuuugacuaacuuaguugacaaguugugucauuuaauauuaccuuaccaaauugauggauacagaaguugcgauugucuaaauauuuuuaaaucaucuguaaauaauaacaaaacaaacuucuauuauaugggacugaaaaggggugcauaaauuuuaaauuuuuaaaucuuucauuuugucauguagcaacaaauuguauaugaugccuuacuuucuuuuugcuuugcagaaaauauuuguccuaucacuaugucauuauauuuuugcuguacacuaaaaauuauccacuacaaccacugacaaacuacucaggauaauauucuucuauccuuguggaaaacagacucccauuaauuuuucagaaagaguggaagaagaguuguaccuuuuccaaguccuacgagguagcuugaacaggaaauuuuuggaaaugaggagggagguggaacuuacaacuuagccauaaucauuccucuuucauuaguugacaagagguuuaccaucaaccuccuucacaauaccacaacaauuucuuugguuacuuccacacccagcacacaggcugucccucccguguuuauguuugcuccuuccagaaaauuccuugcaccacugugaauguacaugugcauuuauuuggagaucauucaugcaacuuuggacauuauagguaggcaguggucuugaaaugauaccauguauaucuuuuuguuguuguuguuguuguuguuguuauuguugagacagagucucacucugucacccaggcuggagugcaguggcacaauuugggcucacuacaagcuccgccucccggguucacaccauucuccugccucacccucccuagcagcugggacugcagguaucugccgucacacuuggcuaauuuuuuuuguauuuuuaguagagaugggguuucaccauguuagccaugauggucucgaucuccugaccuugugaucugcccgucucagccuuccaaagugcugggauuacaggcgugagucacugugcccggucaccauguaugucuucuuaaauggaaagaagauaaauaauuuucuguaaaagaaauuauggaauagucuucuuuucuucuauucucaaauuaauccugaguccauuucacaauguuucaaauuaaggugcauaggcuccaauugguuuuggaaaugucauuaaaauuuaccacaacuaucccuaaauuguauuauuauaaacagcauuugcuuugauucuguugaccuggaauguugggucugcuggucucuuaaggaaaucccuccacugaaguauggucucuuaacuucuauauagaauuaauguauuuguugccuuaaauagcauguuuguaaaauucaggugaaagcuaaucaucuguuauguugaacaguccacccucagcacuuaaauacaagcaugcaugucucugcagauuuaaaugauuuguauaaacauuuuaauaccuauaauauuuuuuucucuuuguuuuagcugucaggaaacugagaguuaacaucaauguacgauauaauuacagcaaacccauuguagaaucccaaugacauacauuuauguugcugcuuuucaauaaugccuauuuugauuuauuucuucagauuuuaugaaguuguauauacaacuuauaaauuuccaaauuaugucuccaagcaggugaguaugaguuuuaaauaaauaaauggguugauuuucgauaacuugaaaacuugaaacuauauggccaaccuaaaagacucuggcuauauuuuuccucuuaaguaucuaucagccaaaccauuuauaauauggaaaauauaacauuuuuauacaauaugguacccuuaagucuggcuguuuuuaguaagcuguucuucaauuuuaauguaguggaacucucaaaauuaugucuacuuaguuuaauguucucucuuuuaaugguucaaguauagggccaaucauuuauccaagaguaccaauuuuccauugguuaaacucacagaaauugcuuucauguccaccacauaaaaagugugcaauauuuauaccauaauccuuagaucuuuuuauacuaaguuaaggacacgauuuaauuuauggacuaaaugugaugcuucuuuuucacuauuguuuuacugauagcauucuuauuauuuuauacucuacauguggauuguuauauauucuuuguucuuauagacuuagagcuguauguaaagguuuauuuuucucagccaaaauuacuccaaguccucuucaccucauuucuugauaacugcaaauccuuccagucaccuucucaaaaaccaucucuuugaacuucaguuacucuugcauaacgcaauugaugaaauuuucuaaacgaccagcuuauauuacuuccauggucugaaauguauaauggcucuuucuaaccuucauauuuagcuaaaauuucucugaaguucaaggucugccauaaccuaggccuauucuucauaucugaacuuauucucuaccauuauaaucuuacaccuaccuucaauauucagaagguagccucccaugcuuuuucucaucucuaacuuaagacuuauuucucucuaaaaggguaugcauuccugaagguuucacauaagucguacccccuccauaauugcggaauauacuaggcuguaaguucccaggccuggugcaguggcucaugcuuguuaucccugcauuuuggaaaacugaggcaggaggacugcuugaggccaguguuggugaccauccuggacaacaaagugagacccuguaucuacaaaauaaaauaaaauaaaauaaaauaacuaaaaaauuagcugcaugguggcccaugccuuuaguccuagguauucagaggcugaaaugggaggauuacuugagcccagggguucuaggcugcugugagcuaugaucgugacacugcacuccgugacuccaacucuaaaauaaauaaauaaauaaucauuggcuuugagacuuuuuucugcuuuauaauuuugauaauaauaacuaccauauaauugugcaccaaggaauuugcuaagaacacuguguguauuauuucuaucuuauuuuauuuuuauuuuuuuagauggaguuuugcucguguugcccaggcuggagugcaguggcaugaucucggcucacugcaaccuccaccuccuggguucaagcaauucuccuggcucacccucccaaguagcugggauuacaggcacaugccaccacaccuggcuaauuuuguauuuuuaguagagaugggguuucaccaucuuggccaggcuggucucgagcuccugacuucaagugaucccaccugggugucccaaagugcugggauaacaggcgugauccaccacaccuggccguauuauuucuuuuaauauucacaaugaaauuuugaaguacagcauaucaucuauauucuacaggaauuacaagguaaauaaaucugagcucaaauggaggugcuagcacgcaaacucaagucacagugacugucaagggcaugcucuuccauuccucaaauuaauuaacacaucauucuucucuaagagaucacaucacuaucacucuuacauucaccaccugcagugcuggaccagagcuguccaagagcagaacuguaaucuacuuucuccaguguugaacaugcauucaaaaacaugcuucaaacauauucacaguggaucgaacguucagaggcagauuuugugaaaaguaaauugaugagauagggaacaaccaaacaaagcuaaacuccaaauccccugauagccccacaucuggacagaaggcuuugcaaccucaugacccucagcuucucagaaauuuaggcaaaauugccuugagacucugcuguuacugcaacuuuacagauuauagaugucaaauccuuuccaaacuuuuccuaagguuuugcagggggugggcaguuauuaaagcugugggggugauguauuuacuaguaauaucuucuguuucuugagcuaagcugcuguacauucuuuuuuuaugcuugaauguguagccuucugcaggaaaacccugucacuccaagcacugugaacaguauagacuuuuugaagacucgugaagaaacacagaacaauaacucaauaauagcaagaaaaacaaaacaaaacaaagcaaaaaaccacauucaacuugcaaauaguggcucuucacaaagucccagacugucuuuuucucuuguccucccuugccuuauucuuugauucuaccuccuguuuucuguaagaaaaccaauaguuuccuuuccuuauagcauagaaggaucaucucuuccuuuggguauguuaaugaccacuuucuuucaugcucacagcaucucacguuuuauaguaagugucaagaaacuuaccagaguauuucuucaaacaaaauacacauauuugugcuagcaguucauauaauaaaguuuuuuuuauuuacgugugugucuguguaugcaaggguacacacauucacauuaacacguuuagagaguguguuuguagcauucaacauggaaaacaaguuaccagauagagcuuucauuaucuuucuagcauaaagaaugugcuuauuuauagaagguaugcuuaugaguauagcacuacaaauaaacauuggaauaaccuaaaagcuauuaaugccaauuacuauacauuucaaagaaguacauauaaauuuauaacucucugauaguuauuaccuacauggaauccuuaucauauuuacugaaacuuucaaaacuuuuucuauauuaucuaccuauuucuuucucuuuccugcacuuuuucuaguuuuguaugcuuuacaugccuuuauucucuucugugauuuguuuuccucauuuggcuaucucuuucuucuauuucacuuuuauuucacacaucuuuaugguuuuaccuacuuugaucacccaucuauauuucuuccuuuucucuuucugucuuuagucucccaaaauggcaauaaaauggaauuuaaauccauagacaacacugaagauuauuaguucaauaaaacuuaaugcucuugauauuaauuugaaaaaaacgaagguaucuuuuucuuuauggaacaagaaaacauacagaucugaauauagauauauuaggaaaugcacugggaaauuaaugauuuucaauuuaaauuguuuuucuauauaucaucuauaaguauugggaaauguuacaaugaacaaaugauggaaauaauauucaaucauucaagaaaaaaauugaauuaacagcucaagaauuaaaacacuuuuacuucuuggcuuuuacuaucuucuugaaaaguaauauuaaagaaauauuguuucuauuguuucuauuaauauuagaacaacacaaacacacacacagaaacacacacacacacacacacagauaauaccugcuuuaaucuuuauacaaaauaacucaguacuuugcugaucuacuuucuaaaaaugauuaagaacuuuuuaguuuucugaaaaucugaacuuuaagucuucauacauauauauaauuuaugcaacuuaaaaugugcacucuuucauuucaucuggaucucgguauuuuagauuuaggugacaggaugacaaacagaccauuauuuguaacuguguuauuuauacuaaaauacguggccaaauuaauuuauauuguuuguauuguuaauuaccaggacaaagcaaaaauguguguuuuacugggacaugggacaaccaugcaauauccaauauccaaacacuuaucaggcagcauauuucccuuaacaucaugauagaaaauuagaaaugcuaccuccugaagucugcugccuggaaucagaacagccuaggagcucucuaaauacucaagagaaaauucugcuuuuguaaccauaugucuguugccugaugcucaacaagucaauacauggagacaccaguuugcagcaaagaaagggguuucauugcagggcagccaaaggaggagacaggagaaaaccucacacacaucaccuuggggagucugggacuaggguuuucacaggcucugaaguagcccaaaguguggagaucaugaauugguugaagagugcagggugaggucauggaauggggagauaaagaaacuauucucaggugacucaguuccucugugagugucuucaaacuggcugggguccgcuguucugcuggaauuuaggaucugcuuaagcaauuccuaaaaagccuugugauuccaacaucagagauccuaucuauccuacaucagaauccuaucuauacaagcaaugggaugcaaauggucaguaucuagugcuaugugacuuugguuguaaggaaguaggucaaaauacagccugacuaaugcuuaauuauaacuauguuucuguccagaauacuuacuaacccugugaggacagcuucacuuugcucugucaagcauucuaaaucaauaaaauuuuucuuuuuuucuuuucuuuguuuuuuuuuuuuugagauggagucucacucugucgcccaggcuggagugcggugcugugcaauaaaguuuacgaggugaaaaugaagucauuuauguaaaguuuucauguuuucauuuuuaacaauuauuucugcuuucaggauaauaauucuaagcuuucuagaaugggaacaauugagcuagaucuacaagauucaucuaaccaauaucuuuuaaaaauaggcaaaauguuauuguccuuauuuuugagggauaggaaaauccauaaaaacgauuuuuucuuuuauuagcaagaaaaaauauuuuaaugggugaauggggguauaauauguauuuagauuaucacauauuuuagauuuuaauuguuuuaucucuuaaaaauuugaauacucugggagaacaauucucaaucuaaauuugagacauggugcuuauuuacauacaucuuuaugaacaacaaguuauaaagaucagccagccuagaaaacuggaaggguagaaccaccaccuguacccugaauacaugcuuuugcaggaaaacaaacaaacaaaaagcaaaacaaaccaaaaaaaacaguuuuugcagccucuaacuuacaaauccauuuuauucaucucucccugaggcuggcaguacaaauaauaguccuggauuuuauaccagauugucaaauucauuuugauaucuucaguacagggacugacucauaguacaugauaguacacguuccauaguuggcuaaaauguagugacuaugacugacuaccucgugaauuuuuagauguaaacuuaugacuuucugugucuacuuaaauuuggaauucuauaacugaauaugcaaucaauucaauuacuuucaucuuaaugguaauuuuguauauguagaugaaaacauaaaaucucuauauuuuauaauuaauugguuaauggcuaaaaguaguaaauaaaaagcauauaaucucuaauggaaguuucaguuauaaauucuuuuggugaacaaaaauuaagcuacuauuuuaguaacuuagaguuccaaaaucauacuuaaaaaccaaauuacuauaucgcaucccaauaugacugacaacauucuggaauuagcucaaaacauggauaaauacacaaaguaugaaaugacuacuacuucaaucuuaagugaguuuaauucucuaagguucaggcucugacucugaaugguacucuaaaaauaaaagucuauagugguaaacugaaaaguaaagucaucauuaucaauuaaaacuuaaaccaauggcauuguaagugaaaguaauuaucucaauuauauaagaaauguuuugugagaaaacuaaacacaggacacugacaaguacauuaaucauauaucuuugcauuaguuaacacaacgaccacacaagguuugcauaagcagaaagcuguuuggaucugggccagcugacauuggcugauuaugugguccuccccucugaaggagucguuagucuguuaguguccucuccucuucuaggcuaccuuuccuagagggcagcguccaaauauccuuucgucucaucaguccuuugcgcaguccggcuggguaggcucuggguaaaaguuacuugaauuucuggguucugggcauauugugaagcuuucaauuuuuaaggaugcuuaagaugaaugacugaauguuuaauucaauuuugcuuaaggcacuaaauuuacaaaaccauuaacuuguauuuaaaaagaacuucuccacuuugugauucugucgaauugucugucagcucuaaucacuagccagaagggaaagcccaguccagaaaguauggagugaaugaagacaaauuccuuaugggguugauuuuuucacucuuaucuaaggugucacggaaaucuuuucagaaacugccaucagugcuccuccuagaacaaauuuuugguugcuuuuauguggaaauuuugaaaggcagccccuccaacuccacuuuuuuaaaugaguagagaaaaggcuuuauuaaaaaaagaaccacuuuuacauuauggaaggucuccauguugauauuuuuuaccuuuuaaauuauuuagaaauuauuuuuucuacaguuuuugagaguauauuaauaauaguuauuuuuucaaauuagauaauuuagaggaauuaaaaagaaacccaaugagcauuaagcaaaucaaacaugaaagaacaacgugaaaugaaaggagagcaucaaaagccauauauaccucuguuugacaaaguucuagaggagaugaaugggauagacucaaaguuacugucuccuaagggaaaaugauggccuguaagucaaauguacuaguguacuuaguuacuaaauguuaacuaucaaucaagauauaauaguguauauuguuucagaagcauccuucauuauaaacagguuuuccaugagaguuucauguugcuagccagcucuggaguugaaacaaucaauaaaccaucauagaagacuaggucaaacuauuaauuauacagagcgauuuucuaauccauuuuuauuaaaugauaaaagauaauuguuucaggucuaaaacugaacaacuucagaaaaaauguccaacagaguuuucaauggauauagucucauaaaccuaaauuuucuccugggaauuccuauguucaugguauuauaaauuuuaaaaugaaguuauugugcuugucaucuauaugaagacuuuucacuguuucauuuaaauccaauuuuauuucauuuauuuuuuaauuguaaauugauaaauuauagcuguauauauuuaugugacacaaacugguguuauaguucgugaauacaauauugaauaauuaaaucaagcuaauuaauauguucaucaucuuaaauaccauauuuuguggugagaacauuugaaauaacaauauguuauuuccuauauucaccaugcuuuacaauauaucccaaagaauaauguauuucucuuguguaauuaaagcuuuguacccuugaccauuaacuccucauuccccucucucccagcgucucggauaaccacuauucuacucucugcuucuuucaauuugacuguuuuagauuccacauauacgugagaguauaacguauuugacuuucuguuccuaauuuauauuacuuagcaaaacguuuuccaauuucacuguugucacaaaugacaacauuucuuuuguaaagcugaauagugcugcacuaaccaugggagugcagacaucucuccaacauguugauuucaguucccaguauacccaguaaugggauugcucaaucauauggcaguucuauuuuuaauaucugaggaaccuccauauuguuugcuauuacgcuuguacuaauuuacauucccaucaacaguguguuaagaguuccuuuucuccacauucucaccaacacuuguucucuuguuucuuuuugauaacacucauuuuuuaaaauuuuuauucuaaguucugugcuaaugggcaguuuuguuacauagguaaauacgccaugguaguuugcugcaccuaucaaaaggaacaagaucauguccuuugcagggacauggacggagcuggaagccauuauccucaacaaacuaaugcaggaacagggaaucaaacaucucauguucucacuuauaaguggaagaugaacagugagaacacaugcacaaagggaggggaacaacagucauuuuaacaagagugaggugguauccacugugguuuugauuuucauucucugauaauuaaugaugcucagcauuuuuucauauaccuuuuggucauuuugugucuucuuuugaaaaaugucuacucagcuccuuugcccauuuucuaaucaaauuauuuguauucuuucuauauauuuguuugaguuucuuauauauuugggauaucaaccccuuaucagacauguggcuugcaaauauauucuuucccaauccauagggcugucucuucauuccauuguuuccuuuuaugugcacgacauuuuuauuuugauguaaucucauuugucuaucuuugcuguuauuguuuaugcuuuuggggucaaauccaaaauaaucauugcccagacuuauaccucauagauauucaccuguguuuuuucuaguaguuuuacauuacagaucuuauguguaagucuauuggcuuuuuaaaaauuauagauauuugguccuuuuuauaaugagaaaauaauuuuaauuuuuuaaaucuauucuuucugcuguuacucauucugugcagaucuaugugucaaguacuuaagcagguguugagauuugauaccaucccugccuucagcuguuuauugaacauggggcagcaaauuguuucugugaaggucuaaguagcaaauauuuuaggcuuuauuggacacauaugguuucuguggcugccacucaccucucucaaaguaacauagacaacacauaaacaaauggggauggcuguguuccaauaaaguuuauaggcacugagacgugaacuucauauagucaugcaccaugaaauauuauuauccuuuuauucuuucaaucauuuauaaauuuaaaaaucauuuuuagcucaagggcuacgcaaaaaagcaccuagcugaauuuggcccaugagauacaguuugcaggccccugguuuguuguauuaaaagacagaagauauucuuacaugcuuucuauuuuuuauuaggaaauauucuccuauucucugaaguuucauaaacuucuuucuuagaaaaaucuuaaggauuuauugucaaguuuuuauuucacaaacauauucaucauguuuuaucuuagucuaguuagauucaaauugauguaacugauucuaggaaauggagaaaagcagaaugaaauggaacauuuuguaguuggcaagggaacucuacugcaauuucuguugccuccguuugaggaaggaauuacgguauuauaggaaaaacagcuuuugaaacuaagucauccaauacauaucagcuacuucacuccaaugcuuugcuaugcagugacaauauucuuggcauugauacugcaaugaaaacauuugaguagacugggggaaacauagggauucuauauguuuuaauuuaagcaggcaaauaaacucaguucauucgucugaacuucuuacaucauaaauuaaaaaccugaugauguucaaaguguuuaaguagcuugcccaauaaaacacaaacaguuucgaucuaguuuuuucugauucccaaauacacgcucuuuacaguagaacugacuucaaagauggcgauacaaauauauuuucucagaaggaagcaaaaaacuaaacaucuuacguuuuaguucacaaguaauuagugacaauuuaauaggaauuuaaaguguuuucacugcauuaauaaauaauuaacaccaauacagaaacagcuuugcugugcuucagaauugugaauuggcggauaagcuucuuaaagaaccagcuuaacaaggggcagcgccuugaagaacuguuucugaguucugucuucauguuuaaguaggcugagauuuaucugcucuccauaacugauaggguuugcuaaacugaggguuaagacgggauucaugcucaaguaggagaacucaacuggaugacaucuaagguucauugucaugcugcuucuuuaaauggagccauaaaaaauuacccaggccuggggauguguugcccuacauuguucaggcuggucuuggacuccuggucucaagcaaucuuccaacuuuggccucccaaaauccugggaugaugggugugagccauaccucauacauacauguaaccuagguuacauauguaauuacuaauuauuauaguuugauauuuuaaacuuuucauguauacaaaagauaaaauuauuuuuucuuauucugccagcaaucuuccaagcuauaugauuuauaaguuuucauuucuuaaaauaauaauaaccaagcauaagagaaaaguggucguauuagcuccguuuauugccaaacacaaaauaaauauugaaaauacuagaaaaaaugaaauugacaauguuuuagaauguuugacagaaagacauauuguacaaagauucaucucaccuuuguauguuucugcucuggaauauaaaaugagauaauuuccuaugauaaaauuuauuuuuuaguaaaagagauugugugugugaaauuuucuuuguucugauaaaagaguaaauuaauuuuaaauacgauuuggaauauaaauggucguuugcugaaggcccaaaucgcucauauuuaauaaugaguacccaugcagacagcagggcuuaauuugacuuguaccuguugauuuuauaccacaauggugaauaaugaaaauuaguaaaaacacacuuaucuauagcacucuuuaaauaauuucauucaaaauuuuacaggaaaguaauuaaucauaacagaaaaauguauuaagggugagggaaaauuaagcauaaacacagucaauauuuucauugucuguuaauucccaugagauagauaaaagaaggaauguggcucaaugcaacucucugcauucuacauuuuaaauagcuucuguuucuccaagaaaacuuguauuuuguaccaugaaucaaagcuuuauaaacauaaaauaugccuucuuaacuuuguucauuuaaauuuacuuuuuguguaaggagaggagagaaacuaugcaccaaggucaauggaaaaaagcagccauuucuucagccauuacauugguucucauuugucugagggaguggucaggcauauggcauaagauguauucaucugccagggcgcgguggcucaugccugucaucccagcacuuugggaagccaaggcgggcagaccacuugaggucaggaguuccagacgagccuggccaacaugauaaaaccccaucucuacuaaaaauacaaaaauuagccagggugguggugcgcaccaauaaucccagcuacuccagaggcugaggcaggagaaucgcuugaaccugggaggcagagguugcagugagccgagagugcaccacuacacuccagccugggcaacaaagcuagauucugucucaaaaaaaaaaaaaaaaaaaaaaaaaaaaauuacuaauuuuacucuacccuuugccuuuacacuuauaggcagauuacaaaaguaauuaagugaccuacaguucuguaaaauacaguaguaauuguaauuuccugauuuuaaacauuuagccuauugggcuauuacacagcuuuauucagucaacaaauauuaauauuaauaauauucauuucauuuuucaaauagaguaaguccuuaagguuuuuggaaacugggacuuaaguaaaauggcauaaaauaaaacacuuuuuuuucucaucaacguuauaauaaaacaacgucuaaucaaacaacauuaucugagggccugcuauacagccuuucacuuaaagucacaguuucuaagaaccuaucaaagacuugaagaccugcuguacauauucugaaaucaccaaaaacaauuaacuuuucuauaacuuccaagccuucuuguacacuccaaaggucaaaccaagaaaacacaaauuuuuuuuuuuuuuuuuuuuugaggcaggaucucauucugucacccaggcuggagugcaguggcucagucacagcucacuguagccucggccucccagguccaagcaauccucccaccucagccucuagaguagcugggaacacaggcaaacaccaccaggacuggcuaauuuuuuaauuuuuaguagagacggggucccuauguugcccaggcuggucuuaagcaauccuccaccuaggccucccaaaauccuggaauuaugggugugggccacugcuccuggcccaaaacacaaauucuuuaucacuuguuuaagugcauaggaaucgauuuucuaauuuuaagacauaagagaaaauuuaauacaaauuuaaauuuuuggagacaacuauuuuuauacuucuacuuaagcagauguaacauuuacaaagcauuuagagaugucuuucuccagguaagauaacaauaauuuuuaacacaaaguuagaauuccaaggcucaaaugagauaucuucugguccuuucuuguauuaacaggaacuuuaagcagcaaaauucuaguaaacuugaaaauuacuuaguuugagaaucuugucauaucaacucuaugcgcucaaauauaucuaaauauaaucuccccauuuaggcaguaucuguguauguaagcauauuuugcuuaguuggaggcuugugauuagaagucacaagccuuaagaaaagaugagcgucuguugaaagcucucucccugaagcauucaguuuuuuccugaggucaacauggagguaagaaugaguuggaaaauaagcucauaucuuugcaaacaaggauuguggggaggagaaaaaucauaauaugucuucaaaacacuaaggagaaguugccccuacaggcaaccuguuacguucagaaggcuuaucugccucucagcaccugccuaagucagccucaauauucgccaagcaagccuuccaaugcuaauuuaaugucccaguggggacaccuacuuugaagagauauuuccaguguaaauuauuaaauugaucuuagagcacacaaauugaucucacgugaguuucagcaguaugagucaucccuccuucccacuccccaggaagaucaaauuuuguuaguuuguaaaaaggcagaaagaauaauuuaaaaacauuuuuauucuuuagaaaaaggugguaacaacagaaaugucccugucuaccuuauuugcuuuuacuuuaaguucacauucauuuugcaguugcuuuuaggugacucuuagcaauacuugcucuucuuauugagguuguucuguuugcuccagagggacguucucaucaccuguuuuggggggaauuuguguuuguuccuuuguuuuguuuuuguagaggcagggucucccuagguugccaggcuggucucaaacuauuggccucaggugauccuuccaccucagccucacaaaguccugguauuacaggccugagccacugugcucagcuccuauauucugauuauuacauauagauuuaaagaaaugcacugggucaagucaagacugaaggacaaucacuuuccacagucagggaggugaacaguagaacguuuauggaucauggcucuguuucuguaggggucggaugaggucagacaaggaaggcccuagaaguuguauucaggauuugggcuguugucucaggaaugacaggaagucauucagggguuuuuaacagggaguggcaaaaucacauuuuuguuugaaaagaacauucuggcugaguaugaagauggcaaguguuaagaaaagcaaaguucuuaaugauuugguaaauugcucuaaagacaacaaaaaaagguagacuggucucugcagaaguuucuauugcaaagacuuagugugacuaaguggcauguacccugaugaauuuaccacugucuagcuuugcacggucaccaacaauuggacugaacucagcucuuauuauggagguuuuauguacaaucaaugaaacaucaaaaguuaaaaagagagagagagagaaguuaucauuguucucauuuuagagaggaaggaacuaagacucagauaaagcagauaauucucccaagugacaaaguuaguuagggauuaaaaugagcucauuugcucugucugauuccaaaucucccaugcuuuccccaccucagcacauagacuauguuguaagaaauucgauugcccaugaaccagagaguccccccuauaaaccaacugccugggaaacuucaacuccuugaaaaaaagacagaaagacaggcagagacacacacacacacacacacacacacacacacacacacacacacagagaaggaaggaaggaaggaaggaaggaaaagggggaggggaggggaagggaggggaggggaggggaagggaggggaggggaggggaagggaagggggaggggaagggaggggggaggggaagggaggggggaggggaagggagcggagaggaggcgaggggaggggaagggaggggaggggaggggaggggaggggggaggggaagggaggggggaggggaaaggagcggagaggaggcgaggggaggggaagggaggggaggggaggggaggggaggggaggggaagggagaugagggaagaggaggggagggagggaaaaauaaagaaaacuucagcuuggucacugugaagcaaacucuagucuacuauugacccuaauuuguaaauuuugacaccuccacuccaaaagagaaagauaacauuuucuucccaaggauucacaguuuaccuaaaaauaguucacuucuuaauaaaaccuucuuaauaaaaccuuaaauguuuucucggugguauacaaauuuuuuacaguuuucacuaacauaaaggauugauguuagccaaauucuuuaugccugauucagauguuucuguauaauaacuauugauugaguaguuuuccaugucauggacuauaagcaagugaaaugugaaugcacuuaugauagucaagguuaauuaguuaaggauuuauauuauaccucuuuucaaaacucauuuuagauuauuguuuuacauauuaauauccaugucucuaugaagucaauaucgacagggucaauugcaucuuuauuuuuaccuacuuaaaguaaagggaggacaauuuuaaaauuugcaaauuauguuccucuuugugaaccuuaacuuacacuaucuauuacagggaaacaaguuaaauguuuuguauaaauguccaagaaauaucuacagcacuggaauuacugugagaaguguugcagagaaucuguauauuagagaaaaauugggugaacaucauugggaaaccaaaugucaaguaguuauuaacaccgcucagcagcaagcgaugaaaccacaagaagcauagucauagccugugggaggcagggagcagagaaauggaagggaaaucuuugcuaauccagauggcacaaaugagucccugaucagagacgagugguguuaucacucagccuaccugugcccuguucagugauaaacugagcagucaaaccccgucagguucccuucacugcaugcuuugaucauccuuuaagaagguuaaucucaucgaacaacuggugaauuuacugucaauauaauagugacauuucaauuauuuuuaaaaaguaaaaaugaagaacaucagauaacaaagauguuuuggagucuugguugacaauuaaccaaauucaguuuuagcuaaguagauugugugcaacuaaaacuggaagcuagaaaaauauagaauuuaaaaucaaaagaucagcaaucagauuaugcuguucuauuuauuaauuacgcccauggacaaguuguaaucuuucaaaaucuugauuauugcauuuauauaguggggaaaacagcaucaaccuuguaaagcuuuuauguaauuuaauauauaauauauuuaaaaagaaauugauaaauuauaaaaugucuauaaauuguuuuugguguuauuuuagccaccaggugaaaucauuuuaauauacuuuggcgcuacauuacucaucuccgaauauuuuagauugugcaaugcuaacgauacaauuuugaguuuacauucucccaaaauguguguuuugaaaaauaaugcuucuauuucuacacauuguuuccauucuaaaacgaacacuagcuaaucaucaauaauacacauacaaagucagauuuaauaacaauaguggaugaauucacauuucaaauugcuuucuagguaauuuuuuuaucucugaucaaucucuuguaaaucaucauugauuuuuaccucaugaugugacaaagaaagaguuuguauugggaguauaaauaacaacccugucauuuucuuguugauuuuguuugcauuuuuauuguaagacugguucugagacuuuuuuuaagaaucuucuuuagccaccuuucauuuuagaagacguagaagacaaauacaauagguguguagucaacccaucuucucccugggaaaccuuggcaccacacauaaaauaugaucaugugacauauggaaguggaaacaccagugucuauccauauauuaaauaugaacaaagccgaauuauuuccuaauuuauuucuauuuguagauaaaaauuuuaaaaauagguuuaaguuuuucuucccauauuucauuuuccauauccugcuagcaccuuuacuuugagaaucaauuccuaaauaaaacuaagaauugccaauaaaacaaauaaauacaucuuaauuucuuuaaaaugaucuggaaccagccaggcacaguggcucacaccuguggucccugcuacucgggaggcugaggugggaagaugauuugagccugggagguugagacuacacucaccugugaucccacaacugcacuccagccugagccacagagcaagaccuuguuaaaaaaacaaaacaaaacgaaaaacagaaccacucauuuuucucccaugauguuaguaguauaaauaaauguugaauuaaauagagauuuggaauugucugaucuguuucauacucauuuaggagucaauauucacuugaaacuuucaaagguauauuugauguuuuuaaguuuucacaauaauaccaaauuugaacuuacaaaguguucacuuaggugguauguauuuuaaauaucaacuuaguuagaaaugugucuuagcuuguauugaagagaacacaaaacucgaguuuccuauuaaaagguuacguaaacauucacuguguccaucuaaauaauuucaggcaauguuaugugucuuacaauaauugcuaggacuuaggacacagcguuuuauaaauauuugaagaugugauauucuaguuucaggaucauguuuuauuuaaaauguaaaacuuuaauauuaaaauuaaucauuggaaucaucuaccaaauucagcugugccacguagaagacagcaguccuaacuucagcaauguguaguucaaacuucacuaggauguuucaaaacuucaaauacucugaccuauuacuggagcauucuguguuuuaagaauacagccacaguaucuauuacucaaaacucauacacagaauuuuguccauuuuaaaacuguagccuaccuuuaacugauagggaacgguaucacugauagaaaauuccagaugucucaggaacuuacuccuaaauagucccuuaucuuaucuagugauuuuucugagagcaaacauauguuacucuaggacauaaucucaguuuuuaaaacuucauuaauaucaaaugaaauaguauaaaugcaccucccugaaucacuuuucuguguccuaacuuuugguuuggauuucaccuacacauuaaaccuguuuuaacaauuauccaaaguguuggcagguuuggaaagucucugccuacauauaaucauuucauaccaggaggagagacagacaaggucacagaugcagucgauggagcuagguauguagacagugucugcaagcaucagagaaccaagcuuugcuuuggagcuuuaaaacauuucuccuuugccuuuuuagcugccacguugggggcaaaagauacaaacguccggucagaggugaaagaucacggauaagcgagaccauuuagguguagcauugucaugagucuauacacaauuggcguguguucacaugucuaccagcuaucaaauaaaagacuggucaauaggcaagcacugaugaacauacaucuguggagacucaaacagcaaugcuaacauaaacuuuuucuuucuccucuuccuuuacuuuuugauuuuagggcuuuuaggucucuacuauguuacuaagaggaacaaagcauauaggcauaugguaagguacaauuuauaauaaaauagaaugucccaucuuuauuaauucaccagccacugcacacuaauaaauuuuaugcacauuauuucauauuuuauccucacuagaauccuaugauauaguuacacuuuuacaaguaaggaaaccuaaagaaauuaaguaauuuuuuuuuuuuuuuagauggaaucucacuugguugccaggcuggagugcaacggugagaucuuggcucacugcaaccuccaccucccgggugcaagugacucuccugccucagucucccgaguugcugggauaacaggaaugcgccaccacaccuggcuaauuuuuguauuuuuaauagagacaggguuucaccauguugaucaggcuggucucaaacuccugaccuugugauccacccgccucagccucccaaaguguuaggauuacaggcgugagccacugcgcccagcugaaauuaaguaauuuaacugaagucauacacgagguaagugaaaagcuaagacugagguacgaaucagaguccuucaauuucaauauauuuuuguuaaguguucaauuaguuaaaauugauuucagaaaugccaggaaaguacccucuuuaccucaucagcuugccgaugcuuaaaauucuaccauaaaagguuuauuauuuaguaggaaguuacucaaccuuuauuaaaaugaaaauaccucugguuauaggaucauauuaugucauaucaauuuuuuacaccucugugugaagaaaaacuguguucauuggaauguacucguuuuaacagaaaaaucaaacuugaacuaacaccagaaaaaugcauauauuuugguucagaugaucuaaaaaauuaaacauagagcugugacccgccuuggcccauguagaauucugccuccuucucucuguaauucuuguaggucaacccucauccucacagagggagcaagauggccaagguuuccaggaauugacggucacuucugaaauguucaggaaaggaaaaggaaguuucugcucccauccucacccugagaaguuccucagguaaucuugcauggugucucuuuggcucagaagguuccugagccagucccuguggcuggucacugaauggcuuagagcuucccaagcuugcagcaagcacuguagcaaagagaaugagauucuauugguaggauuaggccaggaguuaguaaagcuggcugggccuccaaacaaccccaggagcuuugaaaaugucuaugccugaaccauauuccagaaaaguaaggaucagauucuagggguggaggugugaaagcaugcaugaagugggcagccgaugacccuacuuaugaaaaucugcccaaaugauacauaauguggagacagaauucagaaucacugaggcucagacucuccaaugaggguucauuacuaguaccuaauucauguggcugcaagacaagauaggagcggccaagugcagggagugaucagcaauucaccuggccuuaauaucaaaaggcaaguauugaugacagaagaagagugagauaggaauuaauuccuugagacgugaaaaaagggcagacaccuguugacagggaggaagaaauauagaaaaaaagaaaguaggaaagaaaauaaaaguucguaucaacuacuucacuuaaggcucauucuugaucauugcaaagacaacaauuaucacuuccacuuacauaaaguauuuuuggaaaguauuuucucaccuauuguuuuuugcauaugucauauuuuagcugaauuuuggaguuuccugauuuggucggacaagaauuguucugauaaaagcaacugcuuuuacuaaaaaagauagacgugacuuccacacaaacauucacacacacaucgacacgcacacacaguaaaaauccuaccguuaacuuaaacacugcuaauugaacauguugguauaguuacuucaaucuaguuuaaacuuuuaacauuuauaacauaauuauaguauauucauaauaugauacguauaguaauuuauaauucuacaguuccuuucacuuauuaguauauaguacuuuuuucuacauuauauauuuuuuuaaguuuguuuuagaugucuaauauccuauuuauauauuuauaauuauugauugauuccuuaagcauguuuuaaaaauuauuaugcauauuauuuuuuaaaagguugcaaaauaauuuugcugaaugaaaaauuguguccauguuuaaauuagcauuucuuugaugacuacuacaguuauauuuuuucuguacuuugcaauuuuauucccucuuuuauaaauuauacuuauuauuuuuaugucuuauucauguggaaauucuaaacaaauuauuuuuucauuaacuugaauauuaauuuuuaacuuggaaauuucuaccuuuaaauaagauuauuagaauuucuaauaacauggauauaaauguggauacaaauaggauacuacaaaguuaccuguucacagaaacugauuaguguguggaaguguguguguguguguguguguguguguguguguuuaaggaaaugaauuuuuuaaugaaguaacaagaacuucuaugaaaaagaugaauaauuucuucuaaccagcuucuaaacauuuauauuauuccauauuuauuuucaauaaaaaugcauaacuuuguuuuaacaaaacacaauuuuacauuagugauacagcauaauauuguaauauacuugguagcaauacuuauauuuuaaacacaacaaagacaacaacauucauuauuuagguuagguacagaggugguuuaugacaacuuucaaaauccaaugacaacaggaguuucucagagagguucuuuauccauuucacuauauucuugagaagguuucaaaaaguauuguuuuugagacagugaagacagcauaucuucuaacaaucuuuguuccuuuuauaauaagcccaguaagaaccuucgaagaaaagaguuuugaagccauuuauaaugaucuaucuuuauucaucauaugugcgagggcuaccaacuucuuaauguuccuaucuccgacauacucaucuaaaccuaucucagugcuggaaaauaacaagauggcauucaucuauccuuucuuaugucaaugacuauuuuuagcgcuguaauaaaagugggcuccaaccagaaauauugguuacuucaauuuuguuaucuucauuucaauccuuaauuuggguuuauuagauuccugcaucacuacaaaauaagguuaaucaaucacuauuuucugcuuuuugcuuauacugucaggcaaaaugauaccuucaagacauacuaaaucauaauuuauguuugagugaagcugugcuuuuaguuaccuuuuuauacuaagaagcuagcacaguguuuggcacagacuagacacaucauuuacuuacaaccaaagggacuaaauagaaaccacacuuuuuucauuuuuuuagugagugggagucugauagaacauuacuauuuuauagauuauuuucacauauauuuuuuaaacuuuucuucuccuuugauuucucaucuauggaguauucuuuauucaucaucuucacacugauguuacauaaaaggcauuaauucaaauuccagaaaaaaagaacagagaccuuuguuucccuauauuucaagacacucagaauuucaaauguuuacuuugucaaaagauugggaagaagaaaugcaggaaauuacaucagcuaucugcagaaggggcaaaauggaaaaaucucaaauauaucuugaguuaguaacuuugaagcaaucucauaggaauggaauuguauuagcccaucuaaaacuauaggcacaucaguugucucaagagguugcuuaucauagaaccaaaaaaagucugugggaggcagggcaugcuaaucugcugacaauaacauuucaguaucuuuugcuucugugucucccucacgugcccauagcucgaucccguuacauaguaagaugauaacccaaaugauuuuaugcaucucugcuuucaguuuucuuuuuauuuucuuuuuugaaaauuuuucuuucuuguccuuucaucucuuauuagucaguugaaaaguacccacuccacuuucaagauaugccagggauaauuuaaugaauucauccaggaagcuuuucaugaaauuucuagccagaccaaguguuccuguuuggaguccauuaguucauuggcaugcuggacuuguuuacuacuuucuguuuuauauugcaauuuucuauuuacaauucuuuacaaaauguuucagccuuaggaaaugaugggaaguuuccuguaagauuaaacaaauauaaaccccaaacaugccugacuucuuaauggauaagcaggaaauaaaagcuucuuccaaagcagcaggauuaucaagagcaggaaucuguguaucuuuacaccagaacuuaaccagagaagugacguggcugcucucuaugauccaauucuaugugucuuuuaccacugacuggcucaguauuuuccuccagacuguguuauuucccuacugcaaagcuuuuuguuuauucaguuccuuguucaauguaacaucagugguugcaagcugccguucaugacuuuuacuccuauauauuucuucuuucuagguauuuauauuaguuuccuaaggcuccguaacaaaguguggggccugaaagaaacagaaacauauucucugacaguucugaaagccagaaguucaaaaaucaaggugucggcaggaccacacucccucugaagucuccaggggaggauccuuccuuccuucuuccagccucugguugcuccaggccuccguugguuuguggcuacauaugugcacugucugucugugccuucauucacaugaaccucuccuguguguccucuaccuuucugucuauugcauaaagacacgcucauuggauuuaugaccacccacuuaauucaggaugaucucaucuuuaaaucuuucacuuaauuaccaguacaaagacauuuuucaaauuaggucacauucacagguacuggguggaugucuuuuggggggccaccauucaaaccacuacaguaucuuugcaacuucucuuuacacuucuaauucagucauuuaguauuuuuauuuaaauacccaagcacaggaaucugauuugucaggguccacaucuucuugcuaaagcucagaugauaggaugccgccaguuccugcuuucauacucuuucaccucaguccauucaaauguggucaaggcacagagucacaugauaccuaacauggcugcugaggcucagcucuuucauggugccuguuggcagggcaggcuauggcuucagcagccugacauaacuggaaguguccaucuaguccaucagaauucaggaacuuccacacaaguagggauuaucuuauuauauuuuguaaucccagugcuucaaauugugcuuuguauauguuauacguuuaauauguauuuuuaaacugaaacauuaaagauucauucauucauggauucaauaaacauuuguuaguaccuacuacaugacaggcaguacaguuagaugccuugguuaagaugaugcauauugagauagguuccauaucccaauagaguuuuuagacuuaaagaggaggaauacauauauaaucacacaaaugaucaguuuucauugugauaaguucuaugaggaguaucuaucuucuuagaauugacuuuauguuuagcaaauaaaugucugguucuaauuuggcuuuuuguauagguuuuccagagggaguaaauauauucaucaguaaauaugauugucuugguccccuugacaguucuagcuaucauugcaaauuaauaaauggcauucugguucacguacuagucucuaggaaugugguuagcauguuugcauucaucuccucuggugccacugacauuuugcaggauauuucuuaguugugggugacugucuuguacauuauaggauauuugguaguauccacggccuugacccacaagaugccaguagcacacaacccccucuugugacaaacaaaaaugucuccaggcauugccaaauuuugcuaggaagcaaaauugcucccaggagggaaucauugcucuaaaaguaaaucaagcaaucugaguuauugaauuagguaggaaugggaaaugcgaaaccuccaguucuauaaacgagaaucauagaaucacauuaaaucgacuaguauugugccuacaucgcauucuugugguugccaguggauaugugugcuuaggaagauauagaggcucauguaaaccaacguguagcaucuuaugugauuuacauuucuuaucuauagccaauuugccagaagggagacacaaguuuaauauaauuugugaacacaccccacacacauguggguuuacuuugaucuucagcuuuggaaauaaucauuuacagaaauacagacugaagcaaacuucuuauacaauauauuuucuguguucuuuauaucauaucauucuuuauaucaauacccuucuauuuuaaguguuuuuauuuauguuaaaguugaucauucugaauaagaaauacuauuuuaaaaacuuauucggagucagaagaucuggguuugaauccuuccucuauucauggucacuauagucuuguuaaguuacuauuuuuuaacauuuuuaaaaaguucuacaauugaaugauuacaaauaaauauuauaaacaauaagugucaugaauuuuugagaugaugaauaugaacaugacaaaagauccaugugaaaaaucuuaucuauuugauacagaaaaugagagggagaauugacuuucaauggacacuuguauccgauguuugaaccaaaugcauagugcguauuaucuucauauucaggaucuaaaaaugcaccaugucaaaaacaagucuauaugaaagccugggauuuaaaacuauagagggcaaauagcuuauuaagugccaaaagccaaaucaucucuguugcagauaacaggugucccaggugaagguucauguuugaauaacaccgcauaaccuggcaucaguguagauucccacugauuucacugagauaaaaacuaaaaauaaaaauguuuaaaagacaaggaacaaaagcccacucuuugcucgaaauguagguuaacuguuauagagaaugcuuuuccuucuguugaaucacaccugacacaaaguuuucuauauauuuacucagaaaugaguuagaauugcuccugcacugcccauuucucccucauugaauccuucuucauccauggaaaaccgauugcugcuuacccugccucuccuggguggcuugaagaacuuuaaugggguggaaucacauaauaacuaagcauucccuggucuggugaacaaacugcacauacugaacaaauaggggcaaauguuccuccaaagggcugaugaguacauuugcaguuuauuuuaaaacugccccgggguagcuaugccgucucaucuggucucuuuauguuuguguuacuauagaaucaaacagaugccuuccuuuuagucuggggcuguaacuuccaaaucauagaagaaugaaaacucucuccugauauucaacucagaacgcaaaacucagcuuccgagucacugggcuccaugacaauugucaauacccauuucuuacgccauuugcaaagcagcccugggaggcuuacuuaaaagguauguugcugugacugcccugcccauggcuggcauugccagcauugugcuugacuuggaauaacuugauuuugccccuucaggcgcuaugugucacaagcacuggagaauuuuaaugggccuuuagaaauuaagaacauuaucuggcauuuacugagcauauaagguauauuaggcacugcagccaagcacuuugcauauauuauuauuucacuuaauaguuacaacuauuacauauguauguguauauauacacauauauauguauauauaaugucaaggucuuacacauaaggagaucgaacuaacauuuucugauuugguugcaaaugaccauuuccuuauguaugaauaauauaccauuuuuauaguauuuacauuuuauucucauucugaucugugaggauuaaauacagggucaucgccuuguuuuacgaagaaggaaacuagggcucagagguuuuaaguaaccggccaguacaaguaaaagggucguccuuaaaaucuaggaccacagaccgcagaauagguguucuuucccuuguucugcuauaaauagaagaaaaucucuuugauccacagaaauauauaaugauaaucaggcaugagcuuaaaauacccugagagaacaaaaauuuagcuuaccagugucaaguucuucacugauuuuauuucagaccagaaguuagcacaucuggcccgucaucuauuuuuguaaauaaaauuuuauugaaacacacccacccccauuucuuuagguauaauccauggcugauuuuguguuacagccacaaucacaggauugaguauuugagacauauauuguguggcuuacagagccgaaauacuuacuagcuggcacuucacagauaaagaucaucaacuccuguucaaaaucauaagaaauuaucuuacauuuuuauauuacacuuggccuaguuauaguugugaauaaucuuuuuuauuauuauuaggcagucuuaggaaaauaucaguccuuauaauacagauggaaugaguucugauuuuuguuguuuuuuuuuuuugcacgugacgcauuuaauacuaaaaauacauuucccaaagcagaaauuuguggcuuugccucugguuaaauuuuccauaucuccccaugucuccuuucugaucucucucucucucucucucucucucuuucucuuucucucacccuuccacccucaccaucccacacaugugccaaucuguaccucacucccucccagcccaauguaauaggugcuuccuccaccugugcugccaauucuauaccucucgcuucuuggugaacuccuccuucacuucuccuuuggucucaucuauuuuagccuauuuguucuuucucauuaauguuuacgcagguucaaaucuucccuaacauaaaaagauuccucaggucuuaccucuugcuccagcuacuuuguucuucuaucuuucauaaguaauuuccuaggaagacuuguuuacaaucaaugccuuugucaccauuuacuccucaaucuauugccucugacuucuuguccacacacacacaugagggcacauauuuguauguggaugugugugugcacauacacacacacacacugauauacaaacacauacacauuuuuguaaaugcucauuacuucuuuaugauuaauucacaauaguggaauugccgaguuaaaggauaggucacaucuuaaccuuuucaaaaagccgugcuuggacuucuaccagcggggagccagaguacuucacuccaaggucauugcugaaaguggcauauuaucauuuauuaaaauguagccaauuggagaaaggagaauaacaguguugcaauguaauauggguuagcucugugucuccacccagaucucaucuugaguuguaguucccauaauccccacgugccauuggagagacaggguggaaaguaauagaaucauuagagugauuaccuccaugcuccuguucucaugauagugacugaguucucagcucugauaguuuuauagggagauuuucccccuuuugcucagcauuucucuuugcugcugccaugugaagaaggacguguuugcuuccccuuccacaaugauugugaggauccugaggccuccccagccauucugaacugugagucaauuaaaacucuuuccuuuguaaauuacccagucuuggguauggccuuauuagcaguguaaaaauggacuaauacacaguguuagauuauuuuaguuuuauuugauuacuuauaaaguuuuaaauguuuucaugaauuuauugguagaagauggaauuuauugguagaagaauuccaauacaaguucuuugagccuuuuucuaauguaaaccaacuuuaauauaagccagcauuuuaaaaauuguaaaauauuuauuuuuguuuuaaccaaguuguagcaauaguuuaucugaaauaaagaugugcauaaaucugaauaaacaugguuuuuaauuuaagaaaauaucaagaaacaacuuaaaaugucaaagauuugugaaaauuguggcucucuaaaguaucagaguaauagagaaaauuuuucaaaauuauaaaaacuaaugguuauaauuucauuuaacauuucuccuugaagaaaauuaaaaauauuugaaaacuaaaauagaacaauuuuaacuuaacauuaugaaguauguuucuguuuucacaaguucuuaauguaugagugaauaaaccguauauuauuuacuuuaaaaauuaaaagcuuuuuaaaaauacuuuugauuauuuuauacuuuuuauuagggacuuugaagcuaaggaguuaauucaauuagauaagaauuaaaauauuacagaaauuuguaaaauucuuccaauuaucuugcuaacuagacagucuaauauuagauacaucaaaacaauaauccuauggugauucuguacaaaauacauaaaaccauauaaguaucauuugccacugcugagauguaaauauaaaugaaaauauaaauaaaauguauacauaaauuucuugguuucagggguuaagguuugaugauaaauuuggucuugaugacuaaauacgauuuuuagaaauccugcaagaaaagguguaagacucuuuuguaccucugacauuugugaaauuaaaaaaagcaaaccauaggacaacacauucugagaaaaaauuggcaaguacuacuaaagaauaauccuggaggaaaccauaauauuuuuaagaacaaaugcuuacauuugacuccaaacuaacuuuuuuauuuugauguuuacauacucauuuuuucacuuaauuuaauuucuauaacucuauauaguuuucugggauggggucuuguacauauuagguauucaagaaauguuuguugaaugucucaaucugucuuuugcaauaauugacccuuuaagguauuuaaauuuaaaaaguuaaauuuguguuaugugugaaacagugugcuuuuuaucgacaauuaaauaaaauguuauaauuuagucagaacauuauaaaucugggucugagcugaugugcuuuuuuaagagaccauuuuacaaucuaaggcuuaaagugguagauaaucuuugguccuggaauucuauuucagauaaucuauucaaagaauauaauauuuauguaaaaaaugaucauaaaacaucuuuuggaaauauuaaaauuguuuaaaaguuaucuucuuuucuucuguaugaagucaacaauauuacuauuauugauuaucaucaaagcaacugaauaaaauggaaugggcuaaucagaaaaauuaugaaauugaaguuucuggauaugaaaucuuuaagauaauugccaaaaacaaucaaaauucaucuauuucuagacaccaggacaucaucugguggaagggccacucaauugcccuuaauucauuuuaccuagcacacauuuaucuacucagugucugccauacguugagcacugugcuaagugcuuacggacaagaaucauuaaugguugaauauggagggucuugaauucuauacaaaagaauucuauacaaaauucuauacauaaacuauaguuuacgcuguaggcaguggggcagacgaacaacaugauuagacuccuaauuuaaaaauaaccaucgugaaaauguggaggauggagugaguaaugggagaaaguccaguuagaagacccuugaaauggucccaauaagaguaaaaugaaagccugggguaagacaguagccauaaacacugaaagaggaaucagguaugaaguccugagugaugacauguuugagccucccauguuuaacaaagacagcagcauauaaaagaucuuacaauauuugaaacugaagagugaaaaaggcaaugauggacuugacuucccuaagaaaggucugcugucaugguuggccaguucagguugccucucauccuucauaauaugaagccaauuggccaugccacacaugaagcaacagcuaucugaacaaggcagugcaaccgcuggaaaguguauacagaguuaguuggaauuaauaauguuuacauuuguuuaaguaauuauuuaaauauguuuacccuuucgguuguuauguugaacaguaauuuucuucuuaauacuuaaucccaacacaaagacuucaacaguaaaauacaguaucauuguacuacauuuuccuuuaacuauaaguuaugcaacauaaauuuuggaucauuuuuccaaaccaaaacuagcaauacuuaaucauaaaauuucaaguuuauaagagaucuaauuugguaacuuggaaugcaucaguuagcauaaucaauaggugguaccaaugccaccuuacauaacauuuccuuuaccccaucuguaggauaggaucccuuccuaacucucccauuacacccuaauugauugauugauugauugauugauugauuugagauggagucucgcucugucaccaggcuggaaugcaguggcgccaucucagcucacugcaaccuccaccucccagguucaagcgauuccccugccucagccucccaagugccugggaccacaggcgcgugccaccgugccuggccaauuuuuuguauuuuaguagagacgggguuugaccauguuggccaggauugucucgaucuccugaccucgugaccugcccaccucagccucccaaaguucugggauuacaggcgugagccaccccaccuggcccacccucuuauguccccaguauggcacucuuuugugaacugcuaugaagaaucucuguuagaggccaaaggcuuugaucauuagguaaagaugaugguuuuaaauuaugcuuuucacucccauugccuuguagacuuucacagcuauuguuuccaguguauuucagcugaguuucacccucaaaacacagguguauguugaacuaucuucuucuugugaaucuuuugaccaaucaauaaaauaagaccacguaaauaauggauaugcuacuggauaacaugguaaaauauuaauuuaccuuuuguucccucuugaaagaaugugagcuauuuuucccuuaauucuauuccaagaaaaaacuaaaugaauuauucuuucauuuuccucuuuucauuugggugucuuuagguugcaaguuugaaaaacagaccacucuacucaggagcuguuuuggugguggagauggaaaagcagauccagauagaaguaaacaaaagaacucugaaaggcagggaguuauaagauggaugguuauucagccagaggggagauggagucaugccucuccuacuuagggcuggguccagguacuguuuuguuuuuuaauuccuuugcaacaugaagauuuauuugguccacuuguggcaccuccaauugguuaguuaacugacuauaggaugaccauaaaagauagccauuaaacugugguucuaaagauuucugcguggagggucaggguuucaauagagggcagaggacaagauucagcaccaccuuauaguagaaagagcaaagguaacuacgauaaacaccacagacuaauggucagagcuuuccuguuuucugaguauaacaugagcuuccuggauauucauucgacugacacuaggcaaaguuaaaaguucucccaaaguugauugaggcugauuuucuugcugcuguguuuagcgagagcucugaagaaguuauaauauuaacaugauuaagaacaaaucaugugguguuuuucacuagauuauuaugaaguccauguaugaccacuacacauuuauaaauucuaauuucucuugcuuccaccauuuccacgaggauuguugcuuucucauguuguuauaccuagaucccugcacauauguuuauugaucaaaugaauaaaucaugggauauagagcaaauggggacucuuuguaucauagcucuuuuuaauuuuuauaucuauagaaaaucugguuuagaggauuuaugcccccauaguaaucuuaguccauuagugcuacuauaacaaaauacuguagacucagugccuugcaaaccacgggaaugugcaucucacaguucuggagacuggaaaguccaaguucaaggcauccacagauucagugucugaugaagucuuucugauucaucauuagcuggcgcuuucacccuguguccucacguggugaaaaggccaacgcaguucccuggggcuucuuuaacaagggcacuaacuccaugaacuaaucaccucccaauagcuccaccuccuauuaucaucaccuugggguuuaaauuucaagauauaaauguuggggacacaaacauucaguccauagcaaugguauuuucuauuuauuuuuuauaauaucuaggaucuaaaguucuccuucaauuagcaccuauagcaguucuaauuacacagagaagacuacguaaauacagaaauaacacauggccuagauguaaccggcuuccaauuggcuaucucugucuccacucuuuguauaacuuagagcaaguuucagcgcuucacaguauuaauugcuauaugaauauaucucacaaaccacuaugacaaauagauauuuuaauguccauuugaugagcacauaaaaagaggguuacuaaacaguccucagcauuuacagcugagaaaauccguaucagacauggacaucuucccuucuuuccugauauuugccuccucucuaccacccauccucaaucucccuuuauuuuaugcaguguuuuuuacaacuacacagguuucuccaauuuuguuuugauauugaaauaccuaucugcuguugucgugauacacaaauaccuaugacuucacacuguguucaaguaugugacuaaauauuuuauugaaggcagcuauacacccaacuaaaaaaaaaaaaaaaaaaaauucagcaaugugaaccuuccuuagaagagugugcuguggguguguugcagugaggauguggacggagugugaguaaacaaacauuuuuuuuuccaucacaucuuucuugucacaugugcaauuuaaagccagacucuacauuucuuucauagcagcccugucagcuccuccuuagaacagucuuuccuuucuauugucuuguuuucucuguuuagcaguuuguccuuuuuacugccucccauucugcugcagaaagcaauuuaaaauccuuuucuuuuuucucuuuaacauuacagcucacuuaugaauacagcuuauaacaaaaacaauuuuuggugagauagagaacaucagucucuccacaaguuaaauuuguauucccaaaauaaaaaaaaucaaguugugaucccaaaccaugccuuaucuacuguacuugucaagguuuuuaguugaaggcaacagaagcuaacucugggggauuuaaagaaaaacagaauuuuuuaagaguuaauuguguuagcauauagaacugugggaugcuuucaaacacuggcucagaaaaccagaagcaacaauggaaggcuagacacucaggaucaaagucaaaaaccacuccacacuucacugucuagugaagacaauaaugcuacuuuuucucaguacuagcugcuucagcuuacauugccuuugucucuaaguaucacugugaacugccaggucccaaagggagccuuugcuaaucuucucuccuugcauuauuuguucucagucuggugcuuacaauuggcucagcugaagucaugugauuauggcuuaugcucuggcuuucccuaacaguaaacuuugauaauauguguaucacccauagaacuuuaauagcuaauugcaagcgaggcugggagagggcaaauuuguucuuuuaggcuuccauggucuucucaaccaccaagacccauauguuauguauucuucaagcaaacaaagaagguucaucuccccuuagggacacaaaacaaaacaacuacgaaaacccaaauguuccaauacaacaacauaauaaugcagaaauuuucaaaauaugaucaaauugcacugaauucaguauucuacauuugaaaauauacucagcacaggcgcaguggcucaugccuauaaucauagcauuuugggaggccaagguaggugaaucacuuaagcucaagaguuugagaucagccuggccaacauggcaaaaccccgucucuauaaaaaaauacaaaaauuagcugggcacuguggugcaugccuguaaucccagcuacucaggaggcugaggcaugagaaucacuugagcccaggaggcagaaguuguagcgagcugagaucacaccacugcacuccagucuggaugacgggagugaaacccugucucaaggaaaaaaaaaaaaaagaaagaaagaaaaaaaaagaaaaucuacucaaaugaagaccuauuuuaaaaguuuagaaacaugccucaacaauuuccaacucuguugacauaaauuguggauucaauuaucuugucacaaauccacuuguaauuuaaaauugcaucuuuauaacacuuuaaauguuauuaaauggcauauaauguauaauguaaauaaccauacauaaugguaauaaucuauaguacauacauacauaaugguauuaugucauaaugguauuauguaugauaguuauauaacaugguaauaugagauauauguaauacgagcguuauacacagacacacauauuuuuuaagacaaacugaacugugaacuguuagcuuucuuagacucacacaauguucacuuuuaaauacagccauuagaauuuuauugucuuuguuuuuuucuccuuucagccccuaaaguauuaaaguacacauucauaaucuguuguuugucucuauaaugaaugugguuacucauucagauuccuuugaaacuaaugaauggcaaaccuuuaacaucuuaugauacaaugaccagaguggcauuuccaguggcugucauuuggcaguagcauuuggagcaucauaggcugcgaucccccuaucugcuuugaauggcuaucaccucuagcuuccacaacgaucugccucucucacauuaaauguguuguuaguaacugacaccucuggcauuucaacuccuucugcuucguuuuuucucgcuuccucgcuucacuugcacuuuacccuauuauuucaggcuuucuucccuaccaucagauaaccccacgugcuauuucuguuuccucaugucucuguuuucauugucaacguuuggauugcucccaccaucauucuugccaacuauuuauuagacuaauggaaagaauaauaaaaacauauuaaguuacucaauuuacuggauagauuacuuuucuuuucuuucuuucuuucuuucuuuuuuuuuuauuuuucagauggagucucacuguauugcccaggcuggagugcaguggcaugaucucggcucacugcaaccucugccuccuugguucaagcgacucuccugucucagccucugaggagcugggauuacaggcgcccgccaccacgcccagcuaauuuuuaguuuuuguauuuuuuaguagagaugggguuucaucacguuggccagacugguuucaaacuccugaccucaggugaucugcccaccucggccucccaaagugcugggauuacaggcaugagccaccccuccuggccuggauagauugcuuuucuacagggcaauguuuuuauucuucucuuguugacugacagcauuggaaucuaccaaagugaaaucacuuucuaacuuacuuauucucaauucugacccugcgaaggagaauaaauucauuagggagguccuacuguccuaaaaaggacacagucuuuaagucaaagacauuugauaaugacuucuucauuuagcuccguucauuucuguaucucacuuucucuauaaguaaauuaagauaauugcacuaacucacacaacuauuaugauuaccucucagguaauuuaucuggauuuaauguauuucccugucccuuaaaugggugaacauugagauguuucuauuuucccuuuauacuugcacuuagaggucugucuuugacucucuuuaauuggcuuuacaaauauuauuucacaggugauuuccaaucccauaugguaucccugaucucauuccagauuuuccguucucuacuuguaagugagaaaaaugaagccaaccauacccugcucugucuacaaccucuaggaagcuacaagagguaaauuuuuaucuaaauaguuaaucggacaggccuuuacaaauuaucauuucaaaguuuuacuugaaaauguaaggccuaaucugcccaugagguuagaaaaagcugaauuacucugauaaaaaaacccaagauuauauuuuucuacgauuuucuuucauauuucuccagagagguuagaauugaagaagagaagacaaugaaauggaacuacgcuuaagaguaagggagaaagggagauuuacaagucagaagagagcgaagaaucauuuuaaacaugaggcuuuuuauuuccuuccuuccguccuuccuuccuuccuuccuuccucccucccucccucgcucacucccucccuccuuuccuucaagggauucucuugccucagccucucaauuagcugggaucacaggcgcacgucaccaagcccggcuaauuuuuuuguaucuuugguagagacaggguuucaccauauuggccaggcuggccuugaacuccugaccucaugauuuguccgccucauccucccaaagugcugggauuacaugcaugagccaccacgccuggccaaaacuuucccuuucaaaacuauaauguuguugguaaguucuucuuacuaccccacuacccacaagcccaccacuuugugaugccagggcucucacaccuugccuggcacaauuguuauuaagguuuuaaggaucagauaguuaaggugauucuuauauauauucccaauuacuuucugcauauuuguaagcacaugccuuguuccuaccuaaaacuaaguauuucuaaauguaaaaucauauuuuuuaaacaaugccaaaauuagaugucuauuauuuuuuaucacagcgacuaaaacaaugacaucauccuuaaccccaacuuccccucauuuucacacuguuacuaaacuuugauuaaauaugaagcuuuuucaguaguagcugccaucaagaaaucuauuuguuauuuggcaaaauuuaucauaaaaacaauugcugauguaauauuuucuugcuugguaguugguugcuuguuuuuuauuaccaauagaaauuuugauuuguacauauuggaaaaauguuauaugcauuggaagagaagaaauauuucuuucuguaucuuaaaaggcauacaaaaguaugacuuugcucaacuggauuuccuggaaccaucuaggggaaggaaauuauccagagcacugauacuauaggccauuuugaaaaaaugucagauaaguaaagaccaaaggaguugucuaacgugcaauugaggggggcaaggauuuuagugaugguuaccaagggggucagcugaaguucugaucauuuuaggaauuaugguuuaaaaugcauggaagagacaaaguuuguucucacgauuauuagcugugcuaauagcuaauuagauccacuaguuugaguuuaucaugacuggugaaaaagaaguuaguggcuaaggucaugugcuaaagggguugaaaugaaauggcugaguggcagggacaggagaggaccaguguggaaaauuaucacccuucuggguccuucacgcuuuccaagcagaacaauaaaagaaacagcaacacacacacugagcauguuucuaacaaucaaugcagucgaauauuuaaaaauuauucuugaaauuuuucagaggugcuuguucauuagucaguuuaauuucauuucuuccuauccauagaaucauugguuucaaugccuuucaaacauaaaauauucaaaaccuucuaugaaaaaacaugucuagguauuacaggauacauuuucaaauagagacauaauauuuauuuuauuuggaagaaaauaaauuuagucucccucagcagaauaguucugagcuaaagacugaauuucuaaaacuguucagcuacaaccuuugcagacuacaauauaugaguuaucagaauuuugagacuuucuguugaggagaaaaagaaaccgauacccuagaaauuuuuagaagauuugaguagagugauguaguagcuaguuugggaaaggaaauuuuaauaauuacugcauauagguaauagggaaauuuaagaagcauaauugugugauuuuuuggugugcccucccucucauuuuuaucucuucauaaaacuauaaauucuauauuauuuauuauaauugcauguguauuugggauauaguugggaguugagagaugacuuaaaugagagcaggcaagcagaaggggcuaguucuaauugaguuacacauagaaaaauugugggaacuuuucacauaacauugugauucuuaucaauaaaauguuauuaauuuuuugaauauuaaucucaguaacuaaguguauuauuccauucucacacugcuauaaagauacuaccugacacuggguaauuuacaaacaaaagagguuuaauugacucacaguuccauguggcuggggaggccucaggaaacuuacaaucauggcagaaggcaaaggggaagcaaggcacgucugacaugguggcaggagaaagagugugcagaggaaacuagcccuuuuaaacaauuauauccugugagaacuccuucacuaucucaagaacagccugggagaaaccacugccaugaaccaaucaccucucaccaagucucucccucaaaacguggggauuacaauuugagaugagauuugggugggaacacagagcccaaccauauuauuccaccucugccaccuuccaaaugucauguccuuuucacacuucgaaaccagucaugccuucucaacaguccccuaaaguauuaacuaauuccaggauuaacccaaaaguuaaaguccaaagucucaucuuagacaagguaagucccuuccuucuauaagccuuuaaaauaaaaaacaaguuagcuaauuccaagauagagugggggugcaggcacgggacaaaugcucucauuccaaaacggagaaauagaugaaaacaaaggggcuacaggccccauucaaguccaauuccagcaggcuggccauuaaaucuuauagcuucaaaauaaucucuuuugacuccaugucucacauccagagcaugcugaugcaaggaggggaggcucccaaggccuugaacagcucuaccucuguggcucugcaggauacagcccccauggcuacuuucaugggcuggcauugagugccugcaacuuuuccaagcacaaaauccaagcugucuguggaucuacuguuucagggucuggaggacaguggccuuuuucucacagcuccacuaggcagugccccagguggggacucuguguucaggcuccaaccccacauuuccccucugcauugcccuaauugagguucuccaugagggcucugcccaugaaguaaauuucugccuggacauccagauguuuccuuauguccucugaaaucuagguggaggcuccuaaaacucaacucuugucuucuaugcacccucaggcccaacacauguggaagcugccaaggcuuggggcuugcacccucugaagcaauggcucaagcugcuccuuggccuccuuuuagccacagcaaaagcuagaguggcugggacacagggcaccaagucccgagguuacacagaacagcaucgcccugggcuuggcccaggaaacuauuuuucccuccuaggacuacaggucugugaugggaggggcugcugucaagaucucugauguggccuggagacauuuuccucauucucuuggcuauuaacauucagcuccucauuacuuaacauaaauuucagcagcuggcuugaauuucucccaagaaaauagguuuuucuuuucuacauggucacgcugcaaauuuuccaaacuuuuaugcucugcuuuccuuuaaaauauaaguaucaguuuuagguaaucucuuugugaaugcauaugacugaaugcuuucagacucagccaggucacgucuucaaugcuuuguugcuuagaaauuucuuccaccagauacccuaaaucaucucuccuaaguuugaaguuccacagagcucuagggcaggggcaaaaugcugccaggcuuuuugcuaaagcacagcauaagugaccuuuacuccaguucucacgaaguuccucaucugcaucugugacuaccaaggccuggacuuaauuguccauaucacuauagcauuuuggucaacaccauucaacauaccucuaggaaauucugaccuuccccacaucuuccugccuucuucagagcccuccaaacuguuccaaucucugccuguuacccaguuccaaaguuacuuccacauuuucagguuaucuuuaaagcaguaccccacucucgguaccaauucucuguauuaaucaauucucacacugcuauaaagauacuaccugagagugguaaauuuauaaaggaaagaggucuaauugacucacaguuaugcaugauuggggaggccucaggaaacuuacaaucacaguaaaaggugaaggauaagcaagcacauucuuacaagguggcaggagagagacagcgugcaggggaaacuuccacuuuuaaaccaucagauuucaugagaacucccucacuaucaugagagcagcaugggggaaaccaccuccaagauccaauaaccucccaccaggucucucccucaacacuucgcgauuacaacuugacaugagacuuggguagggacacagagccaaaccauaucacucaguaugauaacauaauuaagaaacauggcuuauuuguaauuuuucagcacauacaugugauaauaguagcauauuuuauacaaccaaacauuaucucagauuaugcagcuaggaaaaugucacuucaaaagagaguagcagugacgaaaagaauggcucaucucugaggauugauuggcuuuauauucguaaaucaggagacuauguuacuguggaaccagguuucagaagaaacaguuuagagaguuuauuccucucaggauauuuugacccuuaauauaugguaacaaguaaacuuuauauuugauccaucacuauauggguacacaucuuucuucaugaagaaaaauuauuguaaauaagagaaccuccaacaucaacaagcuauuucacuuguuuuguuuuuauuuacaauauaacacauaugguaugcauaaauauuugggaaaauaaauaaagcauaaaauauaaaugauugcauuuucugaaaauuugauuguucuguacuuagauaauaaaauaguaaaaugguauuacauauuaaaaaauguauaauaauaugugcugugaggcuuaguauccaggcacauacaugaacuauauuuauuaaggaauuaauuuuuguauauauaggaauauaaaugucuauuuucuuauauaguaacuucucaauaauucuuuaauaaaugaaugaagacaaauagcuggauagaccagguaugguggcccacgccuguaaucucagcacucuggaagggcgaggcagguggaucacuugaggucaggaguucgagaucagcauggccaacauagugaaacccugucucuacugaaaauacaaaaauuagucaggcaaugguggugcacaccuauaaucccagcuacuugggaagcugagacaggagaaucgcuugaacccaggagguggaggcugcagugagcugaggccgagaucacaccacugcacuccagucugggugacagagcaagaccacgucuccaaaaaaaaaaaaauugcuggauaaucaaagcggcucaauugcacaaaaagguacagauagcacaucguuggaauauuuguccauuuccucuuguugagaacuguuacaaucccacagcauaacuagugauuuucaaaguauguucucugguccagugaccuuauuaucaccugaaaacuugcuggcaaucugugucuuaacacagccucccagugauucugauggggacucaaguuugaaaaccacuggcuuaggcuaaaguauugggccagggcuuccauguucauauucugcugucucuucccuucauucucacagaaagaaauacuguccauuagaacaccugggccaaucccauuuuauuccucuagaauuuaauccaagagacauaauccuuuuacaucuggaaguacgugauaguuuuugaaaauggaaagucaaguacaccuagguauaaguaaaacagucauuuuggggccuuguaaacagcagaagguauugccuuacugacacagaaagggaaacagagcagauauauagaaagauaagaaaaagaggcagagauguaagaaguagccaucuuucuuccuauaccacucuugcuucuggcucugguuguaauuuccaguuguacuuuuuguugcuggguuucauggaguacuccuguauauuucucauaauucaucucccccuuuauauucaugaaauuagguagacuucacucucuuacagcagaauaauucuaacaagaaaucugcauaauaacaguuguucaaauaaaggaaagcaaaaguagucaacuauugccuguggcuaggucuuuugcaauuaauugguggaugugguaacuugaaugaaccuacaaauuaaaaugcuaaaaacaaacaaaccaaauguaugcuuugaaacauuguggauaauuguuuuccgguuauuaaacuauccuauggaugccauuucuagaacacauucuacuuguucuagcuuaaaugaaucucacaacgccuuagagauguaguagggaaaaaauaaaaaccuccaaguuuuagcuuacuguuuauuuuuuugauuuuacacauuuuauuugauauuucaaaucucauguuuuuuuuucccaccaguaauugaaggaaauaucugcauugccguguugugguaaggcaugggauuuuauggguaaaagaaaguuucuuaagcuaucucuuaagagguuuucuuaaauuauuuucuuauauuuucuuaguauuuucucauauuuucuuauauuuuuaauuggcauuuuauugauacuaacauauaguuauugauuuugauggguucuguauuugaauuaucauucuaaaauguauuauuuuuguauaauuaauauucguuauauuuuuaauaucuuaacuauaaauauuuugucauagaaagcaaaaauacuacccauauuuuuguuacauguaucaauaacugcaaauaaaauauucuaaagaaaacucuuuaaauuucucuaggaauuucacagaauggaccuuacauaaauuuagaaaucaauaaucaugaaauaaaauguccaaauuuccuaacauuuuauuauauguuccauuuaugaauuuggucauaacaaaacugacaauagaaaacuugucuuaauagaacauuuaaugaaauagaaacuuaccucauaggcaauuuucaggacuuagaauuagaaaguagugaugaccugccaagaggcugcacaaaugaaaaggccaggaagaccuaugacccaaagaagcuuccaguaggguuugccccaacacacuuuaugcaugcaugaauuccuucccuauaggauauuucaaaucaccucugcugcugaaucauguucaauaaaacaaacaaguuuucuaauuuguuuucauccaugacugaugcuauuaauaaugaccuuuucuuuugcaacaagauuuauucacagucaaaauuuagaagggaggaagacauaaauuccaccagacuggguucauccuucuuguuuucacuuuccuucuccacauaauucacucugucucaugaugaauuccaggaucuugucaucacaauggacugcuacagugcaaaccucuggaaccggcccuuacacuuuccagcuacaaaugccaacuaucucauagucugugcccaaguuaagucacauuugcggcuuugucucucugucuaauuauaccaccucugaacgaagucagcacaguaaacuauccauuuucaccauccagguuugcauacauaaaaccugccuuuaauccuucuugacaaauauccuagaugccuucuuucuuaacucucugcaugcuuuuccuauucauuuaucccugucaacaucugcuuacucuaauucagauuuuagguaacuuacuuuacugaaggaaagccaaagaagugaaugucuuggcucacuggucaccuaauguuaucuaauaucaagucagccucuacugcuuaucaucauuguugaugccccaugagguacugacggaaaauucuacucuucgguaugaaaaauuuaauuuuguugaaucccuaucagcaaagugguagacacuucaaauaaucuuuuaauauucacaauuaugugagggcuguuuauuguugcauuuuccagaugggcacauugauacucagagaaauguagcuugaaaucacucaucacaaaauuccuuucuacucagcucuuuuggcaauaacaaugcugucucucuaugccgaaauucaacauguucauucacgggauuauugugaccuguuaguauucacaugauuauucaacagguuauucccaugguugagaucugaauuauucuacccaaucuuaccaccacacuaacagucucccuugagucucauuuuuuuuuucaacuuucuacuagaaauucccauucugauaucaugcaauccuuuugaaaugugguguuuauauaacuuuaaaaauuguuuccaauuuguuuccaauuuaaguugucuguaauguuucucuauuuuuuuuaaaugauaccaucaccuuacaaauguuuugcugguuuguuuccuaccuucagugauuacagcuugaauaugguacaagacaaaucacugaaacucagaguucugaucaucuuuuucucuucacuaauauuugcuggauccauuuuugcaagacucucuuuuaccuaauauguacccuauuuucuaaguuuuuaaaguacuuuuacauugaaauaagcuccagaaaaaaagguacaauaaauuguuuucccaaaauuggcaugugcuuaccugguuaauuuuuauuucuaaaauggcuuuaccaucugucucugccaauaacguuuuauuuaccugaacacuucuaauaggacacugccuuuggaaaccaugcuaucaaaucuaaaugacuuccuccauuuacugucuuacuuccuguuuucauuuuuauucuccauauauacacuuuuacuuggguacgaucuguaugaaugaggcaguggcgacauuuaaauauggcaugugccaagaacuauucuaagaauuuuucauuaaaaugcauuauuuuauugaaauacacaugaaaugcuuauuagauaauugaggcuauccuuauugauggauuggaaaacuggggaugaguaaaccagagaauagcagaauccaaagcuugcacaguuauguaagcuuucaauucugcuaucagaauauguguauucugauaaaacuauauuguguguguuugcuugugugugugugugugugugugugugugugugugcaaguagcaaugaauacacugaacauccaaaucuugacuuugcuuuuuguuuuguucuguuuuguuaugagucagugucuuguucugucacccaggcuggaguucaguggcaugaucacagcucacugcagccucgacuuccugggcucaagaaauccucccaugucagccucccaaauagcugggacuacaggugcaugccaccacauggagcuaauuuuuaauuuuuuuuuuuuguagugacaggguugcacuauguuucucaggcucaucucaaacuccuagguucaagcaauccugcuaccuuggccucccaaugugcuaggauuaaaggcaugagucaccaugcucagccuacuauguuuuagauacaucuuuuaaaacaguuugacgaagcaauuuuuuacauuuuaaauuuuaugauuagcauaguugcuauuggccauuauaucugaucaucucagaugacugccuccaauagauccaucucucuguuaaauauuaaaaauguacagcaacaacucaguuuggcuauugagauuuccauucaagucacuugauuacuuguuagaacauacacuggaauauaaaauaaaauaggaauaaagaagacccuuaagguauucacaccugaggaaggguggaagacuugugugggcccaggaaugggcauguauagcaaagacauuuuaugugcagguguaugugaucgcugcaguguguggagacugcaagcaaaugcaggagacaacuuaucuaccuauggcauaccuuccuagagcagguggcagaggacugcgucuagaagagucauuagaagagaaacagaauuuguuagguuggcaaaggaguaguguggcuagaaaagccauuccaaguggagaaauucauggauacagacucacagaggcgugaaauaguagaguauagugaggaaauggcagcacuucugugugucuguacuuagcaaucacagaggggaaggcaagagaugagucaggaaagcuagauugggugaaauucaugaaaacacaguauugcaccauuuuugaguauugugguggcucauaaaaauacuuuuauuaacuaugugaguuugguaaaguuguuuuucucauauuuauuuugaggaauaagacuguacauaaagcuuuuaguguagaguggagcauuuaauacacaaacaguaaauggcaggaguccuugcuuuugccauuauaauuguugcucucauuauuaucauuacgaugaggcaauaagacacuaugggcacauuuuaagaaggaaauuaacuggaucauaucugugguuugaauaagcaugugucuaucccguugacacuuuguuauggacuauuaaguguuaucucuuucuuuuccuucuuuuucuuuucuuuuuaagaauauaaggcaauggguauccuaaaacauaacuggccuaauucugcauuugaaaaggggcgaauauuuugaagaaaauguuuucuauucuggucuaagagucagcucuccaagcuugcuuucagacucuuccuuuuuuccugcccugacuuauacuaguuuucagaucccauccucucucuauuuucucauuuuguucuacuuugucuacugacacuacagguauuuccgaaaacagaguagaagugguuuucagcagggagucaaguugcaagugcaaggucugucagggcggucauauaaaggaggagcgacuuuccagagagacaggccucucucuguccaguaggaaacuggaaaguugcugaaucauuugguggcauauguaauacaguggauuacuauucccagcuauucacccacuuccagcaaugggauuugauauagucaauuauaguuauaugagaauuccuguucauucuaugggaggaauaagcaucagaacccuaugaacuucugccaagucauguggcugcuuuggcuaaugaauaugagcagccaugacauugguaugauuaagcaaaagguuucaaugugauuauuugauuuggcucagccucugucuccccugguauguccucugcguugaaaacugcaggauaguggcugcugcuucacucugggcuccuggaaucaaaagcccagugaaacugagcccagccaacccaaacucacccggcaguccucagaugaacaaaaagcaaaugaucuugcucuaagccuuugagaauugagauuguagguuauugcaauacaaaagcugacugauaaagaagacccagaccugaaaucucuuauuaucacaccauagaauccaauggcuuuucuauaauaauaucagaauauguccuuucuccacaaauuaaaaccuaugugaaaauguaugacguuaagucugaagcucugagucauauauuggauuuaaguaaccuuuggaaauaaucauggaauauuaaguuagaaaaauguggccccuauagccuaaauugugaguuacuucauccucugauucauacucuccuccuaccccauuuuucaaaguugaaauaauaaauuuaauuaaaauuagcaucuaucauguguuaugagguccuugacuauaaaaguucguaacuucuuugcuauaugcaacuuagaauaucagucuucaaaauaaaauucuuaacuuuuuuauaauucuucauucuuaacuauuuuauuauaaaauuacacaaggaaaagagaugcauuuuaaaauuucagguaacaccacauuuugacagcauaucugcuuagguggaaaaaugaagcaaauuuuauaaaacauaaaacaaggugacauuauuaaauuugguaucugucauuaacaauaauauaauuguaacuuguauaaaauuaagauaacaaaauuuauuuauacccacaaaaaugaaccuuuuaaaagcuaaaguuucaaugaaucaggguaauuuaauuacaucuuuuugauugcaauauuuuuuaaaguuguaugccuuugucuaauguguaagauuauguuuugugucauugugauguuuuuauucuguguaaucugcuagucauaaaaacuagauauaauaucugauuucuaucacccucuuauuucauauuuauguauaagaaagggucuauuaaccaagaaaguuucauuggaaaaauugucacucaugcaaacaauaaacaaaaugacucucacaguaagaaaauaauggcuauuuugucaccuugagcucacuaaacuacagucuuguuauguuauugaaagacaguaugcaugguaauuuuauaucuuuuuacauacuuacaaggcauacuuaagccccauuuaaaugcuauccuccucaaucuagaaugaauacaaugacuccuaauuuuagaaauuuaagggcgucaaauaugguuaucaucaacccaccaccagcagagauaccuacacauaaccucauccacacuuucuauggcaccagcucccauacacagcaggccuugcuggauacuggcuaguaaauuacacauaugagaaucauaugggugaaggcagugagcauagugaugccaucaguagacaccauggccacggguaagcagaagucaugggacagguugaagggucacagagacugugaagcuggccauaguaagagagugaaagcccugugcuaacugaggcaccaccauaccaagauagacaagacacagguuugucguaacaagucugccuugcucucuauccaugcgaccuuuaaauuauaauuaguaaguacuguccuggcuaaaggucagugcaguggugaaugggaaacucaaaauuaacgagcaacacuucgguugaaccacaugaaaccguuccuucuguaggccaaaaaugcuucaguauuaguaauuucauagaauucagccucacaugcaguauuagaugcucuacauauuuaaagucaauuaucauaagaagccucagacaaagguacuauuaucaucucucuuuuaauagcugcugaaauuuauuaucuaagauguuacuauaauuuguaacugaagguguuacccugaugauauuuuagguuaacuuugggguaauuuguuucuggcacguaauagauuuaauuucagauuaauagcugguguucuagaaugauuagaguaucuuaucucuucaagagaaaaagacgggcaggaauuuuaaaauaaaauguaagucuuucuaaacaaugaagagaaaauguuucacugcauagagcccuaagacguagcauucaaaauuuaaauuucuuuuuuucuuuuuuucaagaaaagucucucauuccuuuuaauaaaaauaaguauaaucuaagucuuucuugacauuucuaaucuaaugaacggccaaggaaauaaaaugcuauguuuucugucauuuuucucaaaaggcuuugaaauaaacuuguucagugaugacagcguaauaaugaaaagugucuaaugaaaauagcauucugacaaguuuucaaauacuuauguggaaauaagaaaagcaacucaugccaugagaggacugaauggaccaaacuuagaaauaaagaaaauaauauucaagcagcacauaauaagugauauuugugcugaaaguggcauaggaguaauuagcagagacuugcagccauauacccaaagccaaggcacagagaagugagugagucagauaaguucuuuccacacagucacucacagagacacacaagugacagucacguguucugagacuacuauuacaggaagaggaaauacguuuccucauuucuauuaagagauacagaaauaaauuugaauuugaagaauuuuuuuagcaauggagcuagaaaaauucuuuuccagauuagauaacaugaagauuucuagaauauuuuaaaggaauaauaaucaugaauauuuuaauaauuauacuaauuacauuuacugaacacuuacugucaggccucugagcccaagcuaagccaucauauccccugugaccugcacguacacauccagauggccgguuccugccuuaacugaugacauuccaccacaaaagaagugaaaauggccuguuccugccuuaacugaugacauuguuuugugaaauuccuucuccuggcucauccuggcucaaaagcucccccacugaguaccuugugacccccacucugaccgccagggaacaacccucccuuugacuguaauuuuccuuuaccuacccaaauccuguaaaacggccccaccccuuucucccuucacugacucucuuuucggacucagccugccugcacccaggugauuaaaagcuuuuauugcucacacaaagccuguuugguggucucuucacacggaggcgcaugaaauuuggugccgugacucggaucaggggacuucccuugggagaucaauccccuguccuccuguucuuugcucgugagaaagauccacguacgaccucagguccucagaccgaccagcccaguaaacaucucaccaauuuaaaauccgguaagcagccccuuuuuacucucuucuccaaccucccucaccaucccucaaccucuuucuccuuucaaucuuggcgccacacgucaaucucucccuucuuuuaauuucaauuccuuucauuuucugguagagacaaaggagacacguuuuaucccuggacccaaaacuccggcgcuggucauggacuagggaaggcagccuuccccugguguuuaaucauuccagggaugcgucccugauuauucacccagguuucagaggugucagaccacgcagggaugccugccuugguccuucacccuuagcggcaagucccacuuuucuggggaaagggcaaguaccccaaccccuucucuccgugucuucuccgccuuucuggggggcaagaaacccccaaccccuucuccuucacccugagcggcaaguccugcuuuucuagaggaggggcaaauacuccaaccucauaucucugcgccucgaucccuuauuuccgcacccggaccucuuauaucucugcgcccugaucccuuauuuccgugccccagccucuuauaucucugugccccgaccccuuauuuccaugccccagccucuuauaucucugugccccgaucccuuauuuccgugccccagccucuuauaucucugugccccgaucccuuauuuccgugccccaaccucuuauaucucugcaccccgaucccuuauuuccgugcccugaccucguaucucugugccccaaccccuucucugcuuuucuggagggcaagaacccccaacccuucuccgugucucuacucuuuucucugggcuagccuccuucacuaugggcaaccauccacccuccauuccuccuucuucuccuuuagccuguguuauuaagaacuuaaaaccucuucaccucucaccugaccuaaaaucuaagcgucuuauuuucuucugcaaugccacuugaccccaauacaaacucgacaguaguuccaaauagccagaaaauggcacuuucaauuuuuccauccugcaagaucuaaauaauuauugucguaaaaugggcaaauggucugaggugccugauguccaggcacucuuuuacaugucagugcaucucuagucucuguucccaauguaacucaucccaaaucuuccuucuuucccucccaccuguccccucagucccaaccccaagcuucgcugagucuuucuaaucuuccuuuucuaccucuccccuccuggccaggcugagcuaggucccaauucuuccucagccuccacuccuccacccuauaauccuuuuaucaccuccccuccucacacccgguccggcuuacaguuucguuccaccucuagcccuccggcaccugcucagcaauuuacucuuaaaaagguggcugaagcuaaaggcauagucaagguuaaugcuccuuuuuccuuaucagaccucucccaaaucagugugcguuuaggcucuuucaucaaauaugaaaaauccagcccaguucauggcucguuuggcagcaacccugagacacuuuacagcccuagacccugaaaggucaaaaggccgucuuauucucaaaauacauuuuauuacccagucugcucccgacauuaaauacaacuccaaaaauuaaauucuggcccucaaaccccacaacaggauuuaauuaaccucgccuucaacguguacaauaauagaaaaaaguugcaauuccuugccuccacugugagacaaaccccagccacaucuccagcacacaagaacuuccaaacaucugaaacgcagcgaccaggcguuccuccagaaccuccucccccaggagcuugcuacaagugccagaaaucuggccaccaggccaaggaaugccugcagcccaggauuccuccuaagccgagucccaucugugcaggacaccacuagaaaucggacuguccaacucaccuggcagccacucccagagccccuggaacucuggccgaaggcucucugacuccuucccagaucuucuuggcuuagcggcugaagacugaugcugucggaucgccucggaagcccccuagaccaucagggacgccgagcuucggguaacucucacaguggaggguaagucuguccccuucuuaaucaauacugaggcuacccacuccacauuaccuucuuuucaagggccuguuucccuugccuccauaacuguuguggguauugacggccaggcuucuaaaccucuuaaaacccccacucucaugccaacuuagacaauacucuuuuaagcacuccuuuuaguuauccccaccugcccaguucccuuauuaggccgagacacuuuaacuaaauugucugcuucccugacuauuccuggauuacagcuacaucucauugcugcccuucuucccaauccaaagccuccuuugcguccuccucuuguauuaccccaccuuaacccacaaguauaagauacuucuacucccuccuuggcgaccgaucaugcaccccuuaccaucucauuaaaaccuaaucacccuuaccccacucaaugccaauaucacaucccauagcaugcuuugaaaggauuaaagccugcuaucacuugccugcuacagcauggccuuuuaaagccuauaaacucuccuuacaauucccccauuuuaccuguccuaaaaccagacaagccuuacaaguuaguucaggaucuaugccuuaucaaccaaauuguuuugccuauccaccucauggugccaaacccuauccucucuccuauccucaauaccucccuccacaauccauuauucuguucuggaucucaaacaugcuuucuuuacuauuccuuugcacccgucaucccagccucucuucgcuuucacuuggacugacccugauacccauuaggcucagcaaauuaccugggcuguacugccgcaaggcuucacagacagcccccauuacuucagucaagcccaaacuucauccucaucuguuaccuaucucggcauaauucucauaaaaacacacgugcuuuccuugcugaucguauccgauuaaucucccaaaccucaaucccuuacaaaacaacaacuccuuuccuuccuaggcaugguuaguguggucagaauucuuacacaagagccaggacugcacccuguagccuuucugcgcaaacaacuggaucuuacuguuuuagccuagccgucaugucugcgugcagcggcugcugccgcccuaauacuuuuagaggcccucaaaaucacaaacuaugcucaacuuacucucuacauuucucauaacuuccaaaaucuauuuucuuccucauagcugacgcauauacuuucugcucccuggcuccuucagcuguacucacucuuuguuaagucccacaauuaccauuguuccuggcccggacuucaaucuggccucccacauuauuccugauaccacaccugacccccaugacuguaucucucugauccaccugacauucaccccauuuccccauauuuccuucuuuccuguuccucacccugaucacgcuugauuuauugauggcaguuccaccaggccuaaucgccacacacaagcaaaggcaggcuaugcuauaguacaagccacuagcccgccucuuagaagcucucauuuccuuuccaucauggaaaucuauccucaaggaaauaacuucucaguguuccaucugcuauucuacuacuccucagggauuauucaggcccccucccuucccuacacaucaagcucgaggauuugcccccacccaggacuggcaaauuagcuuuacucaacaugccccgagucagauaacuaaaauaccucuuagccuagguagacacuuucacuggauagguagaguccuuuccuacagggucugagaaggccaccgcagucauuucuucccuucugucagacauaacuccucaguuuagccuucccaccucuauacagucugauaacagaccagccuuuauuagucaaaucagccaagcaguuuuucaggcucuuaguauucagugaaaccuuuauauccuuuaugguccuccgucuucaggaaaaguagaauggacuaaaggucuuuuaaaaacacaccucaccaagcucagccaccaacuuaaaaaggacuggacaauacuuuuaccacuuacccuucucagaagucagaccuguccucagaaugcuacaagguacaggccauuugagcuccuguauagacgcuccuuuuuauuaggccccagucucauuccagacaccagaucaacuuagacugugcccccaaaaaacuugucauuccuacuaucuugugucuagucauacuccuauucaccguucucaacuacucaugcaugcccugcucuuguuuacacugccgguuuacacuguuucuccaagucaucaaagcugauaccuccuggugcuauccccaaacugccacucuuaacucuugaaguaaauaaauaaucuuugcuggcaggacuaugcugaaccuccuuaggcacucucuaaucagauguccugagucgucccaauucuuagaccuuuuauaccuguuuuucuccuucucuuauuccauuuaguuuuucaauucauacaaaaccguauccaggccaucaccaauaauucuaaauuacaaauguuccuucuaacaaccccacaauaucaccccuuaccacaaaaucuuccuucagcuuaaucucucccacucuagguucccacaccgccccuaaucccgcucgaagcagcccugagaaacaucgcccauuaucucuccauaccaucuccaaaaauuuucgcugucccaacacuuuagcacuauuucguuuuauuuuucuuauuaauauaagaagacaggaacuuacaaucacaaguaagcugugcuuuauuuauuccucuguaaucucacuuaggacucauucuaaacugaugagauucauauuaauaaucccauucagagaggaaggagcuugaaagaauuuaauggauuuuaccagagauuaaaaaaccauuaaguuacaaaguucaaauucgaacccacaucuauauccaaaauucaugauuuucaccauuaaauauuuucuuugaauagaaaaaauuaauauuuaaaauaaguaaacacuauacaacaaaccccaauauuuugcuuuacaaaccaugugacugaucaacacauguuccuccucucuguuuuguaaaacuuuuucacuacuuccuuucaaaucagaaaguauugcccaaaagagaagaucuggaaauguaagaauaaaaucaauaaaauggucugguauuaaccuacgaauagacagaccaaucaaccagaaauggcaaugcaaaaauauaaccuguuauauauguaggaguuauauuguacaauacauaaauaauuaauauaaauaaaggagaaauaauaaacuaaggaauaaauauuaagaugagacaauaauugguacuaggaaccugagguauuuacuugagaaucaauuuugaucgccacguugcacaacugaagaaguaauuuuugauagauuaauaaucaaauauaacuaaucaaauaaugaaauggaaaaaaacuagauuacuaaacagcuuugguggaggaagacuaaaaaacagaaaucacaaacaaaaacaagaaagaauuucaaaaauagaaacauccauaugucuaaaaacagcaaaaauaaaauugagagagcacaaaauuguuaaauagauauauguucuuaaaaauauuuguguagauuugcagcucauccagcuucuugaaauuauuaccuuucucuaagaggcacaacuaucuuuauuaauugaaagaugacaucaucuucuaaaugugcuaucauucuauaauguaguuaagaaaaugaaagcagggugauauguaguguuauuuuaugaugaauuaauuuuuuaugaaauaauauuuuaggaugggcuaauacacugauauuuguguucacuuuacuccaaaaauaaggucauuaucaaaguuaaucaauccaauaucaaaaguuugugcagaguuucugaauaguuuucagauaacuaaugucucuagauucuuaauuuacucuauuuggguauccauguuuuuaggguuugguuuuguuuuuucuuuuucucuccuuuuuuuuuuuugagacagagucucacucuguugccaggcuggagugcaguggcacaaucucggcucacugcaaccucugccuccuggguucaagcgauuccccugccuuagccucccgaguagcugggacuacaggcacaagccaccacgucuggcuaauauuuuuguauuuuaguagagacgggguuucaccauguuggccaggcuggucuagaacuccugaccucuugaucagcccgccucagccucccaaagugcugggauuacaggugugagccacggcgcccggccuguuuuauuuuuucucauuuucuucugcccugaauguguuaagacaaaaaucaauuuggauagauugucaguuuuauaccugguauuuuaucaccaguucagugauuuuacucaauacuuacaaaaacaaugagugaaacauuucacaugccuuaucacaauuaauccucacaacaaccucaugagauaaauuauauuauugaacucuuuuuauagcucaagaaauugacaugugaagaaguuauguaauuuucccaagucauaugcuuuuuaaaugguggaauaaaauuucaauccuauuuuguuccaauucagugugagcaaacuuaaccauauuuuccccauuaggcuucuagguaguauuuuuaucuuaauagagucuuuucauauauauauguuugugugugugcguguguguuuguguguguguguguauagguauauauauaauuucaaauuuuagggaggcuguaggauucuucuuagaguuauggauugacuuuaaacuugauuucuugaaaauguuacaagucuuauuacaccaggaaaaaacuaugggcuaugauucucuaucauaucugaaccauauuucacaauuuccucuaauauuuagaaauagauuuguggaaggcugucuuucuaaaaaaaaugucacauuaaugacuuaggcaucuucaugcaaugaguuauuauaagucuugcauggucuuuuuaaguuaguacagugaagaguucagcaaauuuucaagauaauuugauggcuagaggaaagaaaauuuuacuaugagcaaacagccaugcuuguauguauguguucuugugaacacaaugguuacuguugucuggcuaaauaaagcuuauuuuuaugugauggccuauauagacuaguuuaauccuugucaacaugacucaguaucuccacuaggguacaggucuguaugaaagcuuuuguuucuuuagacacaccucauuuuagaggacugaagagacagcaaggagguuugaagucuacacauauaucuaaaugccuuaccuccugauguaguuuggauaugugucacugccuaaaucucauguugaauugucauccccaguauuggagguggggccugaugggagcugaguggaucauguggguaguuuucucaugaauguuuagcauuacccgcuuggugcuaucuuggcaauacugagugaacucucaugagaucugguuguuuaaaaguguggcacucccccaccacauucucccuuacucuuacucuuuccaugugauguucaagcuccugcuuugccuucugccaugaguaaaagcucccugaggccuccccagaagcugagcagaugccagcaccguacuuguacagcgugcagagccaugagccaauuaaaccuauuuucuuuauaaauuacacagucucagauauuuauagcaaagcaagaacgggcuaaugacauuucccaacacucuuucauacugcagcccuaugcaaauagcaaacauuaguucuaaacacuaaauuuuacagaugaaccacuuuauguagaauuaguugucuuuaguucaaauccuggaauuugugaauucuaauuuuucacacuuaauuugagaaaaaaugucuaccuccuaaggucacugugagaagugauaauauagauauauaauuauauauuauaugcauuuaauguacauaagugugaggcauuauuauuaucauuuauauauaaauauauuuaauguacauaagcauaagacauuaucauuaaauuauuaauuagcaaauaugguucugauuaauauuuuucauuagaggaaugcuucuucucugaaaaaagacucaauaaaccuuuauuucaagguauuaauuuuucuauauuagaccuagcauuuauuuauucauauaugacuuauaguucauuugauuucugcaaaggcuuaagguagcuuacacugcuaaagguauauaaaacagaacaggaaauaauauguagauaaaauucuacuauaaguaaaauagaggucgaugcacuguuauccaguuaaccuagauaaauucauuucugugccugagcaaaaaauuuaggcaggagcuucauggaagccaaaggaaaaugugaaacccaauaguuaauacaguuucuauuauuuaaaaggaaauaaaacaaaaguuauacauagcagguguucaauaaacuuuauuacaauggauaaaauggguuauauaagauauucugauguuaauuuuuacauugccccuuuauaaaucuaaugaaaaaauaaauuauaaaccaauguagacagauccaugagaauuuauaauauauuuuaguuuuuaaaauuuuauuuccauuaaaccaauucagauaacuuacaagaaagauuaauacauauuucccucagauguguugcaucucauuuuggcaaauguuggaagauaaccugguucaguuugugauuugguuuucuagugcuugccugauaugugauauuuacaaggugcauucauaaaaugcucaacuuugacuauaaaacacaaguaucagauuuaccaggguugauuugaaauauacauaaguauaagacauuauuauuaaauuauuaauuugaaaauugauuugaaaauuaggaaucugacaugcaaucuguccauacacaggauaacacagcacugagguaggcuggagggaagucagaugaaugugagaagauugaaacagugucuauacaucagcacuuagugggauucuccagguuauccuaucaacuaucacauuauuuuuuuacugagaaaacugugccuaaggguucacuaacugcgacuauuucaggguuauuaggcugguccucuuuccuguaaagcuguugguauuuuaaccauuauauuuugcuguggaaugaaaaacuuugcuuuuuauccacggaaugcuaaaccucagcagaaaauaagaaagaauuuugacuugaaaauagaucaccaaggagcacuauuauccauuuauguacaaagccggagcugcagaaaaauaacaucaggggggaaaaugccacuggcaccacagaauagaacacacaauuaaaauuaccuauauuccagcauuacuaauuuaagaguaaucauuguugcuacucacaauucugugaguuuugaaucuaaauuguuccaaacacauaucuacccuaaacuacaacauuuuccuagagauauuauuggcugcuuuagcaugugauauaguuuggcuguguccccacccaaaaucucaucuugaauuguaauccccacaauccucaccugucaagggagagaccagguggagguaauugaaucaugggcgugguuucccccaugcuguucuugugauagugagugaguucucacaagaucugaugguuuuguguuugguaguuccuccugcauucacuucuuccugccgccuugugaagaaggugccuugccuccccuuugccuuccgccaugauugcaaguuuccugaggccuccccagccaugcucaacugugagucaguuuugccucuuuccuguaugaauuacccagucauagguauuucuucauagcagagugagacuggacuacuacagcauaauacucucguguuucuucuuaugcucgaauugcauucccucuguuaugaccauacuuuuuuuuuccucacucauaaaagaaaauauuaauaauugcuuauugccaaccaccuaauaucauucauauaauuauacagcuuuuuugugccucaccaugguuuucucuucaauucuauaauuuucucaauuucuuugcucccuguccaaacuucggacauuuuuccugcucucauuccaaccucaggcucuucacauugugcucacguaucugaugccaaauuagaacagguauuuuaauggucguaaaacuguguguaauagcacaauuaucuucuugcucauucauauaagugcucuguuaacccacuuaaauguuaugcuuuugagcaacaaccauucguuccugauuccuauuuccuaaagacggccaguuguacucucaauccuugacuaagagaagagcuuuaugaaaauauuuauagcagaagauaugcauuuaccauauuauaagggugaccucuuuguaauacacucuaggaucuuuaucaugccagaguugaaucugggggaaugauaguguagaguuaaauuuucuaugucucuccuuuugugagucuacauagaaaauaaaaacaaucauauacauaagcuugcuuuuggaacaaagacagauauuuagauuugaaacuguaauagaugcuauuacaauguagaacaacuauuuauuuuuaucuagccaucugguaucugaaaggauauuucucagaaguguuaaaacacuuuuaugcucaaguaaguuugggcaauucuggguuaaagaaaguuaaacuaguaacaaggguuacuucagaaccuuuaauauguuaauauguuuugcaaauuaccaaagaaauuuccauugcccucauauugguauuucuuaaauguauuucauaucagaaauuuauggcccugauuguccccagugcuugcaccggaaauuuccauugcccucauauugguauuucuuaaauguauuucauaucagaaauuuauggcccugauuguccccagugcaugcaccggaaaaugcuauucuaggcacuugcuaagaaagcaaaaauaauuacuccuuuucucucuuuuaugugaauggucuuaguuuguaugugaagaucauguaacuuacggauugaucagaaaaacugaagacgcaaugcaaaguaugucagaucucauuauuuuuucuaaaucaaaguaauuguuucaagcuacccauucaaugaaauuagcaagaaacucaguauucaucacuuuguauggcuaccuuugccuccaugugugaauuuggacagaacacuggccaguggucuucuacugaggugcuauuuauucauuuaaagugguggcuacuuugagaacauucccuuuuguaucaacucugccuacagaaaucuuugccggguucccaggguuaaagucacacaaggccacagaacuucccugccaagguccugcuucugguacagcuauguggauggcugcuauguuggaacaaaccuguugucaucaccccauccuaagggcaucaaauugucuuucucugucuuguuuuagcuccccccguguuuuucucuaaauaucaacguuaguacuuucccuuuauagaaguuagcuuaauagucuaaaauacagaaacgaagccccucaaaugcuaucuugagcucuugccuacaccucauuguucaacccugaaacaugaaaaaucuaacccucugaagaagcaagguaacucagaacucccuccugugagguaaaaacagaaaaucacacaguagaauuuccaggagacuaauuaauuaauuaauaacuuacaaucuuauugauaaagccaucucucuugggggucauuaguauggaauuugauauauagauauaaucauaucaagggaucagaagcuuccccaguucccuggagaagaaaauguucgauuuguuugauuaauuugcugcucucaucgguuaaguaugaaauuguuauuaagucuauauuaaaaagaaaaccuuuacaucagaagucaaacauacauuucucagguuuuuauuaguaugcagcacaaccuagccucagaugaugucauguugauacuuuuucuaaaagaauaaacaaagccauuaaaauaugacuguguagcauuccucuuucaggcugguaaaacaaaggcuuagaaaaucaacucauauaagacaauuuucccauaaauuagaacucuuauuuauuuaauuauuuauuuacuucuaaaguacaagaaaagcauuccauaugaaagcuguucccacucacauuuuccacuguuaacaugaauaaauauuacaucauucagugcaucaacucauaauugauaugaauaaagaaaucuuaauuauuuuuuuaauaguacacagcgguauuagagaaaauauccuggucauuuugacucuuacuucuauuuaauucuuggugaaauaguugaaccaucauugaauaacaaaaaaugagaauauaauuuaaaagcagugggugguguuaggcacccaucauauggcaguauuaauuuugucacagauguacaguaaaaaguaacaguacaaggacugaauuuuaagcuuaggcuaauauagaauaccagggauaauggcauuuuacaaauacgcgcgcacacacacacacacacacacacacacauuuccauauguacuauggaucagagaauauugauggguaauuaauauaaguccauaauugguuauaagacaagucuauguaucaaugucuuugcuaauuugguuuuuauaagaaggcaaaaaggcagacgggagaacagcucccuucaacuugggccacuuacagcagaacugucaugcucuauccaucucugcccccauagcccuuuucacuguggugcacuccugacuuccaacgggcugagaguuuucucacgcagccacggccugugcaccugaaaacaccacaggcuggaaguacaagagagaucaugaccacuuggggaaaagggguauaagaaccccagaucccuuaugccccagagaagaugaugcugauggcaaacuuuucuaaggguucucaguuucccagugggauuaagcuacagcuaccuguacugguaacugacuugauaauguguuauuaguugccuuuucuuuucuaucuacaucuccacuucccugccaaauaaagaacuuggccuggauuccuugucucacagccagcuuccaggagagccaaaugaaggcugcacucugaauaaacagccaccgugagagucaguggagacauucucugucuugcaucuauuuucaggcacucaagcagaaaauaaaggaccucagaaaaggaacuccacccucccccaaaacccaccaaucuaagauucccaauuaaaaaaaaaaaaggauguagaaaggaaaaauaagugaaacuaucuaauuuuuacauuuuguucuuccugccccuuuuauagcuuuuaucucugauaucuuaagauguauuuucuauguacagccauuucauugugucucaguaaaauaacaugccuuugccucuuccuucucaacucucuguucauacuuuccuaggccuauaaacagacuaugcugacagagguccauacuuugucccagguguuugcaaaugcuuauuguguacggauccaccucuccaaggaauaaauaaaaucauuaagcaauuucaauauuaucacagacaugccaaauaggaaaucaagcaggacaauugacuucccaacucauaugcuaaaaugcucaguuucuuauguaaaaacugaauguggcagugcuaccugguaaaguuuccaauauagguauacauuugauauuucagaauacucugugcaaauuaagaugugaauuuucaguucaaagauaauggggaaaggauucccuauuuaauaaauggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcauuaccauucaggacacaggcaugggcaaggacuucaugucuaaaacaccaaaagcaauggcaacaaaagccaaaauugacaaaugggaucuaauuaaacuaaaaagcuucugcacagcaaaacaaacuaccaucagagugaacaggcaaccuacacaaugggagaaaauuuuugcaaccuacucaucugacaaagggcuaauauccagaauauacaaugaacucaaacaaauuuacaagaaaaaaacaaccccaucaaaaagugggcgaaggacaugaacagauacuucucaaaagaagauauuuaugcagccaaaaaacacaugagaaaaugcucaccaucacuggccaucagagaaaugcaaaucaaaaccacaaugagauaccaucucacaccaguuagaauggcaaucauuaaaaagucaggaaacaacaggugcuggagaagauguggagaaauaggaacacuuuuacacuguuggugggacuguaaacuaguucaacccuuguggaagucaguguggcgauuccucagggaucuagaacuagaaauaccauuugacccagccaucccauuacuggguauauucccaaaggacuauaaaucaugcugcuauaaagacacaugcacacguauguuuauugcagcacuauucacaauagcaaagacuuggaaccaacccaaauguccaacaaugauagacuggaugaagaaaauguggcacauauacaccauggaauacuaugcagccauaaaaaaugaugaguuccugugcuuuguagggacauggaugaaauuggaaaucaucauucucaguaaacuaucgcaagaacaaaaaaccaaacaccgcauauucucacucauaggugggaauugaacaaugagaacacauggacacaggaaggggaacaucacacucuggggacuguugugguguggggggaagggggagggauagcuuuaggagauauaccuaaugcuaaaugacgaguuaaugggugcagcacacuagcauggcacauguauacauauguaacuaacgugcacauugugcacauguacccuaaaacuuaaaguauaauaauaaaaaaaaaagagucacagaguauauucugaaaaggcuugucuucuguagugagucacugcuucaucauguuuuagcauggcaaaggcuguucuuuagacuugaaaaaccacuggcuaauuauacuaugaaaauucaaguugcuuaugagguaaauagucauguugaccucaucgcaaggugaauuaaguuaccuucugagaauuaagcucuuugaucaauccuuuauggaagagucaaaucugugauaaauguuccuaucuuaaguucuauucucaaguaaaccauaauaaaaaaaaacacuuuuuuuuggauuuuucuuuuucaccugaauacauuucuaguuagugcuuagaacacuuuauuacucauuugauaggauuuuuucuagaaauguuugcaggaucaauugggauuguauacucuaacauguagauuauguucuauaacauauaaucccuaaacggauuacauuccaauagauugagauuaugcaauagagugagagauggaauaauuaaauggguuuuugucucucuaccuuaacuggagccuaagggccaaguaagaaaaagacauugcuuuccauauucacucuuguaucccccaaugucuuugacauuguuuuugucaacgucaaaugucaaugucuuugacauuguuuuugucaacgucaaaugucaaugucuuugacauuguuuuugucacuuauuaugugccuaaggugucaggcacauaauaagugcagaguaaguaaguuuuugaaugaaugaaugaauaaguguauaggguuauuagagagauagaauaguuuucaaacaagucuauaccuugauuugauguacuaauauaaauaaugcagaaugucccaacaggagaaguguuccacagcagaaaccaaaaaaacaauagauucuuauaggcuaauauggaggauaccuagucucacuccaaaugaggagaaucucuggcucaaagauuuuuuuaggccaagcauaucccuauagguagcuagacaaaauauuugaacuacacacauuucucaauuucaaauucauugagcaauauacagcuuuuaauuuagauuucuacuuaccuuuuccagaggaaaaacuaugucaugaaaaauauaggcugauaaauacaugcaauuuaucugucaauuaaaauuauauauuauuuaauauauaaaauuacacaaacacacauacacauacaggcauucagggcaucuuuucuaaauugauaaauugucuuuuuuauauacauaacaagcuuauuuugagcuuugccccugugaguuuuuccaugaaggauaucaucuuguuaaucaacucagauuuaaauccuucuaggugaaguccagacccagggccauggaaaaccucuccuaggaagccuuuugagagauagucagccagccucuuuuauaguuucuugaaccuuagcauggguauagaaaacagaacagaauaaccucuguuuaaccuucaggauauuggagaaaauuugcaaaaauuagaaaaaaaauguguuugcaugguuuauucuagcuuuaaacuagcucucuuucugaauuaucucuccaccuuucugcacaaauggacaagagaaguauagaaaugcuaagucuaaaagugugugccacaugugcaguuccuuuccagggaauucuuccaggauaaauggcugcgauaggugccacgagaaaccaauccucacccuauucccggaugcacuucaucagagcaauuauagacuggucuguauguagucucacagaagagcuuugcucagaagggaucuuaguuauuaauuagaccaauaaaauuugucuugaugggucaaaauaggauacaaagaaagaaucauucacugguaggauuacuaugcaaaagcacagaguuucugcugauuacgcuuuaauuuaauuauauuuuaugcucauucuacauucacauaccuguaccuugcuuuucuauaagucagcagacaugggaguaaguggauacuauaagcaggucgauguuuaaagaugaugaacauuaaacaaaggaggaggugacuaguugcugcgaacaggacugauugaugcagaaguagaguagagcuagucacaauacugaaggaaaacagguucacuccugcgucuuacuaaggagauguggccaagaguaccacuauagcuuuaccuuguuucugaacugggaccugggugugcccuauuuccauguugcagggucagaacuccuaacuuacuugauccauaucuauuuuccaaaaacauuuccccauuacuugagguaauccuagugaauguauauuuccugcaaucauagagcuuaaaggacucacuagcugccaauuaaugaaugcuuauaagguuccagguauuauucuagguucuucaagcuauauuaaauauauuaacuuuuuauuuauuuauuuauuuauuuauuuugagacaaagucucgcucuguugcccagguuggagugcaguggcacgaucucagcucacugcaaccucugccuccugaguucaagcaauucucaugccucagccucccaaauagcugggauuacaggcaccugccaccaugguuggcuauuuuuuguauuguuaguagagacaggguuucaccaugcuggccaggcuggucucaaacuccugacucaagcgguccaccugccucggccucccaaaguguugggauuacaggcaugagccaccgugcccggccaauagauuaacuuuuaauuaaucuucacaaguacauugccagaugggaaaugcuuucuaugaccugucuauuucuauagauaacaaauaguggagccagcauucaaagauagggcuacaucacuccaaagccaagcuauacucaccaguuauagccaauuacuacaauuauuuuaaaauuuuucuuuucuauugacuugcauucuuuauucuuuacccaugcaaagaaagaaaauauuaaaguauauuuacugucuauaaacugcaacauacauuaaggugcugauuaauauggaggaaugaaauuagauagugucuagcauuuuguaucagcauacuagaauuucuagaaagauaucagguuucucuucagugaaggaagugcuugucucuaaguuuguucagugacauuuaugcuuuccuguuccugccaggcacugcuuugaaguggagcagaauucuuuugacacuuccacauuagaaaaaaaucucuggugccaaguggacuuauauacucacuuccauuaguccuacaaugucccuaccuauaguuagggcauuuuuuguuuucuuuuuugaucucaaguguguaacaguucuaauacagcaaauuuaauacaauuuuuuauuagaucaaaauucaauagaauguuucauauguuuuaaggaagguucauugaauuucuucuuuucaauggaagucuucauuuggaaaaaugccuuuuauccuucuugccguuuacucaaugcuuguuuauauauuuguguugacuaucagagacacuuuuuguuugugaauuuaguaaaccauauucaaaacagucacgauugacucugcugaauuauauuucccuugugagagaaaugaaggauggcagcaaagauguucaaaaguaggauauuuuaaaaaucucuuuaauaauaggaacugaaaccaagcuaauuuaaauuuugacugugcuugucucauuuuuauuucuaaauugagauuuuuuuaauaagaaaaaaaaaacaaaaaacuucauaggcugaaaaauaaacuggagcagagaaguuuacuaccaaaagaugaauacauuauguagcaguagcauuuggcaacugaaguuuccauaguugggaugauauaaaaaaaaaauuaauguaacaaugcauucucugucagcgcauggaacucauggauacauuuuacuggauuaccuuguaaccuaggcuacaucacugcuucucaaggucucucuaaaaggcaauguuuggauuaggccguccuuauucaaaccacuaccuggagcagagagauuacaaagaaaggcuuugggaguugggucaugggguguccucguagcaucugcccuucacaguaguuuaucuauuuuaagaauuagaccuuugaagaaauuuuguuuaaagaaaaaguuucauggcuuaaaaggacaaacaaguuuguauaccacugaaacagaauguucuuaguguuuucugacauuccaguucuuuuauaaugauauuucugcuuuuauaccccaacuuuuuauuuauaaggggaaaaagugacccgauggcaauucauugaauauuuuuuaagcaguucuuccauauccaagguuccaauuugcuacucuuuuuuguuuuucuuuaagaaaaccuaccaagaggagauaugcugaaagauauauaguuuuauaugaauauuaaucuguaaacucaugugaaacgguucagugaucuaauagauagagagcuugauuguacugaugcaugugugauucgaaagauaauuacauaagauuaaacuucuuuucugagccaaucagaagagagaucauguucauuuuuacaaccuauaauaaacuuuguggaugagaaauugugcuauuaaucucaaguacaaugaaagaaauaaaauauuaugaauaaaauuuguccguaugcucaaugguuaaaaaauguggucucuauuuacaagaaucauuaaaaugcuguauucauuauuuauagaauagagcaauaggaaaaugauaaaacaauaaggaaauugcauaaagagaugaaaugugaaucacauuuaucuaagagaggaguuaauguugguaauauuucuauaagaaaaauucuguaguacucauucugaauagauuuggauuuuuagcaagauuacuauuaaugcauaaagagcuugcucuguagaaagaauauauacauauacugaaaauaaaauauccaauauuuacauaguauuuacaaucugcuaaagccauguucuaagcuguugucaucuauucauucauuuaacuuuuauacaacucuacagaauuuauacuguuaucgucuuuauguaacauaugagaagacugagguccagugagauuaagggacuugccgaaauuaugcagcuagaaaguuaugcuguugagaguuucauuuaggcaacuagugaaaguguuuacuacuaaacaagguguuuaggccacuaaugaaaguguuuacuacuaaacaaagauuuaaacuauuaucuucaaacucuauuucuccucagugucacacacuuauccccaaauaucgcuuggauauuugcagcuauaacgcuauagugcuuugaauucucucucucaaaaugaauccuguagaauuucagcucuuuucucccagucaugaaccaagguagagggcagcagugaaaacaacuccuuucaggugcaaagauggagugcaugcuuuguaggaaguggaaguuuauaauaauaauaacaaaaccaaauacagugaaguugcuuuuaacuguuaccauggguagcaauuugaaaguaugucaguguuaaaauauuccucugcuuugagaccgaauguucccacagccaaccucuccuucacuuggaacaauucucaccuccuauuuauuuaugcugagccuucugcacugcugauuccaucaacagccaugcauaacaugcagcugaaaauguaaauuaucauggaugccugccuucucccucucucuauuaucccugaaccaccaaucaaaacuuuugucagcuuguccuuuuugauauuucuacaccuguucucugcacucuuccgguuauuuuuauugacacuuucuuucauuacucaccaauugacauacuuuuagauacacucaauguucucuuuauuaaagaaauauuaauugaauuuucuaaauuaggaaagugcaagaaagaagaugcaaaucaguuauagugucaauaacuagagucaaccaaugaaauauuuaugcauaucuccuuaaagauuuuuuucuuuuucuuuuuuuuuuuuuuuuuuuuuguuugagacagagucucacucuguugcccaggcuggagugcaguggcacaaucucagcucacugcagccuccacguccuggguucaagcaauucugcugucucagccuccccagcagcugggacuacagaugcaugccaccacacccagauaauuuuguauuuuuaguagagacaggguuuuacuauaucguucaggcuggucucgaaguccugaccucaagugauccacccuccuuggccucccaaagagcugggaauacaggcgugagccaccacacccagccccuaaaguuuuuuucuauucucucaucauuccucucuuaauaucucuuaacccaucugucucucuaugccuaucuauacauaagugugucuuaaaaaauugggcucauauuuuauacauaguuguauucucugccuuuuucauucauuuaguauaaauaacucauaagaauauuugagagucaauggauaugacuauuuuuucuuucaaaaguaacauuucuuaaaguaaugaaguguacaugugguuaugauuuuuaaaaaugaaauacaaaauaaaaaaauucaugauuucaccauuauuuuacuuuaucuuaauuaaaaauuuccccucaccauuucucuuuuagauuacuaauaauuauguucucauuugcaucccuuucucaauugaauuuacccucaucucucaaccuaccauucauacuacuuccagaacguguuuguuuguuuauuuguuuuguuuuguuuuguuucugaugcaaagucucaaggucucacucugucucccaggcuggagugcagugacaugaucuugacucacugcagucucaaccuccugugcucaagcaauccuuuccaccucagccuccagaguaccugggucuacaagugugcaccaccaugccuggucaauuuuuguauuuuuuguagacuuggggucucacuauauagcccaggcuggucuugaacuccugggcucaacggauccucccaccucagccucccaaagugcuaggauuagagguguaagccaccaugccuagcccuaggauaauuuuuuuuaaaauuuugcagauguaaugaagugccaucaucuacccucuaacuuuaccaucccauauaaauuaucccaauacaccaauacucaagcuuccucuaaaaguauuucuccuauuucacauaauuugcuucauuccucaaccugguagauguggaaggaaguuguauguuggguaagacuaguaaucucaguagggccgaggcagaaucugagugcuaagagguugggucaccacagaaucggacagugaaaccaucuagauauuuccuguuucaaguugggaauuguucuaagaaaugggauuagagcuaaaucuguuuaaaaaucuaguuacauucuuuguagccaaucuucaugucugcuaguuuccaaauccuaagugaugggauagauuucagaacaagcagaaaugaauacuggcugcaaagaauggaauuggauuacaaagagugaaagagcugaaaaggacugaauuuagguuaguaauaaacaccuuagcaguguuucauccagaaagagacuaauuauaugaaauuauuucuuaaaaauaccagcauaacagugagcuggcagauuaaaugacuguggaagugguaggagauuuuaggcagaagacaagcuacuguaguucucauacugugugaugaggauagaggauagguuaguacaauaacaggguagauaacacacauuccaccaguugucaucagcgucaaagccugaaccaugacugucugugcacugcuaaugccuaacgucucccuggcacauaauauguagaagguuuucuucuauuugguuagaguggcuuagauacacaguuucugcggguuuccaaguugaaugcugagucucaugaaucuacguguucuaggauuuccacuaaaacuuuguuuauuaauuagaaucaaguugacuguccuccuguaaggguggucauuugacaagauaucugccaccuuaaagaauuuauauauaguaaaauaacuucaccugucaguuuaaaaaauucuuccuggaugugauauauuuucaagcauuuuucucuauguacuuugugaaugaagcuuagauugucuuuauuugccuuuauuugauguaguuuauuggaugaauucacuuucaaaaacuacuacucaucaguguuucgaguuauauuuuuuucugcuuguucaguuuguuucacugcuguugauuuugcuuaaagccaugauguaacuuuuaaacagcauugcuagcuaucuaaagucacucucuguauucaaagugccccuuaaaagcucuuucuuuuugucuucccacaaaagauucuuagcuuuccaaacuuuuucucccuaaauguaaucacauaaaaacaccaauaggauuuuuuuuuucuucucauccagaauguaauugagugaucaaucccuaauacaaagugcuuucacugcaaagggcauuucuguuauuuuauacaggccuagucaauuugaagaaaaacuugguaaauuauuucacaucuguuaaugaggaaauucugagaucaaaacaaaagacacaugaauuauccaaaucuucguuuuuguugcuguuguuuguuuguuuguuuuugagacggaguuucgcucugucacccaggcuggagugcaguggcgcgaucucagcucacugcaagcuccgccucccggguucacgccauucuccugccucagccuccugaguagcugggacuacaggcgcccaccaccaagcccggcuacuuuuauuauuacuacuuuuuuuuuuuuuguauuuuuuguagagacgggguuuccccguguuagccaggauagucucaaucuccugaccucaugauccgcccgccucggccucccaaagugcugggauuacagguguaagccaucgcgcccggccccaaaucuuaguuuuuuggguuuuuuuuuuuuuuaaaccacuguguuccuugauaaaaacguaacuugcuacaaaacaacaaaauuaggguuugggacaacaugucauaaucgcuauuguauuacaauaaaaccgucaauuauaacaucuuauaagaguaauaaacaguauuuucauuuaacuccugccagaaagcuguuuauuuccugaccagcacauggucccucccuaugugagguugugcuacagauagagauggaggaaguuuucugaaagucugacauugccauaaucaaaauaaugaauguacuuauuggcaucugcugcauuuccuaacuggugaaagcuuuuggcuauaaauacauuuacagaaaaaaguggagacuccauauaaaagcaugaauaaaauucugcuggccccaaacuauauuuuuaacaggacaauuugagccaaaguauguuauuuuccagcaacugaugcuaacggaaggaaaauguuguuuaaaugcuuagcagauguuuagugauuuuaucaucaucauuacccacaagcuaugcuaaauuaugcaaaucuguuuggaaauuuaaggcuuauauguacuuauuauacuuuauaacuauuucucaccacuugguaauaaccucuuuaggauaagagcuagguguuuauuuuuuauuaauaauaauacuuugguguggagguuacuuuauuuuccuucuuugcauaucuuccauagcuacauuauaauaacaaauaaaagugaaaagcgggaagcuugacagugguauuuguccuauauuucuaccuauuccaguuaagaagauaguaacuccauguuugucuagagucaagauugccagagcuguaucuuaugcauuccagcugugugccagacacuuccuauggagguucacuaaggaaaucaaacuccucauucucacucauucaccuaaacuagacagaagggugacagugaguccuccccauguccacucuuacugaagcuagugaccaggucucaguguucuagaucaaagucucuucacugaccucuuucugcuaucuugagcuacugcaucugaccccaagaagaccuguugccuugguucuccagcuuuccuccuuauaaauaacuuccacaaacuuagucagaaucuagggauauuaaucacguuauuagcaugcuucaguuccucucuuguccaaacaucuuggcaugaaauaugcgagucucuacagacuggcuaguuucaacucuugccucugcugcuuccuagcucugugacaagaacaaagcacuuucuguguaccucaggaugaucacaaugggauauagcucaaagguguguggguuugugucuauguguucauugaauaaguuaguguguauaaaaugauuacaacagugccuggcacauauaggcaucauacauagucccugaucuuacuauuguuucaucuugaccaaguguccucacugucaucuuaaaaaauuuaccuuuuccuggccaggugcgguggcucaugccuguaaucccagcacuuugggaggccgaggcgggcggaucaugaggucaggagaucgagaccauccuggcuaacaugguaaaaccccgucucuacuaaaaaaaauauaaaaaaauuagcugggcgugguggcgggcgccuguagucccagcuacuugggaggcugaggcagaagaauggcaugaaccugggaggcagagcuugcauugagcugagaucacaccacugcacuccagccugggcgacaagcgagacuccgucucaaaaaaaaaaaaaaaauuuaccuuuucccaccccuacccuauguucuauacauccauguaugcauacacaugcacauauaccuacauacaugugcacgcacacacacacacacacacacacacacacacacacuaugcuuuagucauaccaaacuaacugaauguuuagggaaauuucaccacaguuucaugccccaauccuuucauuugccauccucucuaccaggaauuccaucuuuuuaacauaucugaccauugauuuucucuuaaguguucaaauuuugcucaagcaauuauucuccaaauuuauuugcucucuugccauuuuccagccuccuuccaucauugggcuacaggacauuacuauguucuugauagcaguuuacagaaauguacaaaguauccuuucucuugucagccuguggauaucuggagggcaguggcuuguguuucaccuguauuguauccccagaggugucugcacauaguagcagcucagauguuucuugcuagaaugaaugacuuaguaauuaccacuucuagguaacauaagcauuuuuaaaaaauggguauuucaaagggaaaucaaaaaccagagucuugaaucuaaguucuauuuccaccuucuugacaugcuguaacaaaccuucuuccuuccuuuucucuuuuguccucccuccuuccuuucacaaacacuugugaauuagugaugugcugcuaccaugcuaggcacugaggauacauaaaugauaggaaccucauugucuuuuccuugaaugcaaugaaaauuuaauuuuccaauccuuuguauugacuuaagaaaaauacuuguucaccuagcaaaauauaguuugucuuuaauauguuaagaaguaaacaguccugaauagacauuacauuuucugaauucuaaugaaauuugccauuauaaaauaaauuuauguuagaagugcucucacaacagaauucucuauuagguuuuuuagucauucaguaaucugcuauauaaugaguacuuccagugaauuuuauuugauauuuuaccuaggauuuuacccagaaaauaucggacucuuuaucugauugauuauaaauauugggaaaauaaauauaucaggcuaaucuucaggucuacagcuucagauuccaggucuggaggguuaucaauaauuugaauaucuccagauugguuuaagacaaggaucugaagcaguggauauguauauccuucuguauaaauucaguauauccuucaguaucuauuguugcaauauauauuguuuaaauauaaguauauuuaaaaguauauuuaaacguauauuuauacguauauccuucuguauaaauucaguauauccuucaguauauauuguugcaguauauauuguugcauauauagccuucaguauaaauuguugcaguuauugaaucaugugugagcauuauugggaaggacacaaagggaggauauugugaggaugugggaaagaaaaaaguuacaaaagugacaauauccuaaaguuguucaugguugugggaagaggaccugcaggguccauucagaaauggagugauucaacucaugcagauucauucucacacggauuaaggaccaaccugugguauaaugcaagugaagacgacucuggacucuggaaguacuucucagugaugauaggcacaaacauuaucuaauaacaauguauaaucaaacuuugggcauaggccucagacugggugggaugaaauauuugaagggucaggaggaaggugaacagaaagcagugcaacaaaauuuuaucucuuguucucuuuucaguuccaaaguguuucuauucuaggucugcaagaagauggaucuacuagguuuccaauaauuccaaaucccaggcaaaaucuucucaaaugcuuauaacuaauuuuuuucauucauaacguuuuaaaaguuuuuguguaacagaauuauauuaguauuaaucagauauuauauauuuuauacuguaucaauauuuuauuaaccacauuuauuacauaacaaucacacuauuaguucaaaugugaaaauguucuaguguauaauccaauucauuaaguuuuacuauauauuuauuaucucuauaggacaaacuauaauaccaggugcuuucuauacuaguacaauuuuaaucucuuuuucacaagaacaaacaaagccugaacaguuaagaaguugcuguggcugacuugaaccuggucuacccaaaucugagcuuguguccuuccugcaacuaucauacuguaaaugaugauauagguggcaaauacagacaauuuuaagauaauuuugcauacauugauauuagaccuagcuggaaaauuucauugaaaacuagugauuuuuuuuuuuagcaugcauuccccaauacuucaagauuuucaugaagggcaaacaucuuauacaagcauuccuugacgccaaagucacaaaauauaucacauuauaugaaauuuuguccugacaaauuugucagcuccuacaaaauuauaaaauauaucaacgguaauuaagacaucauuugaaaaggcaaaagucagaaugguaugauguauugggauuggcucacugacagcaagcuuuggggauuaggagaacuggauuuagugucagcucgaucaguaauuaggugucaucaccuguggcaacucaguuugccucuccugggcuuuuguuucuucaucuguaaaauuaaggggcuguacuagauguucucuaagggccucuuccaccucuaaaauucuaugagccauaaucuuuagaguuguguucuuauaacuucuauuauaaaaauaauaaugucagucuacaaaucugacacuaccagccagaauucaaaaguauaaucacagaugcugccaucagcucugacauuauuggucacaguauguuaaaacauucuuuggaaagcuccuugaaguaauucaaguguaaaaaaaaucacauaaaucaugcaaagguauugcuccagacccaucucauuuaccugagacuuuugaaaauuaacacaaccaauccuagaaaaaguugugaagauuguucuuuccaagccucagccuccugucuucuuggugcccugaaggugcuagugcuguucgucuauuuauauuaucuuccauuuuuaugaagauggaaaaguuuacaauaauuagccauuuggguuuaucuacuaauuauuuguuagauaaauggaaacuuaguuauagugaaguguuaccucagcccacacauuugcauuuuaugcuuuuuacaaacagcauuauaaagauuuuuauguuauuaaucguaacuuuaaaggguaauauucuggaggggaaucauuugcagagaugaaggcauguguauucauuagcuuacugauaugguuuggcuaugucuccacucaaaucucaucucaaauuguaauccccauaaucuccacguguggagggagggaccuggugggaggugauuuaugaucaugcuguucucaugauagugagugacuucucgugagaucugauggucuuauaaauggcaauuuccccugaacuuuucugucuuuccugucacccugcgaagaagguccuggcgucucuuuugccuucugccaugauuguuaaguuuccugaggccuccccaaccauguggaccugugaguccauuaaaucucuuuccucuauaaauuauauagucucagauagugucuuuauaaugcgugaaaauggacuaauacacuuacaucuccagauuacaagaagggcagggguggagcugcccuuccagagagauccaguuccaucagggcucuuucuucuuauuacuuaugucuuacacccuguggauaucugacucauucucccaaagcuuugccauuccguguguuagcuacuagccauguguggcuauuuaaauuuaaauuaauuaaaauuaaauaaaaguucauuaguugaauuagccacauuugaaguguuagacuaccuucuccaaaaguggaggacuugguugucagcaaguaguacucauguccuuacagauuucucaccacaggggaaaaaaaagaaauauauauauuuuuauuuuuucguuuauuuauuuuaaccuugauggcaauuuuuuuuguuuguuuguuuuuguuuuuguuuuuguuuuugagacagagucucacucugucacccaggcuggagugcaguggcgcgaucucagcucacugcaagcuccgccucucagguucacgccauucuccugccucagccucccgaguagcugggacuacgggcgcccgccaccacgcccggcuaauuuuuuguauuuuuaguagagacgggguuucaccguguuagccaggauggucuccaucuccugaccucgugaucugcccgccucggccucccaaagugcugggauuacaggcgugagccaccgcgcccggccgauggcaauguuuuaauaaaaguucuugguaaggauucuuacuggcuggacugggucuugugcacaacguuugaacucucacgugguuuggggaucaggaugagggcaguggcugcuuccauucagauucuaugacuaaaaacagaggugggaggauagcacaccugggaaggugugccuguauaauuugccuuugguccauacauugaucuuuuuaaaaaacauguauuuuaaguucagggauauacgugcagguguguuacauagguaaaccuguauuauagagguuuauuuacagauuaugucaucacccauauauuaagccuaguauccauaaguuaagaggggaacaacauuacauugaucuuaaguguuaccaccgaauauguuuugacaaaugcauauacucuuacaaucuauauauaacuaugugcugguuaagauaggaggcuucaauuacccuggaaaguucucucaugcucccuccaggucagucucaauccccccacccagaggcaaccaccacugugauauuuuccauccuagauuaauuuugucuauauauuucuuucacaugggcacauauuauuucauaacacaguagaguuuuuuaaagcauacuuucguguagagaaacuaggguuugauuccugacucuuaccuuaaaugguuauuuaauuucccugcgccucagguuucuucuaaguauuaauacguguggauaauaauaagugacccauuggguacuauguuuauuaccuaggugaugaaaugaucuguauaccaaaccccugugacaugcaacuuaccuguauaacaaaccugcauguguaccccgauccugaaauaaaaguuaagaaaagagcaacuauuucacaggauugucauaaagaguaugugaugcaaugaacguaaacagugagucauaagucaauguaauguuugaaacaguacauauguucagcaaaugcuagcuuuuauuuuuauauaaucacaaaagcguuaagguucuuauucuauaacuaacauuuaaacucucucuuaucuauagcaguguguaagaguuuaacuuuuguauucucugauccaaugugaagaggaacaaugggucaaguguucccauacuuucaaauaaaagaucaggggucauggaaggaaaguuaaaaaugaaaguuccuaaaaaucaaauuaaaauguagcacugaugauauucacguucuuuugaugaaauguuugagcaauaucaaaacuguggaagcgcauaacccgguuuuaugagccuuagaagaacuuuacaacagccacuccugaaguuuuauucugccaguuuuauggaugacucaucaccgaccaaauuuucaaugaaacaggugaugauauaaaccaaccuccuauaaaacaacucuaguacaaaucccauuuuuacauaaugcacuuuaauagaacugcuauuuuauggaaugacagucacugguuagcuugugauuucauguguuuucuccagagugcgaggcaguuucuugcuuuguacucugcuuugagcaaaaggaaaacagauuuucuagagaaucaauaagcaugggauuacguaaaagaggagcaggagaagagugagucugccagguuagagccuggcuuggcuuccaggucggucagggauuagcccugugggagaaacagaugaauucugcugaucggcaguugcuucugaaacauuggcuucggggagugcaaagaaaaaggaacagggugugcugaggcaggauuuugaaguaacucuuuaacugcagcaccaacaaggguuccaucaaauauaaaaccacuuuuuaaaacccucucuagucauuauaagaaaagucuuagaauauaucuguuuuuuaaaauauuaaggaagaugugaaaaaugguugucauucuggcagacgcugauuguucuccacucauaucucccaccuugaucaccucaucaaccacugccuaacuuccaagagaaagccaaccccuggcuucuuggcuucuuuuccugagggugcucuccugucccugaagacucauuugccaccuucaugacagccugcaagagccaggaaaugaaccaucauggagcaguccucaucaaaaacaucuaaugaccaauggcauugacauauggacacucaucuacauucccuucccguggcagcuagcuuagaggcaccuguuuugacuuuagcaacuggccucccuucccugucucauuuccccauaaccccauguauuucuuucaauucacaaauaaaccacuuguaugaaucuucaucuaagaaucugcuuuaagaagaacucaaccuaaggcaggcauuacccaaaugggaagguaaaauauuauuuaucaaagcaaaugcgauaucagccgacggcagagaacagcucacacaaaccccucuggccuuccuugucugaauucaauaaguucaacaaauauuuauaaagugaggccuagauauaacacauuucccccaguuauuuaacaagaguagaaauguguaauaagguacuucauuccauacaggaaguuuaacaaauuuuacaaaguucuuuccaaaggcaaguaaaaaaauauauauauauuauucauauaagauaauauagauauaaaaauauauaugguuuuucauaaggcgaacccucuuucuuggaauggcauuucugaucaauuccauaaaauggcaauuuugucagaaucacuuaucuagugaugagguucaaucacauaacgauuuuuagcuuaugaugguuucgaauuuccuugagcuaacccugauaagguggauggguuaauuauauuuuugaaggaauuugaagacaguaagauguguaugcaguucaauauauccuucuuauaagaaaugauguuuaccuuuaguagauuuaugauuguacauuuguuaagauaguaacuuuaaggaaaggacauuuuuuaacgcaaguauuauuuuguaugaguagcuuccaaaucaguuggccauuggauuauuugagaguuauguauuaguuucacaucaguuuccucuuacugucaaaauuuuaaaauguaguucagguuuacaaaccagaagauuuuaugcauuuauagcuaaaaauuuccuuuccauguacguaauauuuauguaucugugacaugagucauuugauuugaugucugcuuaacugaaaugugaugaguugacauuaucaaacggagcagauuuucugaaacuuuaagccaaauguuccaggguauguucggaaggauuggcaaagcagggggccgagggagguaaggggacagugcauaaaagcagcagaugcugucacauaggguuaguccaauauuaucauuaaaauccauuugaguaaagcagauaagucaauuaucuuauaugaauauuuaauuauauuauuucuacuaauguuauuuuucugggguuauuguugcaaugcaauauagccuguuucuuaaaggaauaacucugaacuuuacaacaauccaaggaaauuaaagccuuuuugaaaaauaaaccauuauagauugaagauuaugaaagcugagcaauacauuuaaugacucauuguaaaauuuaggaucaacagaaucuuuuaaauaacaguguugauccucaguguauuuuauuucacaauuugaauauuauucuguacugcuaagucauauuucauauucauuaauaaaauaaauauuuauugagugucuucagugugccaugcaccauccuagugucugggguugaaaggcaaacaaggugaacguggauuuucccuucuggaaauaacaaagccagguauguaaauguaaacaauguugaaugguaaauacaaugacagucacuguaucaagugaguauuuugacuccugaacuguauagaacccuacacugaaugacuuucauaaugacaacaguuuauauuuaagcacauacuuugcaaaaaaagagcauuuacaugaucuuauuuaguccuuaucacauccuuagggauuuuguauaaaaguagaucuggguauuguggggucugaguuuuaaagaauaugagaguccuucuuuaagaaaaugaaugcauuaaugucuuauucaaaaauuuuacaacaacauauagcaaugcacauauauuguguaggcacuugcaaauguagccuugagguguaaucuuuguugacuucacaaugaagccucuuccuagcacuauuguuuuaccagcuuuucagaugaggaaaccgaagccuaaagagucaaugcaaauuuaaaaaggaaauuuaaucuauaugaaaaaucaauauagaguguaggcuguuaggcagaaaaauuaaugccauggauuucaguaaccgaauccucugaauuccauggaaaaacaaugauggcaucuuauuuaccaaauuuaguuuauucagacauugguugacagguggcauuaagcuauuucuacagacggaaacacaaagauuaugagguacucauccuuauugcuaauauuuauaucugaauuagagaacauggcuugggaacugggauauuugaaucuaguucccauuggguuacuuaaaaucuuuuaacucacaacuuucugaugaaaaguguucuacuaaccagaguagucauucuagucauauuauuuaauuuccagcauuaggguuugaauaaauuacuucuugaguugcccaacauacaacaaucucacauauucuguuaaaguaguuaaaaggaaucugacauuugauugauuuucagugucgucauguaaauaaaugacaaauacuacugucacugaguuaaguaaaguagguuuuacaauuucaucuauuuaguuuucaacacuaauguuuccaugauauuuaacucagcugcagaagaccaaagguugaucaauagccaaggcuuccacucagaaaagugcacugagauuuauggcuaccauagaagcauaauuuaaaaauauaaagaaagcuucuuuuaaauuuugagguuugccaacagaauuggacauguauugaaauuucacuuuuuaaaaauuauaccuuuauaugcacauaaacaacucugcugaaaugaaauuaaucuggaaauggcaacuuagauuuauagaagcaaguacguuaaaaauuaaucaacuacuccccagucguugauaaaauucaguguuuuccaaggacacuucuacaguagccguccaauggcauaaggggcuacacuguugagagcacuuuagacuuucagacugaaucaaugaggaacacuguuaagcacaagacagcccuggcaaucacagcaucucauguucagguuaacuccaguaagggggagauauuagcaggcaucaucaaauaaucaauuuuagucaccuggaagaacacaauguacugaacagaaaccaagcaucaccuaugaagagcauuuuguuugugucuauaagggccccaugcccuagacaugcuggagugaucaguauuuucuaacuguauuucauucuacuucaugaccauucuauguaccuuuucaucacccugaugaaguugaaaucuucucaucauucaaacuuaaacucauauuuaguuguuccauacuggcaaaauuagaugucuuaauugcuauaauaaaauguaauuacucauaaaauaaccugauaauauuauggcaaaauacucuggucaauuuggaauuucauuggugcucuuucaacaggauucaugacuuugggaaucuaaugcucaaaaucauuauacguccagaugauuaaagguaggguacauaccugggcugaauguucugugccuguuagauaacucaccaucuuaaaacagggacacaccagacucccaauuaggucaaucuagcaaggguucuguuguuuuuagcauccccuggaccauuggugaaugcuacgucuuccauccacauuuauuuaguaagucaaauaguucacagaaucauaguaggggcuucaaaauaauguacuucaggccaaaccaccucacuuuaaauuagaaaacugacccccagugauuaauuguuucacacacuauuaguugaauacacucugcgaucuggauguauuuuuaagaagcucuguauauuaaacuauauauccuggauuuucaaaaauauuauuuugcuuuuagaaaacacuucuuaucagaaucuuaauaucuuugaaugagcauuacagcaugacaaaauauaaaauuucaguauaugaauccgauaagauuuuagcaguuucuacagaccagaaaagcuguaucuaucuauggaugaauuauuauuauucauagucauucugugauaagaaauuuuaauauacuuaauuaauaaacuuaaaaaauauagaauuugucuuuauauacucuacagaaaauucuuuccuuaauagcauuacuguaauuuuagaauauuuacugauaauacuguuaauguugaauaaauaauauauaaauucuaggucugcugucucuaguuuauaguauuuccucauguuugacucacuaauucugaaguggccaagcuauuccaauauaccuauucacauuucugcuaguuuguggucaagaaccuauauggaacucuaauauuuuaggguaauaucucuuuaaaaauucuguaaaaauuauuacaaacccaucaggacaggauccaaagcacaaaacuguuacuaaaauuuggacuaaggaaaacaaaaauacaucuaagugggcccauuauaaagcaaaaaggaaaauauuaaaaauacagcauuaaaagaauaaugucaccuucacaaaaaagugagcacuuacuuauuuuugcuugguaaugguaauugauuuuacaucaagguaaugauuaagaauucauauuugaaagguagacuuuucuuucaagauuucgacuuuagcuacaaaauuacaccucuuucgaaauugccggaggaaaauuaucaucauccuaacuuaaaacuauauuuuuuucagaugucugaaaugaaggucaacuuuaugcacaguaacugauuuccuaaucuuuaagcaacuuacauaaagugcacggaugcagcuuuuggaaugaaauuaaugcauuuuuauuuugcaucguuuggugcaaagggcccuagaguuguuugcugguuaaauguguuuauguuugcaaggccucuaucuaagucaacacauaaaaauuugcuuucauucuucuuucuuuucuccaaaaucaacauucaauuucacuuuccuuucagguguuauguuccacuauugaggcaaaaucuuaucucaggguaguugauugguucuuaauuauuuaggccucuuaccuuaaaacaaaaguguguggaaaugagaugaccguccaggguuagacacaugugaccacgaaaaaaaaaaaaaugaaguagucuugucugucuuacccgacaacccauucacagugcaacagagaacuuggcccccuugccauuagaccaaaguacucugguaaauauuagaauuccgucagucuugcaaugguuaguggggauaauagcuauauuuuucugauaagagauuuauaggauuacuugauuuaugauauagguauagccugguaaccggugguggaaaacuauauuaacaguauacucaggccaggcacaacggcucacaccuguaauuccagcacuucgggaggcuaaggcaggcagaucccuugaggccagggguuugaaaccagccugguccauauugugaaaccccguaucuacuaaaaauacaaaaauuaguugggcaugguggugcaugccuguagucccagcugcucaggaagcugaggcaggagaaucacuugaacccgggaggcggagaaaaauuaaaauacaccauuuuaguaucucuucucuuccaagucaucuuauguauuaagugcuuuuguguacuacaucacucaagucccacacagucuuaauaggaagacaaucaucuucacuucacauaugguagcacugagguuuaaagaguuuagguaaccaaacaaaggcugcagaaugagcaaauuucagggcaccuuuugaauucagauauaguaacuccagagugcauauauucaucauaaucuagcaaugccuuuuuguccagaguuacucaaaaugucuauuaaaaacaugaaaaguuuggguauuucaaaacacuaacagauuuaaucugggggagaagggaggaggugggaaugguauauuugagacagaaccuucaggcaucuaggggagcacacagcagccaggcccuguacaguaaguuuucuucuuguugaaaugcucaaccuguuguccaagaugcuuuauucuucaccucgacaacucacgcaacgcauccaaauucuguauuuucuggacuauucuguccauauauuuauguuuacaauaugccuucauuaaugauuuuauucauuaaaagaaagcuguucuauagauggaaguuuuacuaaaaucaguuugaauuaauugauugauuacauaauuauauuuuggauaaauuucccuuuauuucaaacauuuccuuuauuuuaaguacuagcacaaaaauccuagauacuauacuuuuacauuugacuuuuguaaaaaaugucuaauuuauucugucugcagcaauaaagccagaucaucuauaagcauucuucuuuaagguauaaauauuagucuugugaacucaaaauuucaugaaaucuaaagaauauuucaguggcaucuauaaaagugcagccuuaaaaucacaaagcugggugaggccucaacuggccuugacacuuuaggacucuuaugcuucaggcaauggacuaguugaguucaaaaugauagcugauguugcauaagaacaggaugauucaggaggcuaaaguuaagagauccaaggugaaggaaguuuugcaugcagugcccauaagagacccagagaauccuguggcuagggagacagccuacucguaggguuguaagugagguagccuaccugucucucaaaccgguucugacugugacuucuugagggccaauggaaggcugaagucuuuucuacuuggauuuuaagauuagcucugcaccucauauggcucauuuccagguauuuaaauggcgacagcaucaccuacagaaagaggcaucaaaggagcucaaguuuuagggguuuacaaugaagccccuaauuccucacuuuggagcuguuauauccacacagcauaaaaggcucaaagguggcuaaugccugccuacauuauauagguuacuuuuuuuuuuauuacucugugaugucuuuagaaacucagacugggaaacaccaaaaaucuuagcaguuauuuuuaucuuggaugugucaugaagauguggacuagauugaggcccaucucaagaacugaccuauaauaacaaaccugaaguuugaaauuccuguauauuaagaaaugaaacccacagcagcaagggcaaugacaagcugcgaccauaauggcugugucccaacucuguccugguguuucauguuccaggagugaauaaauaauuuaaucuucaugagccaucaauucuaguccuccuucaaaagucuggcaaugggcccagcuaauuucauuuaugauguggacuuuuuuuuuuuucagacuaugaguuuucagaaagugaaaaagggcaaccauuaucucauuauaugagugugguucugugcuuuuuuuuuccuuccaguaauacuuuauugauuuauuaaucagcaagaaaucaaaggguaaggacaugccauuuccucauuaauuagucauuggaacaagcaacacuaaucagucuuauuucaacuauaaauaauuagucuuuuaaaagaaauuuuucuugacagaagagagugaaauauagaaauucuguuacacuuaguaauuuuuuuuuucacaggaugaaaacuuacauauugaguauuaaguuaaagauuuaaaccuugggaaauagauaauucaggaaauaacuuuuaaugccuagcaguuuuuauucauaaauuaaaagaguugcuuugucaucagcuaacauuuauuuauauacccaaacaccaccacucccuccuucaaaguaaauaaauaaguaaauaagucugcuaaagucauauauaguaugaauaagaacauacuuuaggaacuaaaaaaauuaaguccuacuuauguauuuacugaauugugguaacuguuucuacauuacaacagcuuuuuguuucuauuucauuucuuaaugguaucucuaggauauaaaauaaucuggcaggaaauauacuaaaauuuugggcuuuauuucugccuaaaguuuaaaaaauauuuuucuaacucucaaguuccuguuacuuguucucuuguuuuaaguuccaucagagauuuuaaaguaauuuaaacuauauaaugcagacuuucaucuaaucgcuauuauuaaaauaugucuacaucuauuauuuagaacaaagggagaaaccaacagcagguucauuuauccauccuccacucuuucguuauuuggaauguuuuugcuaauaaccaugccucaaaaaauguuuguuucaugaaugaguuaaaaaaaaaaaaaaaaaaaaaacacaguccuguucuguuugaagaaaguauuuuguaacuaaaaaaaauuucuguugucuaacacauuguuaugauugauaaaugaaaagaaggagauugaaaggauucaacuaaaacugauggaaaucuaguaggaauguaguauguuauuuguauaauguuauuugaaggaagcuagauaaaauuuauggaaaccuaccauacaccaagauauuauuuguaugaugcuuauuuuaaacucaguacaucuugaauggaaagcauuuuaauccccauuaaagaaaaccaagucuccaagagaguaauugauuuagacaggauauaaaugaaugucuuucuuauuucaguucccauuauuuuucacgguaccgcaugauacauucuacuaugcuacuagugguggauuggucuaaaaacuuuaagaguccaauuacacuuguagauauauggggucacaauaaauuagaaugaaagcugugaauaccuuaaaaggcuccacuggaaaagggagguaaggucugauuuuuuuuagauagauuuugucaaaggcacuuggucaagcaguaaucauacagcuagguuuugggugaauauuugaggccaauguuguuuuuugagagcucuuaccuugauaucauuaccaaugaauacuugguguuagcuaaggacccacauacucuaucaauaaaaauugcugcaaaaauagcauaaaagaaacaaaucuaaauauguauuuugauuguagacuuaaagguacuauuaauuuggugauuugagagaaauguaaacauuuaaauggaaauaaaauucaugccauuaccauacagcaucauguugaugauuaauuuuuaucugaaaguguuguuguugaggucugacauuaaagaaacaccugaacauggacuggugaauugcauuuuaauaaguuguguauuucauguuuuuaugcauuucaucauuuuaaccuugcaguacaaaauaauguugaccagaaacaccucuuuaaaguacugcuuauaaaagagaaauggugcauuauauucuugacacuuaaggucaaguacuaaagaugcauuguauauuaauguauccaauauaucacacaagaaauuaaugucuauccucccuuuugggucuagacuacuuuauaaaccuauuuuuacuuucuucaguuugauuaauaguaucccagaaauacuguguccuaacagcauccaagacagcuuugauauuaucuaugacucaugaaugaaagaauucucauuauauuugaaaugauacguuucagaaauugaaaauaauuucacguauauguuucauuaagcacaacauaguauguuguuuucuucuagcaauuuauucaaggccaaugauuaauuauuacaauuucuccugaauuauuuaauggauuuucccacuaaaaauuuugcuggaaugguucaacacacucuuucuuuaacagcauacauuaguuuuaacagcuaugauugacauucacaauacaaacuuauguuauaauuuuugucaucugggucagugauuuuagucugugauauguccuugaaaaacaguauugugaauaauguguaaaauacgacaaaacagaauucugccuaaacgaaacacaaauaaaaugcuuagaggucauuaccuucuuuauuaauaggcucugcauaggagccugcuuuuuccugguuaauuuugcuauguugguagccucauagagaaucauuacugcugugcucucccagagacagaaagaauaaaacuucugucuaugacucuguauacaaaacuuaaucuuaaggaacaaaaaacauauuccuaaaacauauuuucacucauauuaaauauaaaauagcaagucucuugaaacauucaaguugcuauguuagacuuuuaauaauuacaauauauauccuauggccggauucauucaaauguaaaauuucacuuguaauuuacuccauagggagaaaaguaucuggucugaguguggggaauuauuuauuuuucccuagaaaucaguacuuuuuuauuauauacuuuauuuccaauaucuuaauuuuucauauuauuuuucuuaagugauuuuacuuucaaaauugcuauagcacuacauuaaagguucugaaaaugaaaaaagaaguaauggggcacuauuaauaguucuuacucuccuaaauuuugucauacuuacacauuuuuaaaaaaaauccacugacuuauuuuaguuuccaauguucuacaguuucuagaauagucuuugacucagaauacauaaauauguguaucugaagugguucugcucagcaauuuaauaaauugugcagucuacagagaauaucauuaauuauguaaagacugauggggauucauuuacuugguuucuuucugaaccacuugacuugucucuguuuaauuaaacaauaauaaaugugaugguagggagaaacuuaugcugucagugaacaauaauaaauguguucuuggaauagagaaagggauucuagauaucuucauauuuagacagaaaaucacaggaagauaauuaaaacacuugcuuacuugccuacaauuuacugacauauaucuucacucauauuucuuaagucuccaguuauggaggacacugugaaggcaaauuacugucaaugccucaguauauuuccuuauuuuaucucuuggagaguucguuuucuuuuagggaaguauauuuuauacauuuuauguaauguucccaugucuggcuucaauuugaaaauauggcacuccuuacauugccugucccauugcaugguaaaaauaggaauauuaaaauauuaaagacauuuugcugaaggguggggccauuaguuauauacaauaaucaguuguaaaaacacugggggaugacaaaauuaugagcugauauuuuuaauaugaauuauaaauguaguuuaaauaucuaagauguuuuaacucuaugguugaaacauuugaaaaguauuuacuauaugauccacgaccacauuaaaccaccaccaacaaacgacuggcaugagagagacuccauacaaagauaaucugucaguuuucuggguuuuggaauuugggcaauuuucauaaccuuucuacuguuguuucuguuuguaaacuaggcauguaaauaucuacuucagaagagauauaauguauauuuacucauaauugugacauaugcaaagcauccauaucagugcauaucagagaauagcuaauaaaaaaagguauaccuauuacaauucccauuauacucuuuccucugauuacagguuuuaagaacaaguuucagugcuagaagucagcagaagcacagaacauuuugaucacuuagagacaguauuaaaagaucuauuaacuaauuaguggacugauauuuaauuuccaauuuagagucugucauuucuuuucuuaagauauuguuggcccaauuaaucuuagaauagauaauuuagaucucugagauguaaauaaaauagugcauaaaacaaaguuuuacaagaauuuuccccauggauauauuuuauuuagcugaaaggaaguccuugaguugauagcaagucaacaugaauauauuaaaacuaaugcuaugaugccaucaauaauuuauuaaauaauugaaaagucauauauguaguaaagguacaguauauaauuuacgaauuaaaggauuccccccaaaaaaucacaacuaugcuuucauaagcaggguugguuauuuucaauuucagaauuuggugugugauauuauauauauauuuguucuucauccccaguuuuuggcauaugauuccuaaaauccuuggaaucuucaaaguaauaaauucuguaugcuacugaguugacuaguagacugagggcuggcagucccuagguagcuucaggauggggcuauuaaccagaaaaaccaaggcaggauuagaggguugggacuuucugccccaacccacccccaggagaggagaaagaggaugaagguuaaggugaucagcaauggccagugauuuagucaaucaugccuuuguaaugaaaacucuguaagaacccaaaaagaaguguucaaagagcuuccggauauucgaacacuugggggcuucuggaggguccuggagaggucauggaagcuguacacugccacacucauccccuucccugcccaucucuucaucugguguucaccaauauccauuguaacuuccuuugugauaaacaaguaagcauguuucccugaguucuguaagcagcucuaauaaauuaacugaacccaaaggaaggguuuguaggaaugauuuguagcuuguccaucagaaagaggcagaccuuucuguugacuucugaaguggugggagggggcauucuugaaaacugaguccucacccugggaucugaugcuaacuccagauggauaguguuagaauugaacugaauuagaggacacucaaccugugucugcugcagaauugauugcuugcuugaugugugugggaaaacccaagcucacuuggucacaaaaaccuucuguguugauuguugugauguaagagcauagagaaaaguuuguucuuuuauagagacgaaaacaaagcaacacagaacaaaaaacuuuugcagaaacuaaccaaaggcuuguagcucuaaaguguaucagagaacaggauuuacaaaauaguuaagauguuuauguauuuacacaucaaaauaugcuuauuguaugaaguacaaaaaaauaggaaaagauaauggauucaaauucccacuaccaaagacaacuguugucaauauuuugauguaauuauuucugccucuauaauguacauuuucuguaaucauaguugaacucauuauuuuuaugcaguuuuauaugauaauagaauuaaccaugacagauuuaauuuguauauuauuauaaauauuuuaugaaugcaauuuuaauagcuacauaacaguguaucuaguagcauuucaucuaguagacauuuuauauucugugcaguuguucaccauuuuuaaauauuuuggcuauuuaaauuaauugucuuaaacauacaacaauaaauucugggggcauagguuucuauauaguuuggauugccggaaguguaauggcugagucaaggcgagauuuucuuuuuaauggcucuuuauacacaggcauuaaguuuuuuaacauuuuuaacauucaaauuagaauuagauacauaugauauuuucuacaacuaaaucugagaaauucacucaagagacgacugaucuaguuuuauccuuaagaggagauuuaauuuucaauaacauuuagccaucaguuaaaaaaauaucuuggcugaaaucagauaauguagguuaugaauagagaccaguaaaaaacucuucuacacuguuacugguguauuuucauguagcuauguggcaugaaaauauaccaauuugccuauggcaacucaacuguggcaacucaaaaagguggcaugaugugaugugagccccugauaaucuccauuagcagcuucuccagacaagcacagauaaggaugcaguauaaaugaagacaauauguuuuauauacaaaugagaaucucacucaccaccaucaggauugucaucccuaaggcccuacuauguggaaaaugugaaagcaaaagugacuuuuuugucgauuugauuugguuuuuuguuguuuuguguuguugcuguaucacuaaccuuacuacaauugcucuaaagaagaccgacuguccaaagauguuauuuuauuguguguuucucuaacuuggcauauuaugaaguugacaaagugauuugugaccaguuaaauucaggaguauauuuaaauauauuucacaaaguauuaacuaaagaaaaauuauguaugauuccaaacacaauguaauugaagcaauaugucaauuuucaguucuuccuuaauaaauauuuuuuucugauucacacacacacacacacacacacacacacacacacacucgugggacauuuaaaaaaaaguucuguuucauuuggaauuuuuucuucuuucaggauauauugauccucuucuuuugcauuaucauuuuccacuuuuaaauaugcuggaaaauccaacaaacaguaaacuuguggaagguaaggcucaggcuauugucuauauugcauuaauguaucuugaacauccagcagagggauuggcaauuaggagcugccaauaaucaucucugaauguuauuuuaaugugauauuucuucuuuuuuaggauacuuaaaaguauuuuaaauauuuuguccuguuucauauaauuacucaaaguuccuauuaagugcaguccuuucuaauuguggucuaugacaucagguuucucccccagaaaguucagauaaauguuaacagggugauucacuuuuacacuuuuuagcuuuuuuuucuuuucauuaacacuaauguuuuauauauuuguauguucucacucauugauaccauaagaaaaauugcauuccccuuucuacacagcaaaaguuuuggcugaagucuaacaaaaauauggaaaaucucauuuugcagaaauacaaaucugaugaccacucgugagaaacaacccaagacaucccuuuuggauucaguaauucagggucuguuccuguugaaacauuaucuuaacccaaauuauccaggcuacaaacaaacaaacaaaaaacuuuucauuaacuccuuuuuacccugcaacgucucuuuugguucuguucagaggccauacucaguauuggccugaagucugugcuuuuccagaagcagaaggguuagaagauggaauacagagucauguguuacuuaaaaaugggcugcauuuuaagaaauguguccuccaggggauuccaugauauaaacaucgcagagugcauuugcgcaauccuagauggcauaaucuacuagacaccuaggcuauauggcauguccuauuucuccuaggcuauacauugguacauguuacucuccuggauacuguagagaauuguaacacaaugguaagcauuaguguaucuaaaaacauagaaacaaaggaaagcauaguaaaaacacaguauauauaugugugugugugugugugugucuguguguguguauauauauauauauguuuagacggaguauugcucugucaccaggcuggagugcaguggugcaaucucagcucacugcaaccuccgccuuccggguucaagugauucuccugccucagccucccgagcagcugagacuacaggcacguaccaccaugcccagcuaauuuuuguauuuuuaguagagaugggguuucaccaugugggccaggaugguuucgaucucuugacaucgugauccgcccgccucagccucccaaagugcuggaauuacaggcgugagccccacgcccggccaguauuauaauuuuaugagaccauccuuguguauguggaagugguccaucacugaaacauuguugugaagcaccuggcucuaccuauauuucagcuuauaauggcucuagucuuggaaaaagaaaacaguuaucaugugaauauuuuagacagauucuacuucuucacacuaccagaagcugucacucauaaauugagauauccuuagaacuaauuuucggacuucauugaaugggauuuuuugaggaaagaacugaaacuuuuuggauuaguuuauuuuagcuagccacugcuuaugguaggggcaagggagaaagacuguuuuucaagcauagaaacagaaauauuaaaauuucagcucaugaucuuuaagaaaagaaaagcaaugagaaguuguguguaauuuuuauuaaaagguaaaugaauuacauugucacauugauucuacaucaccuuucacaucuucaauuuuuuccuucuacccucucuaauuucucuauugaccugaaugaagucgacacccuuuaaaagguggggguaaaguguuuucaaauggaacauuuauuuuuauggccacaguaaauuauuacagcugaaacauuuguauacaaguaaaaagggacaaaacaggauauuuuccuuccagucaugugcagugauaaaauuacaaccuuaauuauuuaacuccugugguaacugaucuuauuuuucauucucuguauguuauaguagguacucccaccuugaucucuaucuuuccuucuuauuccuuccuaucucauuuguuccucuguccugcccugugcaaucuucuguucuacccaucccuacaggcccauuccuaugacucagccuguugaacugucucaaguucuuagucccuggcaucuuggauuagugcauuauauugauuucaaguaaacaauuauaucugcuauuucucuacuaaaauuuagauugauauuucaagaaaaaaaugacauccacuccauuugcuggauucuaucucuaagagguuauuguguccccaacaaguaacagagauggaauaauuuuuaggcauguuuuaaagggagaauuaacagaaauacuugaugauuagguggauaugaauaagaacuuacaguuacaaccaucauuauuuggagaaggagauaguggaaaauaaaggggucuuggaaaaaaucgacaaauguagauacaaagaagauuaugaauuugguuguguugacuaaaugaauacagaguagagauuagggaaauguaguauauguugauauauuaagauaauucuugaaagaauagaugguucuggaucuucaauauauacuaauaaaaaugccaagaaaucaaugaaauuauucucacuaaacauguuccucaucaaaacacuaccuuggaauucacauauagcaccaaugauaaaacaaaaaaaaaaaguucuaugccagggucauuuuucuucuuauuggcacuguaaaaacugaaaccuagaauauaagaaaaaggauuucaaauuugacaacauugcaggaauuuuucuuaggaugaagacaaguugagaucuuacacacuuuguauaacauuuaagauagaagauguaagaugauaccauaacguagaugguugaacugguuugaaaacaaggcacaugagucaggaacauaaauuuaaauacguuaaagcuaauaagacugccauuucacuagcaacacccaauuaaacaaaugggaggcacaaauccugggggauacauagaaauuagaauauaucucuuauuuugggacuugggcuuucuauuuucaauauaacgaauaagucauucacuuuugaguuaaucguuccagucauauaucuaccuauuugacacaacuuuggaaaaaucaacacauuuucugaaucuucaauuuauaauugacauuuuagggaaaagugcucagagaauauaucacuuucccuauauuuccaaauuguaccaaaaugggguauauuucugaauuguaagcaggaauauuagugauaguugaugauaugauuugccugugugcccacccaaaucucaucucaaguuauaauccgaauugucauccccacauguguagggagggacuuggugggaggugauuggaucaugggggugauuucccccaugcgguucucaugauagugagugaguucucaugagaucugguuguuugauaagugccuggagcuccgccucuucucucccuccugcugccauguaagacaugccuugcucccccuccccuuccaccaugauucuaaguuuccugcgaccuacccagccaugcagaacugugagucaauuaaaccucuucauuuauaaauuauccagucucagguaguauuuuuauagcagugugaaaaugggcuaauauaccugaaaaccucaagaaaccggcuuuuaauuugagccauauuuuuaaagcuugaaaaacugguuuauauguaauuuaaugcuggaaaaaagaaaugaagucagcauacuguuagacuagauaagucauuuuuccuuaaaaauacagagaagauuaauauuuugaagaacaauugaaugauuaaauauuggcuuaaaguuauacuuaaauuuuaagucucuuguaucuggaaacaaauuagugauccuguaauuaaaccugcaagcuuugaguacauuuuaaaauaguaucauggaacaaaaaucuacagguacuuuuaaagguauagcugcuggucuaauuucuugaauuuaaauuucagucacacugucacgucuuaauuacaaaaccaaaaagucagaaauuauauaccugauuucuaaggucaguuuaaauaccuaucaaucuucauaguaagcuguuuaaauuuauuugaugagaagacuuagcaaauuuuaaacuugugcaaacagacauucuuuaguaaguuccuacaaauaauuccuuuguuuugucuuuugugauauuauuugcuaugaggaauaauaacaaugagcuuacguacauuaauucuuuucugguuuuuacaucauucuugccuuuacaacguaaaaaaaugcuaguuuaugcuaucauacacuaggaaaaaugaaaguggaaaaacuuuucaaccuguauaauauugcagaucuuuccauuuuuuuuccaguagagaaauuuuccuacacugaauagagaccaucuucaaaacagagagguuaugaggaaauaaaugaaauucacuggggaaaaaaauuuguacaaaaauauuacccaguguuucaaugauaauagccugcagcuuucacacuaacuugaagauaaacugucauuaguggaaauaaaaugaagccuccuagaguacuaggagugcacaaaguaaagaaacugggaaauuuccaauaguagugcgacaauacaaaagccuccuguuaacucuugguguaugucucuuuaugcauauguuucuuucuaugugaauauauacuuauauuugacaguacauaaaaauauauuaguauuaucuagacugcugaacuauuuauaguuuucuauacaugccaugucuucucuucugguuucucuagaagcagcuauccuguaauuaucucuaggucccacaauucucucucuuucucuuucucucucucucuuucucucucucucucucucccucccucccuccuuucccucugacucucuguauauaauuuuucccuauagucuugggcuuaccuuaaaugaugacaaucaacaaaacauuuugggaucuucugaacuguaacuaauccuccacucaaaacucccaugugcuuggcuggugcucauuucuuucuaccucucauuguaguuauugguauacauaugccaauggcucuguuugcuguuaugacaaacaugaacuaacgccuguguaagagucucuaauucauuucauuccauuuugcuccuaaaauaaauaagguaauuccauggaaguguuauuucuaacuguucauuuuaauuucauugaaaagugugggugauucucugucaaaugucuuuuaagguuaagcacuguugguuaauauaccacauuacucacugugcacucaaauguaauugugcaugagcauuccauaugcauaugcaaacuucuuguuauuacagcauucuaaagguuggggaagcagaagucaaacuuuguaaaaacaaagagaccaagacaacucacauggcaagucaauuccagucuagaggugcaggagcaguagacugccauggaugauggaucucuuuauaauaggcaugagauucacaccaucaugauggaaguggucaugaagggaguuugacuuacauguuuccagaguacauguuaaaaaguucaaauauaaugauaaaugaugugguaaauacaaauccuuuucaaaugcugacaucauucugaggcgugcguuguaggcaaagggccaaggcuucaggagguugugccuggauggucuuccauuggcaggagugcagucaguaucucaguaucugcugggcuggcuggucacccugggauugacuguucuggucuccaagaauccugacaccaauauuguucuuaguuuagcaguuugcacccuucaaaauuuuaaagccaucugaggauagcaaaacuauuaacagagucuuuuccaaacauuucugaaucuauaauuuaguguaucuuuuaaauaucauuggcaguaagaaagagcaauuggaagcagagggagcagguuaauugaaagcuguaaagaagccacugagugaaaaguguugagaaagaaugaaagcaauuuuaaacugugucagucacuguuuaguuuaugcccuccauguuaguucaauacuggugcaguuuccucuucucauuuucuuucuguuugaaugugcaguauucucaacuuuauuuacugucugcuguuccuugguucauuggcacauaaacugcaccugauuuaauguuuuuagugcaaaccguuuuuuccaaagaaaaucaagccauucuuaaaaaugcaucccuuguuuaaugaaucaauuguauacauaaauacugcagcaagcaaaggaaguuuuaucuuuccaaggcugaagacacuugguaauacuugcagcaucuguuuuagagaagaaagaauaaaaugacaaagcuggagaauuaauucucccauauucuuuauuguaaaauaauuacauaauuuuguuuuaaagugacaaagugagguucagaaacaaacauucacagauuaguauuuaaauauuucaauaucuguggaauauaauuuuacaaauggaaaccccagauuggagaagugaccagcaguguauuuaggacuagaauucaggucuccagacccaguucugucauuuucuuacuacauuuugcuacuucuuauauauagaaaacauugucucagaaaagacagcagauugugguugcaagcauauuuuagaaucauuaaaggauaaaauaucaugaacuucaaauaaguuaguuuuagcagcauaaaauaacuuuguuauuauuuccacauaaauaaagcucauuaguguauggauaaaaagcaaagauuagccuauauuuuacaauuuucuuguuuaacauuagaauuuagauacaguuggugauaugguuuggcuguguucccacccaaauaucaucuugaauuguagcucccauaauucccaaguguccugacagggaccuggugggagguaauugacucacggggauaggucuuucccaugcuauuuucaugauagugacuaggucucacaagauaugaugguuuuauaaagggaaauuucccugcaaacguucucuugccugcaaccauguaagacaugacuuugcuucuccuuugccuuccaccaugauugugagacuuccccagccaugcugaacugugaguccauuaaacaucuuuccuuuauaaauuaccuagucucagguaugucuuuuuuagcaaugugagaacagacuaauacaguaaauugguaccaguagagaggagugcugcuguaaugauaccugaaaauguggaagugacuuuggaauucaguaacaggcagagcuuggaacaguuuggagagcucagaagaagacaggaaaaugugagaaaguuuggaacuuccuagagacucguugaauggcugugaccaaaaugcggauagugauauggacaaugaaguccagguugagguggucucagauggagaugaggaacuucuugggaacuggcauaaaggugacucuuguuauguuuuagcaaauagauugguggcauuuugccccugcccuagagauuugugaaacuuugaacuugagagagaugauuuaggguauccauuggaagaaauuucuaagguggcaaagugauuaagaggaagcagagcauaaaaguuuggaaaauuugcagccugacacggcaauagaaaaggaaaacccauuuucugaggagaaauacaaguugccugccaaauuugcauaaguaacaaggagccaaaaguuaaucagcaagacaauaaggaaaaugucuuuagggaaucucggagaccuucauggcagccccucccaucacaggcacaguggccuaggaaguaaaaaugguuuuguggacagggcccauggcccuucugcucugcagccuagggacuuggugcccucugccccagcugcuccagccauggcuaaaaaaggcuaagguacaacuucggcuguggcuucagagggugcaagccccaagucuuggcagccuccauguggcacugaaccugugaaugcacggaagucaagaacugagguuuggggaccuccaccuggauuucagaggccuuauggaaacccuugcauguccagguggaaguuugcugcaggggaggggcccucauggaaaaccucugcuagggcagugcagaagagaaaugugggguuggagcccccacacagaguccccaggggcacugccuaguggaacugugagaagagggccaccauccuccagaccccagaauguuagaaccacugacagcuuacagcaugugccuggaaaagcugcagacacucaaugccagcccaugaaagcagcugggagagaggcuguacccugcaaagccauagggguggagcuguccaagaccaugggaauccaucucuugcaucagcauguccuggaugugagacauggagucaaaggagaucauuuuggagcuuuaagauuugacugccucucuggauuuuggauuugcuucacaugcggcauguagccccuuccuuuuggccaauuucucccauuuggaacagguguauuuacccuaugccugugccuccauuguaucuaggaagcaaccaacuuguuuucacuuuuacagauucauaggcagaagggacuugcccuuucucaguugagacuuuggacuauggauuucugaguuaaugcugaaauauguuaaggcuuugcaagacuguugggaaggcaugauugguuuugaaauguggggacaugagauuucagagggcagaaugauaugguuuugcuguguccccacccaccuugaauuguagcucccauaauucccacgucaugggagggauccagugugagguaacugaaucaugggggugggucuuucccaugauguucucaugauagugaauaugucgcaugagauacgaugguguuagaggauuccucugcacaugcucucuugccugccaccauguaagaugugacuuugcuucuccuuugccuuccaccaggauuaugaggccuccccguccaugcugaacugugaguucauuaaacuucuuuacuuuauaaauuacccaaucuuggguacaucuuuauuagcagcaugagaacaggcuaauaucuuaggguuucugauuuagcaguauguugugaaaagaaacuagaaugcuuuuuuggggggcaggcuaaaaauuccauguuacaaguauuuacaggcugcuuugaacacuaaagucaagagaaaaaucuauauuuuaaacguacuaaauaaaguuauugguuguugugggaagucagggaccccgaacggagggaccggcugaagcgauggcagaagaacauaaauugugaagauuucauggacauuuauuaguuccccaaauuaauacuuuuauaauuucuuacaccugucuuucugcaaucucugaacauaaauuaugaagauuucauggacauuuaucacuuccccagucaauacucuugugauuuccuaugccugucuuuacuuuaaucucuuaauccugucaucuucguaagcugaggauguauguugccucaagacccugugaugauugcguuaacugcacaaauuguucguaaagcauguguguuuaaacaauaugaaaucugggcaccuugaaaaaagaacaggguaacagcaauguucagggaacaagggagauaaccauuaggucugacugccugagagccgggcagaacagagccauacuucucuucuuacaaaagugaauaggagaaauaucgcugaauucuuuuucucagcaaggaacagcccugagaaagagaacgcauucccagggguaggucucuaaaauggccgcucugggagugucugucuuauacgguugauacgguugaagauaagggaugaaauaagcccuggucucccguagcacucccaggccuauuaggacgaggaaauuccugccuagcaaauuuuacucagaccggcugucugcucucaaacccugucuccugauaagauguuaucaaugacaauaugugcccaaaacuucauuagcaauuuuaauuucaccacgguccucugaucucgcucuguccccauuugccuugugauauuuuauugccuugugaagcaugugaucucugugacccacacccuauucguacacucccuccccuuuaaaaaucacuaauacaaacuugcugguuuugcggcucagggggcaucacagaaccugccgacauaugauguccccccuggacacccagcuuuaaaauuugucuguuuuguacucuuucccuuuauuacucagaccagccaacacucagggaaaauagaaaagaaccuacguugaauuaucaggggugguucccccgauaucugaaaagaaccuacauugaauuauugggggugguucccccaauaauuggugaccagaaagaauacuacauacacauaauaccuacauuaugaacuuagccaaaccucugcaacugugagugauagauucauaugauuaaagucaaauuuugcuguguuguaauuuguugcuacacuggacauuuacuucuuggaccacuaaauuuuagaaaaugcuuuuuagggaaaacaugaaugacauuuuucauguucuuaaugacuagaugucuguuuagaaagagagagaagggaucugucuucuucuuuucauuaaaaaaagcauguauuaaauggucacugucacuauuggugcugugagcaagaggauuuugucacuuugguauucauguauaccucuugaacuucaugaggaauguaacaauucugcuuuacuuuccauuaucacuuauaaaaguuuugagaaugcuucuuauguguuucuuuaccaaaucugaaugcaucaauccugauuguaaggcgaagguggacacucuuauuuugaagccaugauaucuccugccaaaggguuuugguaccacagggauguggcacauuuuucuggaaagggccagagcaauggugaaaaagggcccacagaugguuuguugaugugguagagccaugcuauugcuacaauuaucacagacacugauaaaaagggucuacugaaauaaaacagcuuugugcauccuuuaucguacuucaacagucuuucuaaguugaugaaguacaacucaacgacagugcugauauugguuccugcauagaagaauaaagcccagaacagggaaagagcaccacugcaggucacugcuuaucuccuugguuugcagaauggccagagccagaagccuuccugcacauauaaaaggcaguagaaaugaauguucagucuccuaauuaacaaacgaacgcaugagguuugcaucauuuuccuggguucuuaccaagggucaguaaggaaaucgcuucuuugaaguauaucuccguuauuaccugacauauuauaagucagagugcugucuuuagugucugugaacguauguucucagaagauuagccacaaaaucacaaacuuaugugagaaaauuacuccuccauuaaaguaauuuaugggaucaugugcaaaagaaacauuagauauggcaaccagagugauuggacaguauuucauauuguuaaaagaguguucuacaugauaaacucucaauauaaacagcuguaaguuacuuucaauugaagugugauaaggcuucaaaugauuacauuaaaugagcaaaaguguucaagaaucacaucugaauguugaaauucaaaugauuuauguugaauuucaagggcccucacucagucgcaccugcaaaaugucaccuccaugguccuaucucuucucuucucauuuacuuucuugcuaaaaggucaaaccagaaaaucuacucuuuaacuuucucuuugacaaugucuaaauucuuaaaucuguuuaauuuuaaacugcuuugugcauauguauagacuuuguuccaccuucuguguuucucuaagaugccccauuagucuuaaacuacuaauacuuuuagcuuuccacuaaauaaucuauaagugguaguaagaauuuaaacuaagaugucuauauugcaagcuggaauccucaugcaagccuugaaugggcauaggaccggaaaccuauuuaauuuauugaagcugaaguauuauuaaguauuauuaaucaacaucaucaucaccauugucaucaaggauaauauuaauugagcauuaacuauguacacaauguaaggcauauuaucauguggccaacauaauuuucguaauuguuuugugagacaagaaauguuauucuauuuuacagauugagagaguauggaucaaagaacaaaguccgaauuucauuaccugagagaauuagaaaaugucuaaaauugaagcauuucucauucuuugauuuuuacuuuaugauuacaaauagauuuauuaucaaucuguguuucugaguauugugauuaaaaguagcuuuuguguaauaaaauucauaauuacuauaacacaucauuacuaguaaaacucucuaauuaguuuaucacaaacagaagcucaggcccucccuccagagauucugauuuaauuuuaccugggugguuauaauguacagccacauuugaaaaaccacugauguaacacaguuaugacauuacucauauggccuagaaauagccaaauugggaugucaaauugauuucugccagaugcaaguucaauaacucagugguuuggugugcucuagucuauucaugauauaagaugcaaaauaaaugaacuuuauuauuugguuggugguggguaugcugauugcaaaauuuuuaaaccauuucaaauuucaugcugagaauaauuuuaugucucauauuaagagaaucaccugaaaugacauauuacuuugacauaauagccuagaaucagaugaguccaagguauaucuaacauuuucuagaacaaauuaaccugucuaagccauguguugcaggacacagaaggaaacucgauaaagugaagaaaacuuggcauuaagagacuuuacauuuggcuuuaguucagguucugccucgaacuagcuaaaugcuuagggcgugcaacugccuuuuaucugcaucaguuucuccaucugaaaaguaagauauuaaaugacugccaagcucucuugcagccuuaauauacuuugaguucuauguuagugguauguacgguaauucacguuccaaaaaugcuauacuggaaaagcucacuguacuguuucaaaucucacucacaucaagaagaaugggcugaauucaguaucagucacucaaauguucaucagauuccuuauggaauuuuuugugguuguucuuauccuguuucaauauggauuguuuuuucuucagggauaguuuuccuuugucauuugugauaaacucaccuaaggucuucauuacauauucuauugugauauguuuuaauuuauccauagccuaauacauacucuaaaauauuacgauuauagagaaaggcauagaauugugaguuuuaaaacuauccaaaucucagaggaacuguucugcucacaguauuaauaauaaaugcacaagagcaugggaacaggcagguuagcaauagaaacguauuaauggguuguggaaaaacuaccucacauuuguuauuauaguuuucagacugaaggguuucaugcuucauaauaauccaugauuugucaaaggaaggcagaaaauguggccauaauaaaccugaaucugaauaagagagaguuccguguuguugguugaauuucuuaucacaaagauggcccuuaguaaguuuucagagaaaagaauaggagagggagaaagagagggaaggagggggaggagagagaguauaugaaugggagaagguaagaaaaagggagaggguaaaaagaaaacaauauaucuuacuuaagccaggucauaucaaauuuggaaagaggaaagucacagggucacaaagaaucacaagacaauauuuaugggauuugauucugugauaauguauaguuuuguggauucugcagaauuuuuccacauaguaugugcuauggaguagaauauccuuggcuacuuuguggcccaugccauuuucucuucuucggcucucagugggugaacuuccuuugcuucuaccauugccaaaagcagccaucaggccugccaacaguguggucuaccucccacauguaacaccucugcugugacccaucuucuguuagagcagaagaugucugaagcaagggugcuaacgcuugaggguucuuucauguucuacucacauuuaccagaguugggugggaugauauucugagugacaauuaccugcucucagaaucacucuucccuuaggaaaaagccauucgugggcuucccucaacaauacuagugaccugacuagacuuuaaaaaauuauuucuaaguuugagacuaaacuaagacuuuuucugcaagaauaaauacaauuacacugcaaugaguguuuuaagaugcagggcuaguggaguaacuaggaagaaagaggauagaaacgggauauaagagacugauuucuggcccuagcuuuaauauuuacuagguucuugaauagagguaaguuguuugaaugcauuaugcauucuuaaaauguaaauagcauaaaauuaaugaaaaugaaccacaugaaaacauucugugaaaggauuauugguuccaaaaauaaaggaugccauaaacuuccagguagaagggacaugccauccacaauacaaaaauaaaucaaguuauuucagauuugucuuccauaauauuagauaccagaagauuacagcauuugggcagaaaaaagaaugugaccaaggauuucauauccaaauugucauucauauauaaaggcaacagaaagucuauuugaaauacauaauacaccaaggaaaugcaagacacuauaaaagugauuaaguuauuuuuaauuaugauaugaaacuggaagaaaguacagauucaauugaauaguuuaugauucauaccuauugaauguagacuucaauaacuaugauaaaaguuaguuaucaaguaacauguauaauugaauaagcauauaucaaaucaaauuuaaagcguauaauucuugagggaaaguguacaguaagaaagauauguacagcaugaaagaagacagaaaaacaaaaucauuuuuccuucuguugcuuuuguugcugcuguuugggggaaugaagguaaagguaagauaaaaaugagccacaauucccuauucuuuauugggggcauucaguaaacaccacugaauaaaauuaagaaaauggaaauaggcaaacaugaaugcaauaucaguaauaugcagaguagaauuuagcacacauuuuaugauaugggauugagaggguuuguuuuacugacagugauuacaauccuuaacaaaaaucuggcuguaugcacugacacaucuauuacgcaauaauugucagcaauugccaaacaaguugagagaaacaauuuuaacaccucucucgguaugauacauuacauaaauaaaaaugccugauggaaagauuacugaauaagauaauuacugacuuuuaucuuaaaaauuuauaucugaggacauacuccagacagaauauuuauuuuaauuccaaguaccuacaccaaauacccaugcaugguuuagaaaacugaagccuacuuuagcccacagaaagaagcucgguguguucuacaaaaaaaaaaaaaaaaagaauaauaaaaaguucacucccugaaaauaauauuuaauuauauguguaauuuuugaacugaaaugaaaugagaaagaacuagaggaauugcuuuaucaagcccuuggaauuuacuagaacuguaucaaagcacuuacuacgugccaggcacgagccucaucucuggagagaggaugcccgagccacagcacugcucccuuggaggagcucacaguacagaaguuaacauuaaaauuuacagagaguuccaucuagcuccuguuccucuuucaauucagagccagcauuuguguguuucuuuuuuuuccuggaaaguuccaacccguaaauacucuuggcuuugagaguuacauggucucuaucgaaguuacucaacuuugccaugguaggaugaaagagccauggaaaaaauauaaaccaauagguggguggccugauuuagucugcaguuugguuugcuguuccuugcucuaauuaaacauacuuuccucccagccaucgcacuaaaaaguaguauuuuuuuuucaauuguguuuuuuaaucuucuuucuuacaaucuuuacaggauagcuuacucuacauauuuuaauacaaauguguuauguuuagacuagauuuaagcuauagucuaggguuuauagaauguuuauggauuggccugggaaacugaccacuggacguaauauuaauuuuuggacaaccuguguucugaauucaaaauaucucccauguuugagcgugauuuuuggaauaugggauguucguuuuuauuucuuuaacuuuuagcagaaaugauacagaaaaaccaucucugaauauggagggaaagagagauagugacacuuguaaaauagaaaauaauguagcacuuuugauguuuaucucacucaauuuagaaaugucuaagaaccacuuuuuugcaauuagggaguauuuacauaaaugcucaaucacuuuccugcuuuucuuugaagucuaauguuucaaaacuucuuucaacuacaaaggauaaauucaucaagauaacuagauuauccuuugagccacacgcauuuccuuuguaaaauauucagcaacuccaaccauccuucaugaaguaccaauauccaccuggggaacuguaauucaagcuuucaggaagagguugguaauccuucuacguaugguauuuagcugagccugagaccaagagaauagagcagaacacaaaaauaaaaauuaaaauauauucuauuaacuaauguuucuucucuuagcucuuaucauuuaauuaaucccuacuguaauucuccauauuagcaucauacaguauuauaauuucuuacaguaggcuucaguguuuaggauuacacaaucuuuuguuguuuggagucuauuuagugucaauuauguuccacacuaucucauggacugccugccauuucgguuauuuuggaagucucagguuucauuuuugugguccuauuuggauucuuguuuguuuaucuacaagacauuuuaucaauugauuaaucaaauaauacuuaacauguaaccucauucuguuagauacuaugagaguugcaaaguucaguacagcaccuaaguuccucauacuuauaguccgugauuuuugcuuuugagcauacugaguaguugguucggggcaaagcuggagcuuuucugcaucugggaucuugggaguugagcaugggcauauggaagaaagggaaaacaaaauagguagccuucacaagggagaccuugagaccuagggggaagucccaagaucaaguccauacuuccgggcagagaucaauagcugugcccaaaguaaagagccagcuacuguggacuacaagcugcaguaaaaaagauuccgagugugagccuugagagauuccucgagguaauggucagguaaagguaacagaaagggaggauauuucagagagccuaaaacagaaaauuauaggugggaggaguauuauaaaggguucugaguuggcuuagacaaaacgucgcuacuccagcccaagcuugaaugucauggaagugacccagcuguuccuuauauaaauuugggacuuugugcacucugauggcaguugaguuucuaguaggaauugcagugacacauuuauuauuauuauuauuauuauuauuauuauuauuuguguggugauaaauucuccugauggugcugacagcagaucugcggcagcacuggcugacucagccucuuguuucugagcccuuuagucacaguuggauggccuuuuacugaggguaccaguuuucaucauaccauaggguucauuaagagagcaagccacaaacucauuaccaaaggcuugauuaaaaccagggggaaaaugcuggaaggccaugaaaguuccagguaucuucucaucaauauucagagagaagaguuugggaccaaugaaggguuaacugcagcuaaugaaucccauggcugaugggaccaagugggagaucuguccugcuagaaucccagacaccaauuguucugguuucuucuccuuauauugugagaugcaggcaggguucuucaaggccuggcauccucuggugggagguaauaacagaggcacuggacauggcacacauuuauaaaguaaagcagaaucaagcuuaaaucuugaaaacagaagccuuuugcaaaacauggaauguccaaaaauaccauuccaagaagagaacauuuauaggauaacugugauuguaguuguuagcuaaaaggaauuuuuaauagaauuaaaugguaauguauaaaauaaaggaacaagaaauacgaacaaugacaagagaagcucucacuaaaaggugguauuuaauaggacauagaaagaugagcaggaccuagauagaaaauuggaguacagauacagcauauuaggaagugguuaaaugugaucuuacaagagagguacaagagugagagagacaugaguuagcaagggaacagugaggaaguucgaugugugaggcuggaucagacgugagugccuacgaagucaaacagaaugaaguuagauuugggaaggauauuuucaaaucaauaauuuaaaggguaaaaguuguguuagaaaaggauuaaucugcugugccagaaggagaaagagcuugucagaauccugugcagagauccaaagugaagcgauggaaauggauaagaaaagaugcauaaacaugcaguuguaacaagcugugaaaaaaagaacucaugagaggaucccuuuugcugcuuuggaagaacacauucuauguauucuuggggaagugugaugaaccagaaagaaaggaaaugguucucugcuugccuauauguagacuugcuauuuuccuaagaaugaaaauauguacagauaauauguacaugucuccuacaaauuuuugagcuucccaauugcauagccauuuucaggaguguuacugugggaauguuguuaaacauuagaggaaagauuauuggacuagugaaguauccuaccuagacaaaaucaaacaaacaaacaaaaagauucucuugucucuagaaucuuuuucucacacaaguacacaguuauucucauucauauuuccucuccaguuugcuuucagggaagaagauacuaaauauuuuagauuuaaaauuuucuuuuucuuuuuuauuaaauaaaguauuguuucuacauuauuucugugagcacuggagacucuguauugcagcuauuuuuauuauuagaauaaguuucaacauaaccuggacauuaaaauauauuccagaaauaauaagaaugggaauauaagcucuaagcuaaccuacaugaccaaugagccugcacaucaacauaaggcaggauauuaaaucagcuccugaaaaagaaacaauaucaagagugccaugcacucuacuuguguaaauaugugcuugaccagcaaauucucucuagggccugaacaguuuccauuuuauuauauuuuauuuuuuugugggacaagacuuagaaaaugcucugauuauaaaauuuaacuuccauucauggucaaaaaccuugaguuacagaaacaaggccaggcuuguguugccaaguaagcauaaaacuacagcaaaauuccauauaauacuuauuuugaauguucaucugagcaguaaaaaagugaagucuuuaguuauucugcaguuacuauccuaguccuauuuuuagagaaaaaaaguuauuggauggcaugagaaaaaaauguauuaucaaguggcacgguuauggaaggauauguaaaaccgcauugauuuagacacuuaagauuugcaaauguuacuauaugcuaagccuugugcuacucuuauuagaaauaauaauaaaaauuuaucauggcauguuacccuaaacacaucuagaacuuuuuuucuguuacugauaagaaagcuaaagccaauaaauauuaagauauuagucccaaauaucagagauguuuaguggcagagcugaaacacccaacucuccuaaauccuaaccuccuuauucuauuuauuuuggcaucauuuauacuaaaauaaugaaagugaaucaugcauaucauggguauguuggcaaaguuggguauagucaucauguuguucccccaaagugcuuaaaguaacuugaugaugguacauuuugcagaagcauaugcauucaaaugcaacguugaagucaugaaagaguuccuacucauaacagaagugcaaaauguuucucagaaauuuauagacuaugcccugggaaaaguggagccaagaaagaagauaguaggcagaguagaaggaagaaaaccaguagcauaugauaucccuccuccugcuuuuguguucaaacacagucuacaaggcacagcacauacacccgacucugaacuucagaugaacugguuuugaaccacgacaaacuuacuuacugguuacugaccuuggugauauuaacuucuuugaacauuuuuuaaaauuuuguuuaauacauaaagugaggacaaugauauacaacuucaaagacuguggugaagauuacauuacggcaaauugaaccuaaauaauuuaguauuugguaugaagaauaaauggaggcuacaacaaucauuacuuccuacaacagugccuaguauagagagggcuguugauugaggaagaaugaaggugggagagagcuccucagcagcuguguguugaauacauacauuuuaauauacuagguuaaaaaaagagauaaugcaaauaaaauaaucacacauuaauacugggaauuuaaaaauuuaucgacuuuuaaaugaaacauauuuauaaggcagaucuauuuugauagagaauggauauaugccccauugauuuuaucuuaaaguuuaacaacuuuaaaaaauaaauuaaaaggaaggaaaagaaagaaaaaugaaggauaaagaaaggaagaaagaaaaggaaaggaagagaaaaggaaagaaaaaaagaaaaaaaugaaauaaaaagaaaggcgggcacaucugauaaauaugcaaaagaacucacuaguagcugaaggcagaauugcuaggcuacuuaaauccuaagugucuagucaaagaggcugugaauuaacacuguuguaauuauuaaagugaaaaaagcuacacagaguuucuaaacuuucccugaggguguuucuccuguuacuuauucuuuguaccaagacauccaaaaacauacagaguuuagugcuuuggcaacugcuguuacaauguuugagugaaauccuguuuaacugugaauggcuuggaaguggcggagaaaguguaacauauacacacacacauacagcacugacacuuuccuacuaaaaaucauuucauauuguuuaaagaaaauucggcaacguauccaacaagccguugccauaaaaauauuuuuuaucucuucuucgucaacauuuauaccaaaauaauagagauuaucuuccugaaacuuuuucuuuucauuuuagucacuaaucuauauucuacaauaauuaaauuuugaaaggucugaagcauuuaucccccaauuuugaaauaucacuucagacuauaaaauccugcaugaagaugggcucuaugaccuggccaauucacuuaaucuucugggacuuguuuacuucacuuacuaaaugaagaguuuggaucuuaggaucucuaggauaccuucagguucccaauauuuaauaauucucgaaaaacaugcuauuugugugugugugaucauguuuuuccuauaaggguauaugagccuaaaauucauagaaaacuguguuuaaggcaggcauaucaauuaguuuggaucauuauuucuuuuagugaacuaaaugcuaaaguuuuuuucugacuuucuagguuauauuucuuugauaucaaaaaauaucagauagucuuggcuuuccacaauuauuuuagggucaauuacacccccuccccaaguauuccuuacgguucuauuuuuauuuaccccaugucccaaguuauuaagucauccauggcgauacccuguccagaacggccauguucccaucugcaacacuuucaucugaucauagcuuucauuauccacuccaaaaccaucccuuucuuacuauccccucaucuccuucucucucaaaacuucuguuuccccaaaagagcuuauguucacuaggugaucacagaggagcagacuaauuaaaccaauuuaaaauauaaaugagugacacaugaccugguuuauuucagucaggaaaaucuucauguuguaaaagucucaguuaucuuuaacuucuggauucauucauuaauuuacaaccaguauuugggagauaacagcagcccuaaaucauagcaagucacagagcugcuagguggcuuuagaccaagucuagguuuaucuagauaggaaacuagcuaaauuaucucaggccuuugaucuaaccuuaguaauaagcagacccaacuguaugaugauaagaacagaacugaaagaauaauuuugccuguuuguuucucuucauucuaccuguaggugaaccauucaauuuugcauaaaauauguaauauuuugagcaauaauuuagcagauguacuguuuucaucuaaacgucugacaccugaagauuacaaaaguuagcauuaaaaaaauaggaaauuuuaaaauguuaaucacacagaauugcacacuggaggccaaauggaggaugcguaggucacuacuuguauagauagaaaggauucuuaaauuacuaaucaaacaugcccaaagcuuauguucuguauuguauggaguaauaucuaaaugagaaaauagcaaacuaugacauaauuuacucuuuguagcauguucgauaaaucugauguaucaaaauuuacaguagcugcaaauaaacuauagaucuaaauauuaacagaaaagaaauacaagcacauaaagaauauguuccaggccgggugcaguagcucacgccuguaaucccagaacuuugggaggccaaggcaggcggaucacgaggucgguagauugaaagcauccuggcuaacacggugaaacuccgucucuacuaaaaauacaaaaaauuagccgggcaugguggcaggugccuguagucccagcuacucaggaggcugaggcaggagaauggcgagaacccaggagguggagcuugcagugagccgagaucacgucacuacacucuagccugggugacagaacgagacuccgucucaaaaaauaaaaaaauaaaaauaaaaauaaagaauauguuccaguaguuuaugaaauaaaauaaaauacaagcaaccuacaggcauucucauagguaagaggaaggauuaaacuuggcgaucaugaaaucucuacaauaugguucuuuuaguucuaaaauuggaggcuucuaaaauuuaugaaacaacagaaacaauaagaacucucuauguaggaaaguaaaaauaaauaaaaugaauagcaaagaaagaucaugagaaugcacccaauauuguaaauaacaaaagagggaagagccaaaggauuucuuacauauaaauacauauucuuguguuacagauagaauaguucaaauauuauuuuuaucagaagacauugggaagucaaccuuuugauuugucagcuuguuuuuucauagcuugacaugugaagagaaauccgguacgaacuaaacuagaaguaaacacuaagaauuugaggcauucuuuaaaaguaauaguauaacagcuggacugguucaauuuggcuuuuacugcuguuuuuuucaguuguaagagcaaaugaguugaacacccacagaagaaaauacaucacauucugggaaccaauccuaagaaaaugucaaccuguagagauuuguguuugaacaagcugauaauagucuguuguuguuuuuuuucuucauauuguaucucuugccuggaauacacagccuuuguugaugccugaaauuuuuaagaaccaugaagaaauugaacauuaucccagaauuucuuauacuaaaucaauacagcaaaagaacuuagucaagcaaaacaggcucuuugggaggccccgcugcccuucaauacuguccagauguaaaauucaggaaaugcuguagacauuagagucauucaaaauuuacaacaccuaaguaagcagcaugaaaggacugcagaguggaaacaaagaaugaugcauguugagcagaaggggcuggagugaaagacaacagaauccauggcaaggacagagagcagaauggaucucuaacccucucaggcaaaacuggacuaaaccugucucuauucaaagcaacuauucugucccuacugccuccuggcugcuugucuucccugaccccuucugaaggcaugaagccacuuguggcuauagcuagaggcacaaaaccuucuuucaaaugguguauuauuuuaaauaguaaguuguaagaauaccaaaagauagucuuucuaaauuuuuuaaauccaauuuacuuaauuuagaacacacaauggcaaauuugcuuacacauuaucuaauaauaaagcagucacaucagaaugucggguucacggaggccaggaacuuagccguaucauuucuauugaaucuccggcagcuaaaacaaugcuuggugcauaguagguaucccacauauuugaaugacaaaaugagucagagaugaacugaagcagaauucagcuucauggagaauuucugauucccagggaauuggauauucugauuuuuauccuguuuaugauaaacugaauuuccuuugccuggcuuuccaaaggauguccaaauucucugucaauuuuuauuucaauaaaaaaugagagccaaaaucacuuccccuaguacucuugaucuucugaaagcuaaauuauuuuucuuccuuuuacuauccuuuacgccuccagucccuaagcuuaauuaacuuguauuuuucuaaaggaacugagaggcaauaugauccauagacaaaaagggaauuauuugcucuguuuuucccccaauuaucaaauuaucaaacaugagucuucaacacuuagaaguuugaaaucagacuuauaauuuuugucccucaauaugccauaccuacagggcauuaugaggaucaauucauuauuuagugcagaaauaauuucuuuacuaguacuuuuguuuauucugacauguaaaagaagaaguuuaaaugucuuucuaaaguauauauuucuauuuauaguguauguaaauuuccccaaggguagcaauaacuguagcuguggaaagugagagacacacuagaauaacgugagucacuuuucauuuuucuguacuuuccauagcucccacuagggacauaagcugaggccacuaaauauuucacaacugcaauaggguuauggccagugaugcaacaauagaaaaagaagagagaaagaaagaaaaauagacaaggauacuggaaagaauggagugaggagggaagagagagacagacaaagaaauagcaauuguaauauuauagaggaaaauccaaacuuagaacuaaagggugugcauauggaaaccgaaaagcacauaaagacuaagaauauauuuauucauauaaaucgaauaauaacuuagucauugcauuuuauccagaaagucucuaaaguuuucuuaaugguuuucagucauucacaaucauuaagauuccacguagauucuaaaauuaauggcaaucauguaaucauaggugagagcuacaaagauuacacucuucugauaccagguucauguaauacaucuuugcccaucauacugagauggaucauuaacggucaauuucacuccaacugaacagccccaccuuaaccauucucuuacaauauggccuuguuaaaggauguauuagaaccagaaaccuaaacacagagcuuucauccuucacuuccucaaagaauaccuugcaguggcuucaaaacugccucuuagccuucuugccuggugaccaugugcuucugucacuacuuuacauuuuucaaauuuauuuuuuaaugauucacaauaucagccuccuuaucgauucaaauuaaaaugcauuuuauauuccccaaggugacucugccucuggggauccauuaccauuauuacuacugaccagaugaucuacccauuucuuccuuaacaaucuggauacucuccauccucuaacagcugguuucagccgauagcuugguaccuaaaauauaauaaauucauauugaaugaauaaggaaugaaugaaugagucaaacaacaucugugaaacuugugcuccauguaauccuggauuuacaaccuuaugaugagauuuuagcaaugaaugggaaaguugggggcaucuaugaaguauuauuuguccaggaaauauguaauuuauugauuauuuccuccucugggugcuuucuuuauaguuuuuguuuguuuguuugagaugagucucgcucugccgccugggcuggagugcaguggagugaucucggcucacugcaaccuccgccucccagguuaaggcgauucuuccugccucagccucccgaguagcugggauuucagcugcccaccaccaaacccagcuaauuucuguguucuuaguagagauggaugggguuucgccauauuggccaggcuggucuugaacuuccaaccucaggugauccgccagccucagccucccaaagugcugggauuacaggugugagccaccacgcccagccuauaguagaaucagcaaaauucauuuaaaacuauaggcugugugcauuggcucaugcuggcaaucccaacauuuugggaggccgaggugggcggaucacuugagaucaggaguucaagaccacucuggccaauauggcaaaacccuguuucuacuaaaaguacaaaaauuagccagguguggccacugcuccuggccuauaguuuuaaaugaguugaauuuaggugguaagagucaaguuacuaagcccaaaaauguggaguucauggagaaucuuacauuucuuauuauggguauucgguauucuguuguuauguuggguuuuuuuucuuuuuuuucuuuccuuuuuuuuuuugagacagcaucuuagucugucacccaggcuacagugcaauggcaggauuauagcucacugcguccuccccugggcucaacgcaauccuccugcuuuagcuuccugaauagcugggacuacaaaugugcacaaccaucucugguuauuauuuuuguuuuuuguagagauaggguaucacuguuggccaggcuggucuugaacuccuaacuucaaaugauccucccaccucagcuucccuaggcauugagauuucaggcuugagccacagcuccuggauuuauugucgauauucuugauugagauauuuagucauucagagcugugcauugguaauagcuacugcuugagcacacuuuuauccacauauagauuacaugcuacuacaaguuaggagucucaucaucuguuuucaacuaacacaugcugaguauauuugcauguacggcauucugucaggaucucuauaugacauaccauacaguacugagcaauuuuuagaguccuaguucucauggaaauuauuguucuguaaagaaaauaaauauaccaacuauuacaaaaaauaaguuauaacauuacagaagcaauagaaacuuuaaggggcaauuaaauuugucaaauaggucaggaaacauauggcauauagcaucacagauuugaauuuagccuuauacccuaaaauacgcauguauauuuacuaugcuauaaacuacacaagcaagauauaaguguguguguuguggggggaggugagggggauuauuugaggaagcagauaguguuacaucaauuuauuuucuaaauggucaauguuuacagcaaacaaacuggaaaauucaauuauuaaaaacaccuggagaaaauuaaaacaagauacauauaauauguacacuauuguaaacuucaaaaaguguauuauucaauccuuaauaugagauuagauaaaaauguaaauuuacucuaauaauguauaauaagauaaaaaaggcuuaagguaacugaacaaaauuaaaacuaaauauaaaguucucugcacguaauucacuaaaaaugccaguuuuuuuuaaaaauccuuugagcagauuuacuucuacuuguucuggugaggagauuugaacauuuagaaucuugugaaagcagauaggauuauaucaauauuuccugauguuaauaggaauuuuaagggauuaaaacgaaacaaaacaauuuuauuagaaaaaaaacacacacacagcugcagaaaaccaaacuaagcaggcuuuaguacuucaggaccucucagguucauugguaaauaucacagagcuucuugggaccaaaaagucagcauuuuccagaucuaucagaccaugaucuuccccugcagaauaucuugcaugucuguauuccaaacaaaaugcguugaaaaacacuaaggaagaguucuuaaacugagaauucugaaagagcccacucauuucuagcaaguguuaacacuguacuacacaugguugcuaauuaauuacaagauuccuccaguuauccacacagaaaugaaaacacguaaugaucagaacuuaauuaauuauugaagaucuaguguggugguaacugaaugguuccaaaggcaaugccccucaaucacaucauagucagaaucauuaaucugagaaaugaaaacaagaaagaggagagaaaaaucaggaauuuuguggucaaaaaggagaauaaauucaauaaaauuuuuggaauguagagaaaucuggaccacuaagguggcugcgcaguguauguuucaauaagaauuucucaaccuugguacuauugauaugcugggcuggaaaauucugugcuuuggggguggucauguacacaguaggauauuuagcaguaucccuggccuccacccacuagaugucaguagcauuccucuccccagaauugugacaacaaaacauuucuccaaauauugccagauguuuccugggaggcauccuaucccagccuugagcuauuugguuaaaaagaagaaauagguauuuucagaagcaaauuguaagaaauacaaggaugguaggugaaaaagaaaacccaagaaauaacacgaacugguaacaaaaaaaagaagaaacuuccaaaguaaauaucauauuuuaaaucauaagcaaaaaaaaaaaaaaaaaaaaaaaauacuaagagcauuuuuuaagaauuuguagaagaaauaaagguacaaagcaaauuugucauuuuuugaaauuucuacaauguuuuaaauuucaauaauauaauuuauuuaguuucuaauuuuuagcugaauuaaugacaugaaauagauuccauauucaaggugaauauaauuuuaauuaauuuaaacuuuguuaccucuguagcacuauuuaagauaucaacacaucauucaaaaauauaugauguucauuucaauauuuuuaaaaguuuauuaaauuuacacauuauauauguuuuaugauacuauuuccagagcauuuaagaaaacacaucuuuucuuuuacauauuaauagaaauuuuggccaaagaaaauucccaaacugguguugaugcaugaugaaaaacgaaacaggccaauuuguguuuuugauaccaaagaguuagaauucauaaaacacuugcucauagcuuuccagaaaauauuacuugaguugauuaaaacaaaccuugaaccuauaaugauuauaauuaagugagauuuaaaauaugacaaauagaaaauuauuuagcuauuuaaaauauuuugcugguuuuuuuuaaaccugcuuguauguauacuugucauaugugauucauuuuggugcuucccucuuucagcaccucuaaauaacgaauaucaaagaaauaggcucaaagaaauacaauuaaauuugcaaaaacuaccaaacgcaauaauuaccuaacuauacuauaaaauauuguuuugucucaaauauauuuuuuucuacuuaguucuuguuugccuagagagguuauuuaaagcuaagaaggauuggugauuguccauugauaauaaucaggaaaaauuuuaauggaaaacucuacucaguauagcagaauauaaugaaaaaacaaacacacaaaaaauccagaaagcuguucccuugcuaggugaauauccacacauaugaauaacucuuauuuauuuauuuauuuauuuauuuuuagacggagucucgcucuguugccuaggcuggugugcaauggcgcaaucucggcucacuguaaccuccgccccccagguucaugcgauucuccucccugagccuccugaguagcugggauuacacgcagccaacacuaugucuggcuaauuuuuuguaguuuuaguagaaacaggguuucacuauguuggccaggcugguccagaacuccugaccucgugauccgccugccucggccucccaaagugccaggauuacaggugugagccaccauacccagcacuuaugaaucacucuuaaucucuuuacaaauucucucuugucaguuaguuuuaauuguuugcauagcucuaaaagccauucauauuuaacucaaccuaaucauauucuucuucaauuuuuuaaaaauuaguuuucuuaauauuuucauauuuucuauguuaacauaugaccacaaaaaccauauuuaaaaauauuaguggugaggugcaguggcuugcaccuguaaaaaaaaaacuagugauauucaacaucuaauuuuuaauacaacaaguauuuaucaacuaucaaaaagaugaguaauaacaaauguuggcaagcaugugaagaaaagggaacccuugugcccuucgguuggaauguaaguugguacagccauuauggaaaacacugcaaaguuucaucagaaaucuagaacuauugugccuggcacggucacuaaugccuguaauccuagcacuuugagaggcuaaggcaagcagaucaccugaggucaggaguuugagaccagccuggccaacacggugaaaccccauucuacuaaaaauacaaaaauuagcugggugugguggugcacaccuguaaucccagcuacuuggaaggcuguggcaugagaauugcuugaacccaggaggcagagguugcagugagccgagauggcaccacugcacuccagccucagccugcgcaacagagugagaccaccccacuccaaaaaaaaaaaaaaaaagaaaagaaaggaagucuagauccagcaaucccacuuuuggguauauauccaaggcaaaugaaaucaauaucuugaagugauaccugcauugcuacauucauugcagcguuauucacaguagcuaagauauggaaaacaaacuagguaccuauccacgaauaaaugaauaaagaaacaaugauauauauaauaaaauauuauucaaccuuaaaagauaaggaaaucuugccauuugcaacaacauggaugaaccuggaauauauuauguuaaauaaaauaaaccagacauggaaagacaaauacuaugugauuucacugauacgugaaaucuaaaaaaaaaaaucauaucacagcaacagaagaagggugguugucaggggaucagagguaugggaaauggagaaauguuuuaagaugaauaaguucugagaaucaaauguacaacauggugccuauaguuaauuauacuauacuguauacuugaaauuugcuaagagaauagaucuuaaguguucucaucacaaaaaauaagguaacuacgugagauaaccaauguguuagcuugauugugguaauaauuucacaauguauauuugcaucaaaucaucacauuaugccuucaauauagacauuuuucauuucucaauuuuaucuccuaaagcuguaaaaauauuuaucaagcacuuacuauaugucagguacuacuuuagauucuugacauaccucuguggaaaaaagagauaaauaucccuaauauguggcuuacauucuaauagcagagacaguaggaaaaauguacaaauaaauuggguaaguuagaauucuaucuggaaaagaaaauguggagaagagaaaagugcuugguuggauugcauuucuaaauagaauaguugaacagagcguagaaagugauaauugaacugauagcagaaaguggcaaaggugcugcuaaugaggauauuuggaagaugaaacagccagugcaaagguccugagguucaaauaugacaguauguacgaaagccuggaaaaaggccacugcggcuggagcugagugagcaggagggagaauaguagguuaugagggaagagguaauguaggcauuuuguguaagucacuuuaaagacauugguuuguauccugagugaaauggacagccauuucaggguuuugagcagagaagugauauaauuugacuuuuacuuaaggggucauucugguugccacauugaaaauaguucuuggguaaaagcuagaagcugguaaaccauuggguaggucauugcaauauuucagguuugaaaugauaaugaauugaaaggagugagaaaguggaugcacagagaaguguuugaaauccagauguaauguuagguagcauuaacaggacuuucaaguaaaugugagcaggagagaagagucaaauaagaccucauauucuuggacugaacaacuggagaaaaacagacuggcuacaaucugugguagagaaaucuaaggaugguacauacaggggcaggguugggaagaucucuuucaacauauagaaaaaauaacgggagucucuguccuuacauuaucuguaggauagggaauguaugagcauacacuuccaauaugauauaaaauuuuccuucauauauaauacaugacugugaugguuaauauugaguccuuacauuaucuauaggauagggaauguaugagcauacauuuccaauauuauauuaaauuuuccuucauguauaauacaugacugugaugguuaauauugagugucaacaugauuggauugaagaaggcaaaguauuguuccugggugugucuguugccaaaggagauuaagauuuaagucaguggacuggaauaggcagacccacccucaaucugggugggcaccauguaauuagcugccagcacagccaaaauaaagcagacagaagaagguggaaggagcugacuugcugacucuuccagccuucauuuuucuccccauacugcauucuuccugcccucaaacaucagucuccugucaaguucuucagcuuuucaacucuuggacugaaacaccagugguuugccaggggaaucucgggccuucagccacagacugaaggcugcacugucggcuucccuacuuuugaggcuuugggacuuguaauugcuuccuugccucucagcuuacagauggccuauugugagacuucaccuugugaucgugugagucaauauucaauagacucuccuucauauauacaucuauacuauuaguucuguuccucuggagaacccuaaugcaaugaucaacucaaauuugcuguguccaaacaaaaauucaguaucuuucuccucaaacauacaccuccucaaguauuccuuguaucuuugaaaagcaacaacaaagauauaguuguacuagaagaagaucaaagcaucauucuaaacuccuuuucaucugaaccacacauuuuuagauucuuaaauaacuuuugaguuuauguccucuucauccuuucugcuacauaucaauccuauaauauuucucaccugagccaauguaggggcucauuaauaccucagcacacaacagcugcaaugccauuaacaaaauuauucucuucaacuuucagcugaaguauuguggccaucugaaagucuuucauauucucuccaauuugauuugagucucuucuucuguguuuccacaauagcuuaacauggguccacuguaauauuuauaugaccaacaaugagugucauuuaucuguaaaauguuuaauguauaaguaauucauacuagagcuaugggaauucaccuguaugauuuauggauuugugguuugguuacagggucuguugaagaaagaggaaaaguacuuguugguugguaguaagacuucuacaaaguucuuucucuuugaguuuacagagcaacugcuaugcgcccaguugucacuaucaauuaaaauuccccagcuucaugucugggaagaaauucuccaaagugccugauuccuucccccuacaugucaggugggaagccugcuucauuccaugucuuucacguuacucacaugugguuucggacuucuuuuuuaauuucuuaccauuucacagcucuuggaccagauuugagcuuucacuaccuggcuuaugccuucagagcccuugggugcucaagcauuauuucccgcuaucuucuaaaccuucuguuucuucuucuacagaaagauuugcuccacugugucugaccacuucuaacucgauucugaucuuauuuaagguaaacagaguuaacaauccaagggguuuuggcuggauuuaaguauucauaguaaguuuuuuaaaaauagcuuaaauguucauuaauuuccaaguuuauuuucuagugaauagugauuaauaacuaguaugcaaccguguauauugcuacauuagaaaauuuuuaaguguauuucauuugcauuaucauuuaaguaaguucaugaaguuaguaugaaaccuuacccaauguuauuacugcugagucuauagaaaacaaauuccaauuucaaaacaaauuagcuuuuuggaguacaguccauuggaugcuuagcaauggauugauuaaaaaugggggaaauauggccaggugugguggcucacgccuguaaucccagcacuuugggaugccaagaugggcaggucaccugaggucaggaauuugagaccagccugaccaaaauggugaaaccccaucucuacuaaaaauacaaaaguacccaggcaugguggugggugccuguaaucccagcuacuugggagacugaggcaggagaaucgccugaacacaagaggcagagguugcagugagccaagaccaucccacugcacuccagccugggcaacaagagugaaacuccaucucaaaacaaaagcaagaacaccaccaccaaaaaaacaggggugggggaaugugagccaaggaaguugcuaaguugcugcaacaaaguaacaaaauaaaccuauaauuuauaauuauuuuaaacauuagguauuagguacacauuguuuugauuuuguaaaauugaacaugcaaauacacacaagugauuacuaugauacugcaaggaaaagaaggguugauauaccauuaaaauacauguugggaacuaucaugaccuaaugcaucuuuuaucauuaugcauuacacaaaugaugcugcuagguccaaaaagaaaauauuuuauuuuuguauauuauaaccugcuaacuuuuguuuuaugcuguaucuaucucacauaaaguuuuuauguauucacaaauauuuccaacauuaauucauuuuugugacauaauaaaguggggauuuuaauugaagacauacagauagauacagauuuagauacauauaaaaucuggaaaagccauagugcaauuuaaacauuacugaaaaagauuucaauuauucagucaaaaauacuaauugacagacugacuugaaauguuuagcuuuuaauaaucaagagcaucacacuuggauaacuuuuauaaccuguuuuagaaugugcacaaauguuucaaaaaagacaauugucauaagagucuuucaauaauauuccucuuuucuuuguagauuuuaagacuguuugguagcaaacauauuccacguuucaagcaugccaccuuuugggaauauugcugauucauaauacaauuaucauaacuaauuuuaauuaagaaaacuuugguuucuuuuuuaguugugcugaauuaaacauuaagcauuuuauuuuaaaagcgugccuucuguacuuuacugaacauugacaaauuuuuaaaaaaauauauuaguaauauguuauguuuuuccaagauaacaaagaaaguuaagaaaagaaaaguuuacccaaaucacaguagauuuuucuacugcuucacagcuuggacguuuaaagauaauugucauagauuauaguucguaagggcaccguauuuuaauuccaaacugugaauguucacagaaauauauacaaagagacaaaaauacuauuuuguagauuacuuuaggcuuuaacuuaggguuguuucacacacacacuucacauaaacugcuuaucuuuucaaacuccgaauaacuuccugaagacuggucccaccugaaagauuaggaauauaagccucaaagaacucccagaaagaugagaucuaaacacaaauugucuuuuuaugaaacauagagaaacggaagaugcguuuaaaauguaugacgcauuuuguaaaacuauaaagaagaaugaucugaaagguagccuacuggaagucauuagaaagaaucaauguccaaagcaaugaaaaaauaacucaauguucaugccuaugcaauaaagcagggaagagaccacuucuuuagccaaaugagaaggaaacugagaauagaccuacugaugguauucaaguucaucaagaguuguuauuaaguugcuguucaggaaauggaaaucugccccucuaauaaugucaaggaaguugcugcaacaacguaacaaaauaaacucuacaauuuaucacagaaggcugguccauaacauaguaacaaccaaauaaccacauagguacauaccuaccuaaauacacacugccuucccuaaauaacuuuaaaaagaaaaaacaaaaaaaacaguaauucaucucuucaggaucaacuuuucuuggaguaaguagaugagugauacaugagcagaaaaugccuauacuuaagauucuguuuuuuaguguguguuuaaugaagucuuagaacauauuuaauagggcaaauguuacugcauuuaucgugaaagaaagcaaaccuuaaaaagagaaaguuauucaagguauacaccuauaacaugucugcaaaguccaacuggaaauaaauguugacucaccaauuuuaaggaagaauuuuuuaaacacugagaaaacucagaaaacuuaccacuaauucuaccuaaacauaugacaaagaagcaaauauaauaucaacagaacuguguguacugauuuuuauuuucagagaaagcacuucuugucacaggcugggguaaaaggagaugaggcugagauggauuccgaaccaucagucugaagagagcugggucuggaacacuuacuaaacucaaccaaacgccaauuauaaaccuucaaaagaaaggcauuccuaaauaaaaacaaucuuguguaaaucuugaaugaucucuuucuuuugucugcccucuuccuuacaaacacacuuaaaacaaccuuucuuuuucuuuuuuuuucuuuuuuuuuacccaguauggagugcaguggcaagauuucaggucacugcuaccuccccguccccaguucaagagauucuccuaccuuagcuucccgaguagccaggauuacaggcgucugucaccacgcccugauauauauauauauauagauagauagauagauauagauagauauagauauagauauauagauauagauauauauagauauauauagauauauauagauauauagauauagauauagauagauauauauagauauauauaaugugauauuucuaguagagaugggguuuuguauuuuuauuuuuguauuuuuaguagagacggaguuucaccauguuggccaggcuggucuugaacuccugaccucaggugauccucccaccucaaccucccaaaaugcucggauuacaggugugagccaccucgucuggcucacccuuuccuuuuagaugauauuuugagaacugaugaagaauguaacaaagaaaauuuuauacuagaaaauugucacugauuauuauguacauucaauugcuuuaauguuauuuuuauuuuuaauuuuuuuauuauuauacuuuaaguucuaggguacaugugcacaacgugcagguuuguuacguauguguaaaugugccauguuggugugcugcacccguuaacuggucauuuacaucagguauaucucacaauguuaucccuccucucucccccaaacccccaacagaccccagugugugauguuccccacccuguguccaaguguucucauuguucaauucccaccuaugagugagaacaugcgguguuugguuuuuuguccuugugauaguuugcugagaacgaugguuuccagcuucauccaugucccuucaaaggacaugaacucauccuuuuuuauggcugcauaggauuccaugguguauaugugccacauuuucuuaauucagucuaucacugauggacauuuggauugguuccaagucuuugcuauugugaauaguggugcaauaaacaugugugagcaugugucuuuauagcagcaugauuuauaauacuuuggguauauacccaguaaugggauugcugggucaaaugguauuucuaguucuagauccuugaggaaucaccacacugucuuccacaaugguugaacuaguuuacagucccaccaauaguguaaaagcauuccuauuucuccacauccucuacagcaccuguuguuuccugacuuuuuaaugaucaccauucuaacuggugugagaugguaucucauugugguuuugauuugcauuucucucauggccagugaugaugagcauuuuuucaugugucuguuggcugcauaaacgucuucuuuugagaagugucuguucauauccuuugcccacuuuuugaugggguuguuugauuuuuucuuguaaauuuguucuuuguagauucuggauauuagcccuuugucagauggguagauuguauaaauuuucucccauucuguagcuugccuguucacucugaugguaguuuauuuugcugugcagaagcucuuuaguuuaauuagauccuauuugucaauuuugucuuuuguugccauugcuuuugguguuuuagucaugaagcccuugcccaugccuauguccugaaugguauugcuuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucucguuuuugucagguuugucaaagaucagaugguuguagaugugugguauuauuucugagggcucuauuguguuccauuggucuauaucucuguuuugguaccaguaccaugcuguuuugguuacuguagccuugcaguauaguuugaagucagguagcgugaugcauccagcuuuguucuuuaggcuuaggauugucuuggcaaugcgggcucuuuuugguuccauaugaacuuuaaaguaguuuuuuccaauucugugaagaaaggcauugguagcuugauggugaugccauugaaucuauaaauuaccuuggguaguauggccauuuucacaauauugauucuuccuauccaugagcaugaaauguucuucaauuuguuuguguccucuuuuauuucguugagcagugguuuguaguucuccuugaauagguccuuaacaucucuugcaaguuggaauccuagguauuuuacaucugcaaacagggacaauuugacuuccucuuuuccuaauugaauacccuuuauuucuuucucuugccugauugcccuggccagaacuuccaacaauauguugaauaggaguggugagagagggcauagcugccuugugccaguuuucaaagggaaugcuucaaguuuuugcgcauucaguaugauacuggcuguggcuuugucauacauagcucuuauuauuuugagauacgucccaucaauaccuaguuuauugagaguuuuuagcaugaagggcuguugaauuuugucaaaggccuuuucugcaucuauugagauaaacguguuuuuugucuuuaguuccguuuauacgauggauuauguuuauugauuuguguauguugaaccagccuugcaucccagggaugaagccaacuugauccugguggauaagcuuuuugaugugcugcuggauucggguucccaguauuuuauugaggauuuuugcaucgauauucaucagagauauuggucuaaaauucucuuuuuuuguugugucugugccaggcuuugguaucaggaugauguuggccucaaaaaaugaauuagggaggauucccucuuuuucuguugauuggaauaguuucagaaggaaugguaccagauccucuuuguaccucugguagaauuuggcugugaauccaucugguccuggacuuuuuuugguugguaggcuauuaauuauugccugaauuucagaaccuguuauuggucuauucagggauucaacuucuucuugguuaagucuugggaggguauauguguccaggaguuuauccauuucugcuagauauucuaguuuauuugcguggagauguuuguaguauucucugaucauaguuugcauuucugugagaucaaugauauccccauuaucauuuuuuauugcaucuauuugauucuucucucuuuucuucuuuauuagccuugcuagcagucuugcuagcagucuaucaauuuuguugaucuuuucaaaaagccagcuccuggauucauugauuuuuugaaggguuuuuugugucucuaucaccuucauuucugcucugaucuugguuauuucuugccuucugcuagcuuuugaauguguuugcucgugcuuuucuaguucuuuuaauugugauguuagggugucaauuuuagauuuuuccugcuuucucuugugggcacuuaguacuauaaauuucccugcacacacugcuuuaaaugugucccagagauucugguauguugugucuuuguucucauugguuucaaauaacaucuuuauuucugccuucauuuuguuaugugcucaguagucauucaggagcagguuguucagucuccacguaguuguuuaguuuggagugaguuucuuaauccugaguucuaguuugauucuaaugaggagugcuuuacuucaaacugugugaucaauuuuggaauaagugugauguggcacugagaagaauguguauucuuuugaucugggguggagaguucuguagaugucuauuaggucugcuuggugcagagcugaguucaauuccuggauauccuuguuaacuuucugucucauugaucugucuaauguugacagugggguguuaaaaucucccauaauuauugugugggagucuaagucucguuguauguaucuaaggacuuguuuuaugaaucugugugcuccuguauugggugcauauauauuuaggauaguuagcucuucuuguugaauugaucccuuuaccauuauuaauggccuucuuugucucuuucaaucuuuuuugguuuaaagucaguuuuaucagagacuaagauugcaaccccugcuuuuuuuuguuuuccauuugcuugguagaucuuccuccaucccuuuauuuugagccuaugugugucucugcaugugaggugggucuccugaauacagcacacugaugggucuugacucuuuauccaauuugccagucugugucuuuuaauuggagcacuuagcccaucuacauuuaagguuaauauuguuaugugugaauuugauucugucauuaugauguuagcugguuauuuugcucauuaguugaugcaguuucuuccuagcauugauggucuuuacaauuuggcauauuuuugcaguggcugguacugguuguuccuuuccauguuuagcgcuuccuucaggagcucuuguaaggcaggccugguggugacaaagucucucagcauuucuuugucuguaaaggauuuuauuucuccuucacuuaugaagcuuaguuuggcuggauaugaaauucuggguugaaaauucuuuucuuuagaauguugaauacuggcccccacucccuucuggcuuguagaguuucugucgagagaucugcuguuagucucaugggcuucccuuuguggguaacccgaccuuucucucuggcugcccuuaacauuuuuuccuucauuucaacuuuggugaaucugacaauuauguaucuuggaguugcucuucuugaggaguaucuuuguagcauucucuguauuuccugaaguugaauguuggccugccucauuaguuuggggaaguucuccuggauaauauccagaaguguuuuccaacuugguuccauucucccugucauuuucagguacaccagucagacguagauuuggucuuuucacauagucccauauuucuuggaagcuuuguucauuucuguuuacucuuuuuucccuaaacuucucuucuugcuucauuucauucauuugaucuucaaucacugguacccuuucuuccacuugauugaauuggcuacugaagcuugcacaugcgucacauaguucucaugccgugguuuucagcuucaucaggucauuuaaggacuucucuacacuguuuauucuaguuagccauucguuuaaucuuuuuucaagguuuuuagcuucuuugcgaugaguucuaacauccuccuuuagcucagagaaguuuguuauuaccgauccucugaagcguucuucucuaaacucaucaaagucauucuccauccagcuuugucccauugcuggcaaggagcugcguuccuuuggaggagaagaggcgcucugauuuuuagaauuuucagcuuuccugcucuggcuucuucccaucuuugugguuuuaucuaccuuuggucuuugaugauggugacauacagauaggguuuugguguggguguccuuucuguuuguuacuuuucuuucuaacagucaggacccucaggugcuggucuguuggaguuugcuggagguccacuccacaaccuguuugccuggguaucaccagcagaggcugaagaacagcaaauauugcagaacagcagauguugcugccugaucuuuccucuggaaguuucgacucagaggggcacccggcuguaugaggugucaguuggccccuacugggaggugucuccuaguuaggcuacucgggggucagagacccacuuaaggaggcagucuauccauucucagaucucaaacuccaugcugggagaaccacuacucucuucaaagcugucagacagggaaguuuaagucugcagaaguuucugcugccuuuuguucaacuaugcccugcccccagaaguggagucuacagaggcaggcaggccuccuugaucugcagugggcuccacccaguucaagcuuccuggccacuuuguuuaccuacucaagccucagcaguggcagacgccccucccccagucucgcugccaccuugcaguuggaucucagacugcugugcuagcagugagugaggcucugugggcaugggacccuccaagccaugcacgggauauaauguccuggugugccauuuccuaaggccauuggaaaagcgcuguauuagagugggagugucccaguuuuccagguaccaucugucauggcuucccuuugcuaggaaagggaauuccuugaccccuugugcuucccaaaugaggcaaugucccacccugcucugugggcugcaccuaccgucugacaagccccagugagaugaagccgguacuucagcuggaaaugcagaaaucacccaucuucugcguugcucacgcugggagcugcagacuggagcuguucuuauucggccaucuuggaaccuccuucugcuuuaauguuauuauugaagaagaguacagaaauaaagauucucaaauuguauuaaaaauugcuuagaauaauaaagaccuaagaucuagauguuuggaaauuccauuucugccaccuugcccauuaaaaaaaaaguaguucaccuuauuuuauuuuugauuauuuuaaccuaaguuagauugaggaaucauacauacuauuaaauauauuaaauuuucagccaaaauuugauucacuuuccaguuuuacuuuuuguuaccuccaaccugucugugccugaauuuccuugcuggauuuaaacucugcacagcugauuucaaugaacucuuaguaaguucaaagaagagcgucuauaaaaaugcuguaaagcagcugggcgcaguggcugaugccuguaaucccagaacuuuugggaggucgaggcggguggauuaucugagguccagagcuugagaccagccuggccaacauggugaaaccuguuuuuacuaaaaauacaaaaauuagccagguguggggcaggugccuguaaucccagcuacucaggaggcugaggcaggagagucacuugaacccuggaggcagagguuauagugagccgaaauugugccacugcacuccagccuuggugacagagugagacuccauuuaaaaaaaaaugcuguaaagcaguuauuacuuuaaaacaauauguagaggagaacuuugugaauaaauaacaauaauuuaauagcugugaccacuauuuuacauaaauuaaguuuagcauaggcgaaaguuguaauuuuuucagugaacuuucuuuuuuuugcaaaaaauuagaggaauauaaaucacuacaguugccauuccucaucacauguauaucaccaguuuucuucugugauuucaaaagauggauuaaauaacugaucuggguguuuuacaauguaucaaugugcucuuauacauuaaaacaugaacaaucauucuuuauuuucucuuugguuuucaccaugguuacacuaauguaagaaacaacauaauagcccuuagacuacuaugguacauaacauaguaacaaacucacauuuguuugagagacugaaacccucugcacauuuaauacuuugucauuaucuuuagauaccacuucagguuuuaauuaaauauaauuauguuccagacgaugugggaagaguuauccccaggagcugauagcgucucuguucuaggaugacugauauaaaaaaacaggaauuuucuguauuuauaauaaugauauugucgcccaaguguaguggcucacgccuguaaucccagcacuuugggaggccgaggugggaggaucaccugaggccaggaguuugagaccagccugaccaacauggugaaaccccaucuuaacuaaaaauacaaaaaaaaauuagucaggcaugguggugggcaccuguaaucccagcuacuugggagguugaggcaggagaaucacuugaaccugggaggaggagguuguagugagccaagaucccgccauugcacuucagccugggcgacaagagcgagacuccauuucgaauaauaauaauaauaauaauaauaauaaugauauuguuuuaugcaauuauuuauaauuguauuuacuuauguaauuacuauauaauuauuacuuauguaauuacuuauuuccuuucuucuuaaccucuauuccucauugcauauuccaaguguauauucugcaaaugugcccaagccucuacaguaagucuaugacuugaauucaguucaguuuuuaucaauugaacaaguauauguuaucaugacuggccgggacacauaguuauacgaauaaaauuguaugagaggccaaaagaucccccaguuucuagaauuuacuguuuaguugaauuaaauuuucuaguacuuguuguucugaaauaucacuuuaauuugagaaaacaucugcacaguccuuuggggaagucaacuuagauuaaaugccuuaaacaacaaaacuaguaucggugauuuaaaaauaaaugauuugugcuaccuuuucccaguucgaaggaaguguaaccuauugaagagucuaggauccaaugucagguacaaguagauuaaaauuccagucugaccacauaggagcuuuguaucuuuucacaaauuauucaggcuuucaaagccucaauuuucucaucugugaaaugguaguacuaaacaauucuuaccauaaaacucuguugaagcaauuagaguuuauaucuaugugugguugcaaaccaauaaauauuaucuguuccuguucuuaugaacaauaugagugacaguagagggcaaaucccagauauacaauuucaauaucguugauuugugaguaacugucuugugaaggaaacccccugaagaguauaaaacucucuguuuuggcucugaagggaaggaauacccucuucccagguucuucuggucuauagaugcuuuuuaccagguguaaaguaacagcccaaaagguuucaaauacuuucagaagagugaguagugcccagagagcugaugaggcagguccaguggcaucucugagcugucagccucaugcccauacucugccaguugccugcucccuuucuauguuucuguagcauaugcuguaaaugcuuugugagacucuuggggcauaaaguuugcacugauggaagccugggucagaccaaacuaacuaaugaguacugucaaaauuccaguuguuaucugaaauucaauauugacuuccuugucaauguuuuaaggauaccuaagagcuuaagagacuuagcugugccuguaucaugcugucuuugucuaagaaagugcagaagaaguuuuacugaaguauuuguucuggugcauaugaugaaacaaauucuggaaucaauauuaaaaaacacuguauagcuuguagaauuagguauagcaagucuugcauaaaacugaaaaacaaccaaaaauuaaaaauaaaauuggaguuggggggaauauauagcaacccuuuugagccacauauacaucacuauauuacaucacaaaaauaacuguuacuucacuauuuuagaagcucagucauuauuacacuauuuuuccaaaccauccauuguaaaacucagagcaaagcuaucugaggaagauuguaagcucuuuuuuuucaaucacagucucuauaaacuaauguacuguacucaaaacauaaauugaaacaaggagguaaaagggaaaugaacaaucaguguuuuccaaauugcuucuuugguaagaaauugaaaaauacauucauaugaauguauuuaaaaaacaaaacaaaacaaaaagguggaaugaauugaagaggcagagcagaucauaaaauaaaacuggaaguuuaauaaucugcuacuuuuccuuuagacauagaaaauguacuuuaugaauaccuaaaaacauuaugauaauagauuauugcuguuacguauuauucauacgacaauggauuuauguaaugugucuacaucaaguaaaagagauuaaccagaagaaacuaacuucaaaguacauugucuuuuaggucuccaaaguaauaaagauccaagcacuucccuuuuaggguauuugcucugcaucauuuagaaugcaguuucuuuccuucauuaggcccuccauaugagauagagcaaaucagaggcuacagaaauagagauuucuuccuuguacugauagucucagauguuuggggcugcuaacccacuagugguuuuguaagccuuauucuacgugauccacccauuucucaacagccgugcaaaagauuuuccaccuuuguuacaguuugacuacuauuuccaaauaaacaacaauacagucagacuuuguaaaaguggauguuucauauagaaauuuggccacgcuuccuaaaauauaagcaauucuuacgugugaguaucaguucauacuaaaaagcucuccuguguacucuaguucaacauagcucugguuggaacguguaacuguacucgauaauuaguuuuguuaauaaugucaugaaaacauuguacaaauuucaagaugauagauuuuuaaaauuuugucauuuuuaauuacuauguucaauuuuccaugaagcaacacugaaauaaauagcaaaacaaaaccaguaacaugaaacauuuccauaauuugugaaauggaaauaggaaugauauacaccuugauuuuacuaugaugcaacucaaugugaaauacacgaaacccuaugaggacaaguaccaaggugacuuacgccaaagaaaauugauugaaguauuucuauuuugaucaaauuuguuguguaaaguugugccacugcaaaacucugggaguaaaucauaaaauguauauuuuuauauugaagguugauggguagagcacuuucagaacaauuuccuguugagugagcaguaggaaguuauaagguccucaacaggaacagauugauccaugcauagacagaucaaagaaauauguuuauuaaguacuucguguucaucacaaaguucaaucuagcagagauuuucuguuauauuguccauguggugacuccuucacaagcuuuaaaguaauuauauuauuuuauuuuaucuuauuuuaaacugacagauauaauuguauguauuuaccaugcacaguacaagaugauguucuaaauauauauacaugguggaaugacuacauccagcuggguaacauauggauaacuucacauaauuauucuuuuucuggugaaaacaccuuauauccauccucaacauuuuucaagaaugcaauauauuguuaacuauagcuaccacguuguacaauagaccccuugggcuuauucaucccaucuaacugaaauuuuguauccuuugaucaguaucuccccagucuccacaguaccccaaccaucccucgccuguaaacacagcuuuugcucauuacuucuaugacagcaacuucuuuacauucuacauaugagugagauaaugcagugauugucuuucuaugucuggcuuauuucauuuaacauaauuuccuccagguucagguauauuauugaaaaugacaggauuucauuauuuuuaauguucaaauuguauuccauuguguauauacaucacauuuucuuuauccagucaucuauugauggacacauagauugauuccauaucuuggcuauagugaauaauacugcaauaaauauaaaaguacaaauaucuuuucaacauacugauuuuauuuccuuugacuauauacucaguagugacauugcugaaucauaugguaguucuuuuuuuaauuuucugaguaaccuccauacuguuucccucaauggcugagcuaauuuacauucccaacagcguuugagaguuuccuuuuugccacauccuugccaagacuuauuaucuuuugucuuucugaugauagcuauucuaaguaauaauguaaauuaaacaaugaugguaaaauaaaauuuguagaugacuguucucaaaauauuuccuccauuuuuaaaaaaggcugaauaguauuccauugcgcauauauauauauacauauauauauauauacauauauauauauauacauauauauauauauauauauauauauauauauauauauauauauaucacguuuucuuuguccauucaucagugauggacacuuacauugcauucgauauuuuggcuauugcaaauaacgcuucaaugaacacacagauuagccuagagaacauuaugcuaagggaaauaauccaggcacaggaagacaaaaaccacaugaucucauuuauauauaaaauguaaaaaaaaaauugaauucauaaagcagagaguagaauggugguuacuauguauuggguggguggcaccaaauggaggaauauugauuaaaggguacaagguuugaguuaguacaggaagaauaaguacgaguacuauauucacauacucacaauguauuguacaguaugaugaccagaguuaauaauaauguauugcauaguugaaaacugcuaagagaaugauaugguuaggcuuaguguccccacccaaaucucaucuugaauuguaauccccggauguugaggaagaaaccuggugggaagugacuggauuaugggggugguuuccuccaugcaguucucaugauaguggaugaauucucaugaaaugugaugguuuuacaaaugguagauuuuuccugcacucucacacacuucuccuuccugccaccuugugaugaaggugccuugcuuccucuucgccuucagccaugacuguaaguuuccugaggccucuucagccaugcucaauagaguaucaauuaaacuucuuuccuuuauaaauuacccuguauugggcaguuuuuucuuuauagcagugugaaaacggacuaauaagagaguaaaucuuaaauauucucauuacaaaaaauaauaaagauuaguggugauauauauaugguaauaagcauuauugacucauuccacauugucuaaaauaauuuuucauucaucaauucaaaaaauguaguagauuucuaccuaaaguugggccacuaucaacaauacuauuuaauguucuauugagaguauuaauaaaaggaauuauagaaucaaaaucagaaauauaagaauuagaggaguuaaauugccccuauguaggugauauaguaguagaucuaaagauuaaaauaaaagaaauaaaaaaucuacaaagauauaaaauuaauauaaaaaaucuguaaccuuuauauauaaaaauaauguuaggcaauauauucuggcucucuguaaacaguuauuaaaaacauauuuuuacaaguccuguuguaaacauguuuuuauuucuacagaguaaauacuuagaagugaaacugaugugucauagggugacuauaugcucaacuuugucaguuauuacccaagagauucucaaaguuacaugauuuuucauuccaaccagcagaguaugugaguuuaguuacuucaccucuucaccaacaauugguauuguuaaucuuuuguaauuuuagcaauucuagugagugugcaauaguauuugauuuugcuuuuaauuuacauuuagcuaauaacuuauuacauuaaauguuuugugcuuaucagacauuuaucuuuguaaacagugcaaaucuuucccccauuuuuacuguguugucuguuuacaauugauucguaugacaucuuuauauaugcuggguacaacugcuuugucaaagauauauagugugaauauuuucucccauagcuuagcuuuuucauucucuuaguguuuuuguuuguuuguuuaauucugaagagcacagguuuuccuuguuuuguuuuucaugaagccugacuggucuuuuuuuuuuuuuuuuuuucuuuguggcuaaugcuguuuguguguuucuaugaaaucuuugccuagcucagguccaggaaauauucuucuauauuuucuucuagaaacuuuugagcuuaagauuuuauauuuaggucuaugugccaucuauaauuacuuuuguguguaugguaugaaguaucaagauuuauuuuuuuccuauauggauaccaaguuuucuaggucuggugguuaaaacaauuuuccuuucuccauuacaucacuuuggugccuuuuuggaagaucaauuggccauaucugcguggaucuaguucuggacuccguucuguucuuuuagucuauuuguuuauccucucacuauccuaaauaaugucauuuaaaaguaagccuaacacugugcugcugucacuguccacccaaauuugaugggcaaauuuagguagaaaaugauucuuucugugaacuuucaagcuucugauacaagcugcaauauucauggauuaauuuacaugacagcauaggauaaugaaugagaaaaagcccuuggaaacaaacaaauaugaauuugaauccuaucauacaggaaaucuuuuuauguuuuuaaaagugucauuuucuucaccuaacaaaguagggaucauauugucaaucuuauaacuguuuugagauauuuauuaagauaccauauuuuuuuuugugguccaaauuuuuuauuauuauuauacuuuaagaucuaggguacaugugcacaacaugcagguuuguuacauauguauacaugugccauguuggugugcugcacccauuaacucgucauuuacauuagguguaucuccuaaugccuucccucccccauccccccaccccacaacaggccccggugugugauguuccccuuccuguguccaaguguucucauuguucaauucccccaguggagucuuugacauauauggaguaaacauaacauaccuagcaauauaacacuauacucauaggcagagagggugaagauuauuuguagaaaacauggacacaauuuugagugccugcucuauuacuucuuccuuuuuuuguucugauuagcgaugucuuuccuuagauuauguuaucaaugauuuuaauguaucauguucuccuguguauaauagaaugcuauauucuuauacauuacuauuuugugauuauagccuuuguaauauaauaauuauccacguucaucauuuucucaucauguugacaaaugauaaaaaacuuuauuauucaugugcauaccuuuucaagguuuucucuuacuucugaauuucccagcauaaaaaauaaaucaggcgugcacgucuuuaucaguaggaaacagagcaauguuacuuagagcauuuucccaauagguuuacucuuucauuacuauguaauuaaccccacauugagaauucuauugugaauucuuuugcagcagcaaauuaaacauuugaauugcauacuauuauguuucugugaaagugacuaucgugucauuuugaaacagacgagcaauguuaugaguaaugaagaguuuucaguaaaguuuucaaugaugcuagacgacuugcucuaagagaaaauacucuauauauuucaaagaccccaccauaauuucuggcacaaaauccaucaaaaucuaauaaaguagcuuaauuagcaugaucaucgucuuauuaauaauuuacugguuggcaaaggcucuaaugggauuauaaugcaucauuuuaaaaauaaaagaacaucauugugaugcucaucaaggugagcacuauagaaguaaaaucugcacuaaacaaauuugguaucuuuaaaauauaacuagauaaccugccauuuccugauaaagcacaguccuauaagagagcauauuuucuuucuaggaauucugcaauucauaucuaaaaaugauuucaagguaaccauucugacacuuugaaaaauauauauauugguuccugaucaacagggcauauuuaaaauuuuuccguaaaauggccugguuuagcaaaucaacaauaaauuagcagaaaucacuaucaauauuuaacauuaaaauccuuguccacagaaaaugaaauuuccuaauggaccuuagaauauuuguaauguucacuguauauucauaaugcauuuuguagacagacaguauaaagaagucaacguaacaggauagagcagaugucuauucuaaauccuccuuagagucacugagagucuagagugacaggugaaucuuugauucuagcuggcuaaagggauugauaacagaauacagagccugcaguuccuaggucacuaauugaaauuugauccugguauaugccuagggaaaaauagaaguggguaggcuuccuacuuuaaucaucugcauuacgaaagccauuauuuuauggauaugaguguccuucacauucuaauauaaugcugcuacagcaugaaaagacaggaaaaacccagccauccaccuauaauggccuuucacaagacauguauuuuaaaucuuguuuguuacuaugaaucuccuccaaacugucuguagugcagcguggcuccaauugggcugcacugccuacuaauugauagucuucuuacuuuaugaacuaaaaacaagagagagugugcuuccuucccaauuaaacauaauucaaucccuagagacaaugccacauugccgauccagugcuuaacaacaguauuuuaaagagaaagaagaaugaucaaauucaagcaaagaagaauuccuggcaauugaaucacuggggcuucagcgguauuuugaugauaaagagaaguggucacuuccggguuaucaucugucuuaaauuaaagucuguauucaauguuuacacagcuucuuucuuuuaaagacaguuauuguuuaggaaaaaaacuaaaguacuugaagcccaacuaagugaacuguguguuuguuugacagaaagacuucgcaccauuagugaaucauucacuaacgcagcugccuguccuauaaaaagaaauauagacuaugcaauguuguuuucugaaaaaagaacucuacagugcauauaacaagaucuggauuagacuuuacuacuuagaaacuacuuaggaagaaauguuuucuuccucaggaaaaguucauauauuguuuagcuauuaauaaauguuuaaggcauuugcccccgaaauuugaugaaccauuuuuauuaauagaaucuuucaaaacuuucuagcucacuacuuuauaaauauuaugucaaguuaauuauucaaugucuuagccugguggucuuggugguuucucaaagacaaacgcauaugcuaaaaugcagagccauccauuaaagagaacaaaucccuuugcaauaaauaacuucaaggcaaauaauguggcaaaucuugacaagaauaaaguauaucaauaaugauuaggccuacauuauugaauuaauagaauaggucagaggaagaucaaaaccaaauucaguuauguguguguuuaucuccuccaauaaauggcgaacuuccuauggcuggggacauaaauauucuauggccuuaguuuaucccacuauauaauauucagcccuuaaugaaugguuacugaaugucuugaaauauaauauugaaauaucuuuaauuagaugugauguuugcauaauaaaaaucaucugaacauuuaguccaaguguaaaaaauauuuucaauuauuuaaaauccacgauauuaaguuccuuuuaaaaaauaaauuacuacagagaucuuaaaaugauauguuauacauuucuuucaacugauugggguuuaguuguacucaucauuaaucugcugauaucugagcugaacaauauucuuaaaacaaaauauaucauuuaaagguuagugguuuaaauuuuuauuguauuucuauuuuguuuggcaacuauuuaauaacaaauuguauuacuguaauuauauaauaaguaugaaauucuguccuagauauugaaagugcaaugcagcagacacaaacucauggcugcuucugaaggugaaagucugcuuccuuugucccauuuggauggcuggauuuagguacagcugucuucaaaagcugauauacuaaaacacaauuuuucuagagacgcgagguacaaauacauugaauuuuagaaguagaaaucagugugggaguuucuccucugggauuuuuuuccuaguccauuccuagaaauagaacuauauugcugugggaccauggucaguaauaggggacaauuggacaaggagagcugcuuaccaugcagaaggaaacaauucuuauuucuccauguaccuccacugggaaaccggcacacaggcaauuuuucucacucuauucaauccacaucaaggacacaaaaagacuuugguacuuuucuaaauaauaccuuucccgaaugucuugcugcaaagauuucuaauugccugcccaguaucuacucuuuuccuuccuuacuaauagcaccccaguuugguuugggauaguaaugugcccagcuaaaauguaguauguucucgucuaauuuggaaguaagagaggccaggugccaucauucuagcuaaagcuguuuaaagagaagucacugagugaggcuuucaggaaggcuucaaaugugacucagcuggucacgcuuucggcccuugaaucuucauucuuucucuuucucugaucauggacacgggggauagagcuguugucgcuuucuuucaaucacgaaaaauggccuaaagcaucucagaaaaagaugaguuucugaaugucaggaucacauuuuguauauuuauuuugcagagucacugucugggggcuuucuguuguaucugaccaguccaaauuccaacguuuggacaaaauucaucaaauccaucaacugaguuacaucucucccaccaugagcuacugccaacccugaaguuuugaaaagucaucugggacuuucuuccugacauuuccuuccauuauaccuaagcccuuccauucacuguuucauucuuugugucacaccuuauuuuguuuuaucauccauuuagcugcaguuauaaagucaaaagcuguuaauagaaaaguugaugaaagaaaaaauuaguuguacaaaaaagugggauuuagagaggcaggaagaaacaacacaacaaauaauaaugagauaaauacacuuucuucauuauguuucuuuuauaccaaauuaacaugagaguaugagucgaaguucuagaaugacauagucucagcccugaaaugucaaugaauaacaauggcuauaacaacagcccauucagcaauagcaaaguaagcuagaguuuuacacauacacucauccacuaacucaaaagaguaauuuuagccugggaacaggaaggaaugaaauuuuuuguuguuguuguuuguuuucuauuuuuuguuuuuuaaauuuauuaaaagucucagggugcaguagcucacaucuauaauccuagcacuuuuggaggcugaagcaggcagaaggcuugagcucaggaguucaagagcagccugggcaauguggugaaagccccucucuaaccaaaauaugaaaauuagccaggcacgcuggugcgcaccugugguuccagcuacuugaggggcugaggcgagaggaucacuuaagccuggcaggcagagcuugcagugagcugagaucacacuacugcacuccagcuggggcaacaaagccaggccccaucucaaaauaaauaaauaaauaaauaaauaaauauuuuaggaagucacaaaaagcuuguguguggggaaagugugacacaaaguguaauuuugcuuauugaaaguaaauuagggcugggcaugguggcucacaccuguaauccuagcauaucgggaggccgaggugggaggaucaccugaagucaggaguucaagaccagccuggccaacauggugaaacccauaucuacuaaaaauacaaaaauuagccugggaugguggcacaugccuguagucccagcuacaugggagacugaagcaggaaaaucgcuugaacccaggaggcagagguugcagugagccaagacugugccacuguacuccagccugggugacagaaggagacuccauuucaaaaaaaaaaauaaauuagaauuuagaucuaugauacucuaaaguaagaagacuguaaacuuauuguagaaauguucguauucauuacacagauuauuucaggaaacacaauaccauuaacuaaucuauuuaggagaguagauauuugaaaacauucuaauaugaaacauaguauuucaauaccacaggagggaaaagcuauaaugcaagucauucugaaaagaauuucaacauuuuauacuucuggagguuaugucauuuaaauaaaaauaaguuuauaggagugacaaucagaagacuggacauaauuuucuggagacucaaaugagacagcguaauuuaaaugugacaagguuuuagaaaugagguuuuuguccuuauucauggaaaacuaaaauuuuaauaacuuaacaucuaauuuuaggcauaucauuaacaaaguccaauccauuauuucuguuugcucacuugcgacuucagaagaaggugaguuucaguucuuuauuuucaaagacuuuuaaacuggcauaauaaaaagaaaauaaaaugugaagaaaaaugucuugaguuuucaauuuggaaggaaauuugaaaagucaaacagcaaugaagucauucuuuaggaggugcagagagggccacaacauagagccacacagagugauuccaagaccaccauugacacagauaacaauggcagccuagcaauccaucauccuguaacuucauggcucuggauuuggaaaaucauuugagaggcuugauuuuauuuauucccuaaaaggaaaaauaccaaaaaggcagaguucuuaagaaacuaacuauguacuucagucauacuaacuacuggaugccuuucuagacauuggacuucuuuuuaaaagucauuuucuuacauugaaacauuucuaaaaugggcuauaaauacauauuucaaauuuuacaauaugauaaauguaaacacuuuccuuccugucucucaauuugggaauaaucaaaauuuggcagucauaguaggauggcucucucuuaccauaaaccaaaagauguauuauuuuacacagaauuagaagagaacccaauuaggguaauacgaagugaaaguuuacauagaucguaaucauguaaucuauuucuaagguuuguuuucugcucauaagugguagagugaaucacccuugaauuuuaaaaacagggaaauuagauuggcuaucaauagauuuuucuaucuuuaauuccucccucucaacuguuuccuucuuguuagaaagcuucuuucauuccuguauaacugcucuuucaugaaaacuuggguguucuuuauuuuucucuuuucuuucauagacacauuuguguuagggaucaucaugccuguguauaaaguuuguaccuugcacaaagaugccucacugaaggggcaagugucugucugaaauuuaguccacaugcuguccacgaaguugugaaagacagugucuccccagaggaaaagaaugaggggagugaagaaagaagcccucucuucacuaaccccugaacuuuggggcuacaucuguucaggauauggaagggcaacuuuuucuaauucaugcagaccucuuaucaucuagcagcaggccugcucuuauuaagaguuucuauucacauugcaaauauuucuaauauauucaauggagugcuuauugugaaaguuaauugcaauauggugagauguggguuaauaacaaggaaauacaaagcaaacucaguaugggcaaaguuaagaaaaaacagcagaagucauagcagcugucaguaucucugaaauaccaacaagcaaaucaauacugagcccucuuugagaucaucuuuccugguggacuauaauauuaaauauuaguaaccuaaaggcuaugagucuuuaauaaugcuuacuaaauuuauuuuguaaauuuaccuugaguugcacaauauuugaauuuuacauuuuucuuauauggaaugaugcgugucuuacaggaauuuucaaguugcaacuuuagugaaaauguaauaaugccuaaugaauuauaaaauaaaaggaaaucagauuuuuaacuucaucaauagaacucaauaacauuauuuuuaaugcuugaaaagaaaaccaccuaaaguaggaaaaaauaagguugaguuuucuugaaagguacaaucuuacaauuaauaaauaauucacaagugaaucuaaaacuuuuaauuauguaauuguuauuuaaauauagaacacuuauauacaaauguuaaagaaaaugaaaacuauauuucuuauaguguuucaccaucaaccuagcuugcuucuugacaaccaaguaacaaauggcuaccagaacaaucugucccucagccugaaguaaauccauaaaaaauacagucuaucuacacacaaaauuuaaacauuguuucaaugcaauaaaaggauagugaucuacacgaauaauauauugauauguaaacauucaagcaccaccacauuagaagacauaaucaaguagucagauguuuuacucacaccuagaaucaccuucaauauaacaacgacaaauguaggcugacacacaggugcccuuugugccacuuagacaccaugagcagcauugguaucugugacuuucugaaauggugaaaacaguugugaccugagcaaaguacguuuccuccacugacacuguaguuauauuuagaaaauuagugcacauuaaaacuaugcaauauacuuuguaucuacauacaaauuugaguuuguuuccagauucagaaauuuguaaagagauuuugcaauugcacaaaccuacagucacuggguggugggaaauucuuuguaggguaggccagacgugcagauugcaagauguucuagugguuccgauuuucgcccucuaaaugucaacagccaccacccccuucauaauaauccagaaaaucaccacaguaaauuuccaaaauauucccuuuguuuccgcuaugaaaaucucuuccuuagagggaagagaaaaaucacugauucuuuuucuuucuucgcaugguuguuugugauguagagaguaaauugcaugaugggauuuaagugaagauccauuaucaacaaaauaucguuugucccuaucaagaacugaaauccaagcauuuauuaacuacccaaaagaaauaaugagagaugcugucaguccuucagauuuuucaaccucaagccgaacacuugaaguacaaauauuuuaauggcuaagaaugagaauuaauauaugagaauauauuuuaaaugcucugucuuaguaucuaccuaauuauuucauucaccauagaucuucaugguaugguucugagacuuuacuugccacagacauuagaugccucaggacagacacguguggcaaaagugugaugagggagcauggcagaggauggcaucagugugcaugaauaggagauggacagaugaaacuugagacauugaacaggaagaagacucugccaucaacccugggacugugcaagaacccuacuacuucuuuaucuacucuugaaaacacaggaugauaucucauuuucucuuuuauaagucgucugcuguagugaauuguugaauggaauuuuuggaaauggagcuuucuucagcaauagaaaaggaaaaauccauugagucauagucugauacaaagaagccagucaagcaaaugaaagggugggagggacacagguaugaaaguguuacauuugaucaagucagacuccuguagcugcaaagauauuccaacagagggcuuugacuggacgcuggagcuaauggaaaugcuagauaccuaaaacugcuuaugaauuacauguuaauuucauacaaagauaaugcaaagaugacugacauuuguuaaauaccccccaaauugugcuauucacugugcuauguacuuucuaugaacucaagcauguauuauugccccaauuauuuuacaaaugagaaaacugauguuuauggaccuuaaaaacacuucuauuuccacaaacuucuuaaauagggucccuuaguugaauuuaggucugucuuauacaaagacauauuacauuugugcaacaaauuaauauuuuuuaaaauaacugacugaaugaaggaaugagcacacugagaaaaaaaaagaaugauaacucaacagccacaaacagaaaucuugaagcaaauuaaucauaaacacagaagaaacucuuaaggugggcagaguuuuguucaaauggaaguuugcuacaucuucuaauacaaacacaucuuccauaaucuuucucauugauuuuuagaaacccuuuuaaauuuaagugucaacagucaaaaaguuauucuaauaucaauaagaaaagauagcaaaauacagcacucuuaagccauuuuguggugggaaaaaacagcuccacagaccugauuggucauugcaaucauaauuaaaauagcauaaaaaugaccccuaacuuacaaggguucaacuuaugauauuuugacuuuacaauggugugaaagcaauacucauucgguagaaacuguacuccaaauuuugaauuuugaucucuuucugugcuugcagucuguguuaucauaauuucucacaugcugggaggaagaagugggucaaagcucccagucacccacgcaaucacgaggguuaacaaccaauacacuauaguggaucaugcugccagaugauuuugccuuguuuuaagcuaaugucaguguucugagcauguuuaagguaggugaggcuuagcuaugcuguucuguaggcuagcuguauucaaugcauuuucgacuuaacuauauuuucaacuuacaguggauuuauagggacccaauugcaaacuggggagcauauauuugauaaguguuugugguuauguuccaaaguacucagaauuauuuuuacacugugguuggguuaagaaagcauagaauauguaagccauuuacaaauguguuucuuaaaguucuuuugguaugucauuuugaugaggugaguugcauuuauaaagaaaugucaacuaugugagcaacagauuuccccaugauaucaacuaaauaaaaucugccuacacacacacauauguacacacacaaaaacacauauauucuuagagauauagaggaucaaacauguuauaaacugaacauguugauuagucaaacugaaauggacuacaaggucuacacguccaaagguuauauuucuuacccauaaugaaaugucccuaauacuugugaaugauauggucuauauuguucaacauauaaguuuauuucaugaucacuuaucauuuacaaauucaguaguaauauugaaagagaacuuaggaaaucuacauaguaacauauuaaguucucaguaauaacaacaacaaauuuaucaauaccaacacucaaguaauuaaaaaaaucuugagauaaaaaccugaauauacuuaauaaaucuguggugagcugucaaccuuucuguguucuucagaccuuccaugucauuuuaaaauucaaugcacaaaguacauuacauuuuccacauaguaacauuuugcaccuacuucuucauagaauucccagacaaaaaauguuaaaauaacaaugugacauuuaucaucaauuuauacuuaaaguuuuauaguuuuagagcuugagaauguuuucucucuuaggaugcuuuucuuauauuaugucacauaucuggcuuuagccucaugaugugcaaggaauguaguuugcaaaaaccaaauuuaacugaaaaauauuuaaaccuaauuugaaaagaauaaaaaaacccaaaccucauuauaaauauauuuaaauauggugcucauuaagaaguaacuagaugaccuuucaguaaacuuuuaaagaauuaaauauuaaguauauauaauucuuuucuacauguuuauuuuuaaaauaaaaaccuuuugauuaaaagaauaauuuuaaauuaugauuuuacuuaaagugauuuaauuuaaauuguaauuaaaaguuaauuuugaaaaaaaauuaaccuuggucuuaucucuuggcaaauuacuauaguaguuuaugguacaugaaaucaucuauuuuaugguacacauaaucaucuauuuuuuaaauugaaaauaacucuuccaugaguguuuuuaugcagaggcuuuucuuuaaauaaaauaaugcaugcauuuucuucuuaggcuuuuaauuauaauuuguaaauaacauaaauucacaguuugcuaguacagcguaaucaagcagcucaccuucuucuuucaaguccuaaauauuucuuuguguugcagaauaugcaaaagaaaaaaaaugccacagacauuucaaaagaagcaaauauuccaccuugcuuuuaaggacagaugaaacaguccuauuuucauguggcagaugaaauaaguagauauuucaauaauauauuaacuucuccaaaggcauauauuauggcccgaaagaacuuuuaaaauuauacuuucagaacaacuucgacauugaaaaauauucacuuuaugauuuacuuguuagucucaagagagaacaaaguuucagagcaaaucgaaauauaaaauuaauacugcauacuguggaaguauauuaguucuguuuuuaugagacuugacaaaggcuacucuauaaaggauaccccaagaaaaguugggaaauaccuaacacaggugaauaacugaguaguugauauggaucauuugagcuguauccaacauuuuccccuuuucaaauuuuaacaguucguuuuucuuguaguaaucacucaaaagugccaucaugaggaauagccaugcagagcauuuuaaucucaaaucacacaacuuggugcuaaaacauucugucuguuucuuuugcuggaaauucaccacgaacaauggcacugcuauuuugacacuucgaagcaggccccagacuagcaaagcaacguaaacccaacaguagaaaucgaauugcuggauauugaaugagagggccggcuuagagccuaaaugagugugagucacuuaacugccaccaccugcuuccgcguuuacagaacuagugcauggggacauuacucagguucuuaggggccccaccuacuaaagaaccaaaccaaaccacaccagacuaaccaacaaucacaccaacgcugagcuucuguagaauccaaccucgagagagcacagcaugaacucucuaccaccccuggugccccuccacgccacacuaauuuccucugaacguugaaaugccuauacuuagagcaggugugcucuacucccucuucuguccugacuucccgaccucaaccagcuucaaacauucaaagucucuggaagauaacuuaagauauaaaauauguucaugguaaaguuuugaggucccuugugaguccauuaucauagaaaagacugacccuuaguugucuuuucuaaacugaaaaaucacccuaauggcauaaaugccacauaauuuaugaaaggauaacaagacuauuggcagccaucugccaugcuacauguggugauuucuggcaguaugcaauguaaaaaaucacacucaguuacuauuaagaagggcauagaguacacugaucaaucugaucaucuucuuagacuuuuuuugauacauuugcucauguguggaaaugcuuuuuauuaguagaaauaauagcuauaaauaauaaacaaugaauaauuuuaguaaaugaaugugugcuuuacaaacaugacaucacacaauauaauugggggcuauuuacauaucgguaagcuuaauauuuucacuauuauauuagaauaaaaaggaguaugcacacacagacuaucaaacaagaggacagaguauuuggguaauugagauuagcuugauuuugauggaauuuuaccagcuugaacauagagagacaagcauuuuuuucuuccuugguauuuuucuuauuucauuauaauuacuggcuuuauuuaaagguauauuucuaauauauuaucaauuacauagguauuuuguuauuauacagugauucagcauaugucuagaaaccuguauguccuggaagaaguuaacucacuuucuaagauucaguuuuacuaagguagguaaaaauauugucaauaggaaacauuaauaacauuaguuaggcacuuguuauugguaaggcaauuuguuaagcaccacacucauauguauaauauuauuuaaacuucauaaauaaccuggaaacucuauuccaaaucuccaguuagauauaaaagcaagacugagguuuauaagaggugcuucuccauucucagacucagaagccuaggagacuagaaucauagauuuaaaaacuggaauggauuuuagagauaaucuaguuuuauucucucauaacuacaaaaacuuaaacucugagagauuauauaaauugucuaaggcuauccaacuaguuaguggaguaucuacaucuuucugaauuuuuuucgucuaaucauaucauagaacuacacuauuauaccuucuauuuauacccaaaauaaaaaugagauaucauaauuauauauuuuuaaaauuuucuuccucuaaagugugcuucuuaauuuuaaaauaaguaggaaauuuucuaugacaucuuucauuauagauucaaaguuuaaaauauugcuacucaaugugugguccauagaucagucucagcauuagcaucaucugggagcauguuagaaauguuacauuauaaaaaagaguccaggaccagauggauucacagcugaauucuaccagagguacaaggaggaacugguaccauuccuucugaaacuauuccaaucaauagaaaaagagggaauccucccuaacucauuuuaugaggccagcaucauucugauaccaaagccaggcagagacacaacaaaaaaagagaauuuuagaccaauauccuugaugaacauugaugcaaaaauccucaauaaaauacuggcaaaccgaauccagcagcacaucaaaaagcuuauccaccaugauuaagugggcuucaucccugggaugcaaggcugguucaauauacgcaaaucaauaaauguaauccagcauauaaacagagccaaagacaaaaaccacaugauuaucucaauagaugcagaaaaggccuuugacaaaauucaacaacacuucaugcuaaaaacucucaauaaauuagguauugaugggacauauuucaaaauaauaagagcuaucuaugacaaacccacagccaauaucauacugaauggguaaaaacuggaagcauucccuuugaaaacuggcauaagacagggaugcccucucucaccacuccuauucaacauaguguuggaaguucuggccagggcaauuaggcaggagaaggaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagccaaaucaugagugaacucccauuuacaauugcuucaaaaagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugccuuucuucacagaauuggaaaaaacuacuuuaaaguucauauggaaccaaaaaagagcccgcaucgccaagucaauccuaagccaacagaacaaagcuggaggcaucacacuaccugacuucaagcuauacuacaaggcuacaguaaccaaaacagcaugguacugguaccaaaacagagauauagaucaauggaacagaacagagccugcagaaauaacgccacauauuuacaacuaucugaccuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauucaagacuuaaacauuagaccuaaaaccauaaaaacccuagaagaaaaccuaggcauuaccauucaggacauaggcaugggcaaggacuucaugucuaaaacaccaaaagcaagggcaacaaaagccaaaauugacaaaugggaucuaauuaaacuaaagagcuucugcacagcaaaagaaacaaccaucagagugaacaggcaaccuacaaaaugggagaaaauuuucacaaccuacucaucugacaaagggcuaauaucgagaaucuacaaugaacucaaacaaauuuacaagaaaaaaacaaacaacuccaucaaaaagugggcaaaggacaugaacagacacuucucaaaagaagacauuuaugcaaacaaaaaacacaugaaaaaaugcucaucaucacuggccaucagagaaaugcaaaucaaaaccacaacgagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuggaaauaccauuugacccagccaucccauuacuggguauauacccaaaggacuauaaaucaugcugcuauaaagacacaugcacauguauguuuauugcggcauuauucacaauagcaaagacuuggaaccaacccaaauguccaacaacgauagacuggauuaagaaaauguggcacauauacaccauggaauacuaugcagccauaaaaaaugaugaguucauguccuuuguagggacauggaugaaauuggaaaacauucucaguaaacuaucgcaagaacaaaaaaccaaacaccgcauauucucacucauaggugggaauugaacaaugagaucacauggacacaggaaggggaauaucacacucuggggacuguugugggguggggggaggggggagggauagcauugggagauauaccuaaugcuagaugacgaguuaguuggugcagugcaccagcauggcacauguauacauauguaacuaaccugcacaaugugcacauguacccuaaaacuuaaaguauaauaaaaaaauaaauaaacaaauaaauaaauaaauguuacauuauagguuccacuccagauuuacugaaucagaaucugccagguaguuuauaugcauauuagcauaugagaauugcugcucuaugaaguucguacucuuuauacaccaaccuccccaauaccaacucugacaauggccagugcuauuauucaaggccaacagacaucuguguauaaccacuuauuggccuauguucuaaguaaauugaucaucuguaaagaacguauuuuagcagagacuguaaucucagauacaaucugagauacagauacugcaugaguuuauuacagauucuguauuaguccauucucgcaaugcuauaaagaaucuaccugagauuggguaauuuauaaacaaagaaaguuuaauugacucacuguuccacauaacuggggaguccuaaggaaacuuacaaucacggcagaaaggaaagcagacaccuucuucacaagguggcaggagagaguaaauucgagcacaggaaacaacugccacuuuuaacaccaucagauugagacucacucacuaucacgagaacagcaugggggaaaccgcgcucauaauccaauuaccucccucccucgacacguggaaauuacaauucaagauaagauuuguuuggggacacagagccaaaccauaucagaugcauaaucaucuaguacuugcugguuauuguuuauuuuaugucaaauuagaugaagccuaagucuuugaaguauguugcaaaguuaagccgcaaagaugcugaaaguuuacaaauuauaaagcaagaccuauaauauucuauuugaaggugcauauuauugaaguucugaaacaaucuuguuauaacacuacauuucuuaaaaacaaacaauuggcauggaacccaggaagucacaaauguaauaagaaugaaagauacauuuuaaaacaauccuuggacuuguuggcagcuuauaaaugcauaccucucuaauaaaaacuaugugagauaaugaauauauuaguguucugauuuuaguaaucaguuuacucuguauaucaaaauauuauauuguacaccuuacauuuauaggaugaaaaauaaguuaaaugagagaauaaaccucagucgcuaucucaauguauuaacaauccaaauaauugaaaucuuauuaaaguaagcaaacuuuugaaacaguagaacauaguaaugccaaggggaaauucuuaagaauaugagucauauuaccuuuauucacauuaaaaaauaacuacaaauauauuguaaauguuggguuacaguuauacucucaaaaauguuaugugaaacuauguaaagauuggaaacaauauuauucguuuucuuuaaagucagcgauugauaugguuuggcucugugaacccacccaaaucucaucuugaauuguaacccucuuaauccccaagugccaagggugaaaccugguugggggugacuggaucauagggaugguuccccuaugcuguucaaaugauagugagugaauucucacaagaucugguuguuuccuaaguguggggauccucccgcuucaugcucuucucucucaucugccaccauguaagacgugccuuugcuuccccuuugccuucugccaugauuguaaguugucugaggccuccccagccaugcagaacugugagucaauuacaccucuucccuuuaucaauuacccagucucugguauuccuuuauagcagugugaaaacaaacuaacacagcaauaaacaauacacuuugaaauaaagguuauuuagaaaauugccucuucaaaaugcuugcuguuucaauaacauacauauguguuaaauuaucaaaguuauuuuuauuagcaaaauucucuaagcuaaauauaauugaauuaucacaaacuuuaauacugaccuaaauucuuuuuaaaaaaauuauuaagaggcagagucucacucuugucucagcuggcugaaaugcaguggugcaaucauuauucacuguagcuuugaacuccggggcucacgcaauccuuccaccucagccucuccaguagcuaggacuacaguacagacacacaccaccacacuuggcuaguuuuuaaauauuucuuuguagagagaaagucuugcuauguuguucaggcuggucucaaacuucuggccucaagcaauccucuugccucggccucccaaagugcugggauaauacgcaugagccaccacgcccggcccgacugccuauauuucuaaccagugaaaauuucuuuucuauuugcugauagacaauuaagcgggauaauuuacucuuucaaaauuuucuuuucauuacacguuuaacagaagacuaauuccaaaaccacuaaauaucuccucaucaaagugacuuccaaacuuggccaauguuggaauugugagguuguccucuuuuucuuggaacagucuuuuccugcuguuugcuuggcuuuuucuuuagguuuuagcuaaaauguuauaacagaaagaguuuccuuaaucacucacugaugaccuuaccuguggacuaauuggaaugauucaauaauuuuaauuucuauguugucauaccuauucaauaaaagagaacuuuaagguaaauuauuaagauagauaaaauauuauaaaauggacagugcaaauaauuuugaaauuaagaaagcauaaguaggauaugugacuucauagaagcauagaauuaaauggcaauuuuuaaacuaaaauguagaaaacugaauguguuauguggaagcugauaaaguggauaauaaagaaaauaacuggaagauacuuuuaguuccaggucuagaagauuaaucuuucaaaaacaugcugaugcucaaugcauguuucugaguagucccucuuuacccauuucuuagggagcaguugacacaguacaacuccaggaaggaaaugcuugaguagcuagcaugguuugucuuuagcgccaccacuugagacuuugucauuugaaaauccauauguggaaacaaacacagcaugagagauccucugaauacuguaauuauacacauauaaaugaacaaauagcagaucuaaaagcuuuuuuugaaaaaaaggcccuauugaugccaauuugauaaaagaaacaaugucauuuuuauuugcaauauucugaaaucucucuuugaaaguagauacaugauucuaauugugccaacaacacauuuuaaauuccaaaaauugauacgugggugauuauaugcucuguaaaacgaaaaugccucagauuauugcauauaauaauuaccuauuuuaucacaauaugaagacuacucaaauugcaguaacauuuuucuaauauacuuugggcaaagaguagauaauaaauuaaaauuuaaaaauguuuuauuucacacugagcaaauaaguauaaacuaucuuuuaaaauaacuguaguuguccuauuacuuuuaaacaacagucccuuuaaauauuucuguuucauuuuugguuuugacucauacagauauguaaguuuuaaggcaguuuuuuuuucuguaauaccaagauuacuuacagacacacuuguuugcaacuaacauuauauuacaauuauaauacuucuuaguaugaugcuuuuagcuaucaaaacacaacaauguauauuuguugcuauaaccuagcuauaagcacuuuaagaaacaauuuguauacagagcuaacccauuucaauuccauuuucaauuguauuuauuuaacacugguuguguaccuagaaauauuuggguaauuuggaggacauaaguaaauauaaaucacaguguuuuaaggaauguguuugucuucaagguauuaguuggcuaucuauaaaaguaguagcgacuaagucuuaaauuauauuuaauuagauucuauauuugucuucaaguauuuuacggcaguagaauauuggguaaauauuaagcuuuuauuugagaagcccaacuagaacuacuggcuggaauuuaugggaguguaaaucuguaucaaugcaaggaaggacuugacaaaaguaagaacuguauaaagauggaaccagugagcuuuaaaaugcuugagcauccuuauacuuugaauauuacagcacagagguauuugggcuaauuucauguaaugguauaaugcaaccaguacaguaccuaauaugaugaaacauguuuacuaaagucuaguuccuuuaauacaaccauucccuaauaccuaucagccuaagggaaaaaauacaggcucugcucaugcagauuguggacuaauagaaaagagaguaauguguuuuuaguaggcaucacugcagggaucauugugaagaauauaaaauuugaaacaggcuucgcuagacuggccaacuuugaaaugguucagaaguguguacuaaguugcaaagguaaggaugaagacggaguuuaaaauauaaacaaauagaauagaaguaacuauuuuuauacuuauaaaauuauauuuuugucauauuaaaaguggaaaugaaauucauugacauuucauaacaacuucaacaauaucaacgcaucugcuggauuauuacacacuaaauauauauaguuaucaaguuuuucagaagcuacagcuaucauuuagaagauuuggugacaucuuaaguacucuauuuaaaguacuuguuagaugcaauaauuauuuuguugacacgucuuuaauuugcaugcagauaacaaauaauucuucagauaauagcuuguggaaaggacagucaggcuuggguuuaaaggcacgugaucacccauguggcuuaagaaaagcagagaaaaucuuuuaaaauaaaauccgguagaaaaaggguugcagaaguuguaagcuuucacagcaugguuucaaauuucccuuaugauagauacacauuuacuuauaaaaugaggaaaauauuugugguuuauucuuugaaaauauauuucucgccuuccuucuguugucgauacuaugggguaauuucucacuuuaauaucagauaauuggaggugguuuucauuauuugugaucacuguguuccuuauaaguucagaaaccaaagaauuugccugcugcgucuuaguauuucaccugugauuagagcaaauugccacagggagguguugauacaucagucugcuccaagauucugaggcuuggaccguaaaugaguuuccucuaaaacagcauagauaaaacaggaaaaaugaaaggaggggacaaaauguaacaagguauaagagaaauaugauucgaaacagcauguuguguuagagaaacugcaaagaucucaguauggucgguuagauuauagggugcaaauguuggguuaggaggagacuaaauuuaagagacagggaagaacuagagaaaugcaguacuauaacaagauuuguguuuugggaaaguauuucuggcauagauauagaugauaagcuagagggggaagauuagaauccgggagacauaccaggaggcuacuaaauuaaugccuggagggaaaugcugaaaaucuuaacuauagaagcugugauaggaauggagagcagcggauggauacaagaaauauuuaagcauuaggacuggcaaauauuuuaaagacaaauauuuucccacugccaugaaagcaaaggaaaaaguuauuuucucaacagcacucucaagaaaagcuucauggauuagcuauuguaugaaaugaauacucaaaacugugcuuauagauuaaacaauuaccaucuuuuaacuuuaguaauagcaaucauauuuacaguuuucgauacagacuucaacauuuccugagaacugauuuaaagacagcuuuuauguauaccugacaaagcauuuuaagaaauauuuuacauagcuuuaaauaaauguuuucacuacaugacuauuacauguauuucaauaguacucaaaugauagaacuacacugcaaaaguaccuuauugugaagaagaacaaaaaugacauauauauuaugauuuaaugugcuaccauugaaagagcugcauuccucucuuuauuucaaauauauuucuuuauuuuuuaccaauguaauuuuuaagucuccagaacauaugacagugucaucaaggaauaaguaaacaaaaagauagaaacauuaugccaauaggcuuuuuccuuuauauacaagcaaucaagccuuaaaauguugccuagauguaagcugaaacuucuuaguuagagaacuugaacacagagacagcacuucacucucagccagcuaugccacagugaagagcacuggaccuggaaauaggccaagcugguggcccagggaaguuacuucuccaugugucucugauuuuuucauuugcaaacugaagcauuguuauaagaaauaaaugaccuaguacacauaaagaguagugccugauuugaaaggcugggaagaaacauuuaauaagaagucaacacaacaaauauuagcuauuuacguaauacaagcagaacguuuuauaaguauaauauguacugcugccuggaguucuagaaaaggacacucauugauugaugcugaaaauguaaauuguuacagaauuuguggaacucaaucaggcaacauuuauuagccaaaaacuaaacaucuucuuugaucaagcaucccugucuuuggaaucaauuccacaaaaauaacccccucaguaucuagaauauuggaauaagguuguuuuuguuuauguucuuaaugguagaagcaauguuaauaccccaccacggcacauuuuuaucucugacacgguacuauuuuugucaacugacacaauaaaauaguuauucuuuuuuuuuuuuuuuuuuuuuuuuuggagacggagucucgcucugcucugucacccaggcuggagugcaguggcgcgaucucggcucacugcaagcuccgccuccuggguucacgccauucuccugccuuagccuuccaaguagcugggacuacaggcgcccgccacaacgcccggcuaauuuuuuguauuuuuaguagagaugggguuucaccguguuagccaggauguucucgaucuccugaccucgugauccgccugucucagccucccaaagugcugggauuacaggcgugagccaccgcaccuggccaaaauaguuauucuuaauucuguacuguggacauacaaaaacacaauuaacuaugcuacuauuuccuuuuaacuagucauaacuuaauaacuuaaaugcuuacguuaagauauauaaauaaaacuuacauauacuacagaagugcaugaggcaugauuaaauuucauuuuuggaaauuucauuacugccauugaaaaucucuucuacuauaaguuaagcauucguuuuaacauauucuuuagggaugaggacauuaaccaagugacuuaaaucauaaguauacuuuauuagcugaaaaacugcuggugguggcaauauauauaacuugaguaaaaaaguaaaguuuuauauugaauaccaaaucucaugggauuauacguggcugucuggcauauuguguggagaaagauucuauggccacauucaaauccacugaguaaaauaccaugagaauuaguaacauuaguauugauggcagcaucgaacucauuguguuauuguugcuaugaauacauagaaaaaaacacccgaaucauguuuucuucaguugguuggcauuaaaaacacuaagcuaguauaauaguuucauaaucugaaaaccugauagucauauuuuauaguccagacauauuuuuauuugaaccaaaaaauguuucaaauaugcuacguaacaauuuacauuuuaaguuagaauuuauuagcaauuaaguaauuuaaugcaucauaggccauuauuuaacacguacuuaauaaauuuuuaaaaauaagacccauaaaauaugcuauaauuucacuaugugacauaauuaggcugaaauuuuuucauguaguucuguuuauaaauuuuugaccaaugucugaaaaagacauauauauauagacagucuguacuuauguuacuuaauaauuugguucccauuaagaggugacugcuuagaaaaaaucaguuaacagugauaaaauuuaauccacauguguuuucuguuaguucaaaauaacuacuucagucuaugauauagaagugacaauaagcacuuuuuuuuuuaaauuuuacuuuaaguucugggauacaugugcagaacgugaagguuuguuacacagguauacaugugccauggugguuugcugcacccaucaacccguuaucuacauuagguauuucuccuaaugcuaucccuccccuagcccuccaccccucaacaggcccgggugugugauguuccccucccugugcugagguguucucauuauucaacucccacuuaugagugagaacaugcaacguuugguuuuguguuccuguguuaguuugcugacaacgaugguuuccagcuucauccguguccaugcaaagaaaugaacucguccuuuuuuauggcugcauaguauuccaugguguguacuugucacauuuucuuuguccagucuauuacugaugggcauuuggguugguuucaagccuuuucuauuaaaaauagaagcaccuuuaauuuuaagacaauuuucuuagaguuauuauuuuauuuggcauaucaugguauuucaccacuuaacagacuguuuuuuuaacaauacaaacugugccuauuauuuuuuucauguauuccuuucaaauaauacuauaauugaacagcauagaugacauuauaacaguaaauaaaaauugugaguccaggcaagauuuuccuuuucacauacuauuucaauaugacaucuaaugcauagaggugaacaaauccuuccugaauuuaacuaaacuuuauguaacuugauuccaucuuagauguuccagacaacacagguuuaguaauuuugacagugcguaugccagucacaccucuauugccugccauuuucuaugauucacauuuccagaucaccaucccagugcagaugaagaagguugugaauguacuagaaaagguaaggaaaaacuuauauauguuuggggaauuuuuccugguaaaaguauucucagaaucuaauuucaccucuuuccuaaacauaaaaacauuaaagcauauaucacuauuuauguuuaugaggguauuucaagcaaaccuaaaucacaagguaaauacagaauacggcccccaggagcuccucuguauuuuuucaacauuuuuacaguauacccaaaauaugugaucuucagcaagcaaauucagagccaacaaccacaucuuuauaucuagauuuccuacuaucaggggaggcuuuaaaaucugcagugucauaaaaaaucaguuacuucaagcuguuauuaugaauagcuaccuccaaagugaacuaaagaagaguuuaagaagauauuuuucaaaacuuacaauugaagaaagaaucaauuuuguuuucuaagugcaaaugcuuuguuggaaagaauaauuggcuuaaaacauuuaaccuucaggauuuuacagaaggaucaugauguaacagccaacuaaaggcauauauaauuuacuaaauaguuacauggacaggaugaaauuggauguguacuggcuaaaguuuguaaauaggcuguauuuuaaauggcaauguuauuuaccacagauaaagaaacgguauucuaagcaucucuguaaaauaauaccacggauagcacuggguaggaauaugaaugaaugaaugaaugaaugggagaguuuggaaguccuaaccagaguaacaccaaaucuucaacucaauaucaauggaaaaaccaagucuuauucuuuacuaguuucuaaacuaugcagaaauuauuucauguucauuuaguuuaauaucaaucuuauuuuuggcaauuucaauauauuugugguuuuacugaguacagucaaucucagucccuucucugaguucuagauuagaaaauaacucacagagaggaaauaacauucuuuauauaaguauugcugauacaaaagaauaaggcuuaaaugugugauacagugggauucauuaaccuuauuucuaaaauuaaacagagucucaagccauaggaagaaccgaacaccauaaggcucuucgcgcuaucacuauuagugcagaggcaaagccuacuuuuaucuaucguucagcagaaucuauucuuucugcaggcagccuggaaggagaaaggaggggcugagcuaagcacaucuagguccuuuucccauagucaccaaacagauaaguaacucuaccuaacauaggaaggaacgaaugaacuguagacauagacucuaagagugugauagacggacauuucuucccauaaaaugaacuguuaggauggagaaagaggaagcaccuccacauuccaacauccuuaucugcucagaacuaaaacauauagcuucuacagagcccaggagaugggaaaauccaguguuuuagugaaucacucuguuacaaguauuauuuucaaggcuuucauuugaaaauuaacagcuguauauaaaugauugcaucauuauucuuacuuauuaaaauggcaaaaauaagcauauaauuuauuucagcagcccaauacugguuguagaaauauaccuuauguuucugauaacuacuuaucuuaaaauaugugucucucuagaaacagguaacagccaguuucagauacugguacagauauaaauauaaaaauuuauuuuauuucacacaacacugguuuugaggcuuaaaauuacuauauacgcuguuuuauaacuuugcaaguaguaaaaaaugauaaaguaaagcacuucacaaaucaggacuagagaugggaaaaucuuuaaaguacauguuuuauuucuucaucccacugacaucaaucacuaaacagacaacuugcacaaguuggaucuccauauguuuaauauuuuaaagaaaagcacauuugaauuaagaauuucugagccuagauucucuccugauucuguauaccauuuacaacaaauacaaaaaucuacuuuuuaaaaacagaugacauguguagacaugucacauuucuucucuuucaaucauaaaaaagauucacaagacuaaaaauuagccgggcaugguggugggcgccuguagucccagcuacucgggaggcugaggcaggagaauggcgugaacccaggaggcggagcuugcagugaacugagaucgggccacugcacuccagccugggcgacagagcaagacuccgucucaaaaaaaaaaaaaaaaaaaaaaaaaaaggaagcuuuauguaaacuuuaagacauuugaguaaguuuuugucuagaagaauuuacuaauaaggaacagugaauuaaaucucaaagaaauuauagaacuugaaagguuuucccacuuaaaauagacaaaaaacauauaucaucaugcauuuccuaacaauaaggauauauuuugagaaauguauccuuaggcaauuuugucuuugugccaacaucauagaguacacacucacaaaccuagacaguguagccuacuacacacauagcauagacuauuugguauggguuguugcuucugggcuacaaaccuguacugcauguuauuacacugaauacuauaggcaauuauaacacaaugccucuuuguguaucucaucauacuuaaacauggaaaagauacaguaaaaauauaauauacaagaugaaaaauggcacaccuauauaugacagcuccauuauaauuuuauggaaccaccaacauacacgugguccaucauugaacugaaaugucauuauggggcacauaacuguaagauuuaaaauaugauaugcaccaaacaacuuugauaucaucuaaaaugauacguuguagguuuauaacugcauaaagguuaauaagaccuaaauuaaauuuguggauuaauuuuuuugcccaauuuugccauauauugaugguaaagaguaaaauuugaacaaugauucuuacuuccugaauauccgugccuauaauaaaaucgagauuauacauuucucuccaauuaguuaauaauuauuaguugcauuaagcaaauaaugugcuaugcuuuaucaaccaaugaauuuugcuugccuaaagcuccuuuuaaguuuaaauuguuuucauuaagacaaguucauuauuauguucaaggucucuauaaaccagcaguauuugcuuuuauaugcauuuacauauuuuacauuuaaaauacaccauuuugggagaaguauaugaauugaggaagagaaaauagacuaauauacuauugcuuaauauuguugcguuaguuacuuaaaauaauugcacuggaaaaagaccuuucuauaaacuuguaaacaacuuaaauuccuugaaugguguuuuagaaaauauauaaauauacacauuuuuacauauaauacuuaauauaugugcuauauuaaauauguaucuauguacuuuauaacauguauucaaauguuuuuauaaaacauaugaacaaauacauauauauuuauacacauauauauucauguguguguauauauacacguauaaaaucguauuuguuagagaauaugugaauuaauucaaaacacauuucccaaauguguuggucaaugaaauuauagguuaauaguucuacuaaaugauguaaauuggccuuuaugagagaucauuuauuuaagugaaaauucaguuaacucuaaaaagugaauuuauuaagcgcuagcuuaaucuccucaucauuuagaacugcaccaucaaggucuuuauaauauguucaaauaaaugcaacucccuaagagugaaauauuuucuuuaaacuucccacgugugucccguguaucuacauuuacaggaagggaagauacacgauuuguuacaucagcucagcagcaguucauuuucgcuaucugcaaagaaauuagauuauauuuuuacauaaccauagugaugagcuuuguuuucaaguuuauucuagucugcuuguacaacacauaguauuaacaguuuuuauaugucugucgacagagaaaaagaaauaagucauaagcaaauacauauuugaaaugcaguuguugugaaauaaacaucuucugucccucauauuaaaaagguauuuaggaacagaaaguuuuagcauacucaucacauuuuaaaaauguguaccaaagaaaaaugauaguuuuagauuuucaugcuacuuuuugucuugugaugaccucuccugguugaguugcucauuaucuuagauucauguaguuuccaucuuuuucuccuuugaauguuuuauauuaagaauauaacuaucauacuuuucuucagagcuauauauaauguaaauaaaaauguucauuaauguaaaguacaguugauauuuaaaguacugaauccaugaaacucauucuaaucaauaaaguucuguagcauccuuauuauuuaauucauuuccaggauauagggcaacuuugcauuuuggucacacaguuuaaauucaaacgaaauaaaaagccaccuuaauuaagccauuacacauuuuuaaacaauagagaaugaaagccaaguuaauaaaaaaucuuaauggccauaacuauuaaccaucuuaaaaguaauuguuucuauguucucugucuucaaauucuaacuauaaaguugaaaacucagaaaauauuuaugaaauaacaacuuuuuuaucuuaaaaugcauuaacccaagggcugccaguguuccauuugcuacucauggcagauguuucagauggacccaucaaaauuaaaguauacagaaugauggaacacagaacccaggaaaaacccuggauaugaggaccuucaaucagugaauauaauaaauuuaauauaugaggaguuuauuuuccaggaaaaguggcaggaaauucuauacaaccagaccuugaaauggaaacagaaauuucaucaaacuaguuucccagugauagaguuacauauuuguguaaauaucaacagcaagcauuauauccccaaaauuuguuuaaauuuauaaaauugacauaaauauuaacaauauuuaacucuuugugauuuaacuuguguuauaaaaaaugcuauacaauguuuucaaguucauuacaaacuuagauugccaguuaguuuaucuccuuaucuuuacacauugugggaaaagaaaagcuaauacuguacuuaggaagauaugucaaaacaguaauacuggcucauaaccggauauuauauaguagauuccuuauuacaacuuauaauguccuuuuucaaugcuauuccuguugauauuuaccacuacaauaagaucauuauuaacaaagaugcauuaauacaucccaaaaucuuagaaacaaagacuacuucgcauaugacgaauucuggaaaauauuaaacuuuucuuuuccuaaauggacaaaaaaaucuuccuuuuaaacucugaaaucuccacgauaauucuuuaucaacuuacucauucucagaaacuaguaugcgcuuaugaauauuauccuaagauuccuauaggcagucuuucuaguguuuaacucuuucugaaccaaaggaacaaucaugcauuuccucucuacaugcacaguaugcacuucuaaaggaaugcagaaaaugggccagaaucuuccauuucuuucuaaaccucaugaaaacaggggcagucuuaaacacacacacacacaaacacacacacacaguugauuaaaaugcagagauauacauauugaauauaauuauuuuccugaaaacccuauuaagaaucuguuuauuacuacauuaacgacgcuuugcacugagugucccaaguaccguacugcaucagucauauccaugauaucaaaguaucaaagaauuaaagcaauuucaguuacaauuucgcugccuuccauuuuaauaagcaaguacuaaaugggcauuaacuuuuuaagggaacgggagagguuaaagagacccuauaggugcccaaacuguuuaaaacaugcuccucuuguuaaccucaaccccgugcucauuaaguuauaaccauaaauaaaaauaagaaacuugguuuugccauggucuucacuuuucauucacugaccuaccuaagccaaaugcaguuaacucucccugcacaaacaacuccuaagaagcugccaucuacaucagucucucuagccaagcucuugccaaccgaucaccaagaccaggaacaacuuuccagaaacaucaccagcgucacaacccugucucuuccaaaacagaaacgcuggguuucgaguuugucuacugcaguggcugcaagugugugacagcggagacacaaacacaucagggugccagcacugcgaugcacuucggaguugauacccuggugccaaacaucaaugccgcacugaaacugcuccagagcagagcgaggagacggcuacuuacgggacguggagggagccguccaggcucugcagaggcagcugcugacaauccacagcaggagcgcugccccgcagccggcgcgcggagccgccugcauccuucgccucccggccggcggcgcuccaagagcucgcugcggagaugcaguccgacucuccguaggguucuugaagggagaugggcuguccucaaauacgcgaggaagccaagccccucccgcuuccucuucuccccucaccccccuccaggcuccaguucuuccgggcuuggagcggcaggggagucucagccuucguucucccuccgugcggguauugccucuugcacugugugccagugcaacgccgggggaggaaauucaaaccaagaaggcaaaggagggggaagaggggagggaacggacaccuaccccgcccucuccuucuugaaaaaaaaaaaucaccaaaggacgggggagggagguaaucagaagagcagaggcugcagaagaggaaggcagagcgacggggacgguggugcagcuguugccacugcgggcgagcgcucccuccgccgccgggcagcgugacucgagggguuuccacucgccugucagcucacauggagagcuugu

SEQ ID NO: 191604 - RNA, 76978 nt, Homo sapiens
gauucaacaaggacaaguucaaguauucuuuauucaaaguugaaaaauguaccauacugcauuauugcaaaaauucacugguacaaaacacuuugcagcuggugagaaggcaauaaaaaguugauuuuuaaacucauuacuauaaauuauucuuacaguacuuugcaaauucagaauuucaaacugcauguucuuuuucuaaauugcccacaguacucgagguuccugaagcuaaggcagcuguuucagaggaggggggaggagguagcagaugucaagggauuuccauuucucuuucgaugccgacauacuucagggcaucagccuggcuguaucugaaacaacaggaaggagauguccgcuggauggccacccauccaacaugugcugagacuuaacacaacaaagccugcugaagauagugggugcauuaaaaugucuuuaaaaaaaaaaaaaaaaaaaaaacccauccaauuacacagcugccugcauaacggcacauucauagaaggcaaugcauaggucuguguugcuggccaucuaauugagacgcugccaaguucugaagugaacaaaccugucuacaagcauucccagagccugaccagccuccccuaugccucugaagcaaguggucccaggaaggcugguccacaucaggaugcuuaggccugacgcugggaaggcaaaauagaaccauggucuggaaaaaaugaugaccauagcaaagagggccaaagagcagcccgccaguugcucccccaggugaagcaagaacuggagugcagcggacacccagagaggagcacaagaagcccaccauggggggugaggccaccgggucaucccaaggaagcuccaccccacacucuucauucagagccagccuggagugaaggcagcggccuuugcuaaagugggcccuucacucagacccugucugccucacugagagcucgcugcugugcaacagccauuaaaggccagccugaauaugcaagaacacaguacucaaagacagcuucuggaugggauguacacggggcuacaggaguucauuaacuagacagucaucugacugcacuuaaaucuguauucaauggcugacuuaaauguaucccacagagcuugacagugucaacuggcagccuaaugccuaaccacacagauaccauugguggcccacgugucccaggcauccccacagggugaucagacagcgauuugccaacagccccuuuuaaaaugguaaugauauguguaauaaguauuauagcaaacaauaaauuaaguagaucuaauccauaaagauaugcauaguauauugucaaguaaaaccauguugcagaaaaaucuauaggacagugugaucgcacuuaucuggaaaacgcuccacgagugagcaugcagcaugcggcaugauaugagaaggucuaggacucacccagcugucaacagcagggugagaaauggggcuuucugcauggauuuuacucuauuuuaaaaauaagcaugccuuguauaauauauaaauggauaauaaauacauaacaggaaaguguaaccuaauuccccacuaaugcucauggcaaagugacccaucaaaagaagcaaagaacuaaaaacccuccuuuguccagaguucacaauccaguagaaaaagcccuuagagaucaugcuagaaauguacuuuaccaaccuguaaucaaaaaacagcucuucgccagucuggauggcucucuuggcaaaaauaccuauccugugaucaccguuaaccaucauaacugcaaagagacacacuggugucagugagcaugaagacgggccacgggggguuaacugacuuguucacauaacaaacaacuaucccagaaguauucaaguccaucaucacaggacugaaaagggaguuccaauucucacgucaaagguaccuaccuuuugcauagcaguuuggauuuaccgaaugauuugcaaaacgaauuuuguuacccuugcggguugcauccaccacaaaaucuaaaaagaaaaaaguaagcacagcccagugaauaauuucaguuauaaguaaaccaaguuauuaugauuuuguaaaugcaacugguuacaguucuucaggguuugccugcaaaagcaaauaaaucaagcagcuucauucaguaagaaaugacauuuggaagaacacacuauuguuccagguuaaaauuaaucaccuauaauucaagaugguuaucugacucaaaagcuauuaauuaucaacuauaaacauacauuacugagcaaaacauagcaaaaaaaaaaaaaaaucugacaaaauucuuccaaacaucacgaauaggcauuuucacauuuaaaauuaguuuuuuucauuauaaugucuauaaagcauucauagaaaaaaaccuauucuacuuguuccaacuaagaguuucucugaauaucuuacauguuaagccuaccuccauuuucacauaaucccaccagaaacaucccuacacagccuuacauucuaccccagaacaucagcuaugaaagcagcugccuuuccucucaguccuuugagaauauccaggggagucuggaagaugguugcaaaugcagugcuccuccccuccuuccccgcucagaggcacugacuggaggaggugugcugagcugccugaacacaagaggugaggugagcagcaagagcacaacguccccuucacagccagaugcugggauagugccacccacagacagccgggacuccagagaggcgguuuccugcacaucuagucuaucugcucccugaggaauuccuugcuccaguuccuuucaagcaagcagccccccaugccucuaaggagauccuccuucuggucaccucacugaccucuacccucguuucugaacacucggccggcagaaggcugccacaugcaacucaggaacucacugccucccagcucugaaacauaccauuguucaaguugaacagaaagcugcacauguauuuaucauacacuuucccucuucugucagcuucaucuugagaaauaaucuaaaaagaaagacacaggagaaaauucuuuuggauaaaggugaucaagccugacagaacacacaaaagcgcacagagugaauacuggaccuucuggagaaaacgcaacaaaaagggucacuacagccaaguucucuuucccauucggucugcgcaguaauaaagaauaacuguauacuaaggaccccaacucagaaauauuuccacauccugaaguaauuauccuuggagaaagugaggaaccaaagucuuuuugcugaguuuuuuaaaaaagccggcugcaguggcucacgccuguaaucccagcacuuugggaggccgaggcgggcagaucaccugggcgcgguggcgcaugccuguaaucccagcuacucgggacacugaggcaggagaaucgcuugaacccgggaggcugagguugcggugagccaaaaucacgccauugcacuccggccugggcaacaagagcgaaacucugucucaaaaaaaaaaaaaaaaaaaaaaaaaauuugggugagcugguuccaaacugaagcuaggccuaugauuuuucgguaacacugucgacaauuuaaaaggugaauaacuaaugacguuguuguuucuagguccuuaucaacuagguuguggauuaagcaggccacucuaugguaaagcucuuguucucccuguugucccuagacgagaaaaacuaaauguggcuagaaccaagcaauccuguuuuguuuugcuuuuuuuccccucugagacagggucucacuuugucgcccaggccggagugcaguggcacaaacauggcucacugcagccucaaccucccaggcucuuccaggcucaagcgaucuuccugccucagcucccaaguagcugggacuacaaguaugcaccaccacgcccggcuaauuuuugcauuuuuuguagcaauggggucuugccauguugcccaugcuggucuccaacuccugagcucaagcaauccaccugccucggccucccaaagugcugggauugcaggagucggccaccgcgcccagcacaauccaguuacuaagcaugcaaauccacaaacaugcagaaguccaggcugaaaaggcaguuuauggcaauucauuuccaaucaaacccacagacuuaccuaauaaaaucaaucuaaaauaaaguaaaguuaguauauacaaugccaccugaauacagguuaucagugccuuaccucuccacaguauucugagaugaauucauuuuucugcacaggaucuuugauaaaaaucccccagccugccacgucagauggugccagcaauagaugcuagagaauaaaacacaaucacaucaucaaaaaaggagggugaaaauggacuggggacaaaguagacuacagaaugaaaacaaaagcuaucacuguaaauccucagaccuguuuguucuaaggcaguaauugggcacacagcuucagucaacgugaaagcugcugagaauggcuaugaacauuauguuuuccuuauacagcagauaagaaucucugucuuacagaaaaccuuuuggugguguugguccucugcaaugaccaucguucagcaaggugcucuaggccugcugcacuuuuggcuucccuguaucuucagcccuugauuuccucgaguaauucacuuucaaccugaauuuaauauaaggacaccaccaaaucacucuuccucuccauaccuuucccucuacuuuccccaagugauucuauuaauaguuauuccauuuucagccccaggacacccccugauucuucacuggcguugguucccucugaagcccauagcagcuuggcuuuggauuuguucuuccaccccaccuccucaggauaacacaagaaacuaccgggagguguuaucaugaucuugucaguccaguagucuauuuucagcagaaaugccaagaugaucauugcuauaaauuauguauuuagggauguguuccccaacauaugccaauuuuucaucacggcucaguauuaugcuuucauccaaaauuuucuugugaccuuuacaaaggcuuccuaucuauuccuauucuggaccaucuuaccacucaccugucaugugaacuucccaaauagccuucugaucagaaacuaaauuagcuaaauacugcuaugcaaaugaaacccaacugguaaaagguaucuacauaguuuaacauuuuuaagaguuaaaaaaugucuuacaaagaggacaugucaguaugaauagaauugcccacuuucugaacaaagugaggaaggaguacaaugguaaguuguuugggggggaaauugagauuuuuaggucugagcagguaugccaucggaaacggaaccagagucacugugauccaaugaccuaaauggacauauaacugccuagaguaaaaucaucuaaaugucuaacagaaaagaaaaaagucaaagcuaaaaacaaaaagcccaccacccugcacaacucucugccauaaacacagacuuugguucaaagacacaaacaaaaccaagagaacuucaauguuuugccuggagcagaauuucugguagaaggggacuugcugguaagaaguguguucucaauuauaaauaaaugguccaacaacaaagauaugucuacucuacaccccacauacacacacacacacacacacacacacacacacagagcauaagagcagguuaaugggagccuggaggauuugaucuccugcuccuuuacaagucuugugacuuuggguuuccuuacccguaaaauggggguuaacacuuacuccucacucacaggguuaggagaaucaaugaacaaauccacuaaagcacucacaacagugccuauuuuuacaugcuuaauaaaugucagcuauuauuauaaaaagaacugacugaagaaagaacuuaucaucugcccuaaaaaaaaaaaaaagauacgaaauuucccaaauacaugcugcugaagugucuuuugcucaaucauuacuuccuggcugauagaguuaacucaccuacauacaauuccccagacuaaaaauauauaguuccuagcuggguuuuuuucaagguuauuaaacaaacaggaaguaagucuauaaaaaccugccaugggaaauuucaucuuuuacucuacauagcaaggaaucuauaaauacucuuugaugagaaugagucuauauuuugauagaaaucaccauuuauuugcauuaaggauacuagauaaacuauuaacuaaaagacaaauucaaauaaucuauuaaacagguagaaaaaauaccucuuauuccuaaaucugauaccaugaauggcuacuucucagaauuugcugguuucuccuacuaucagaguauggugcucuauauaaaacugaagagacugcccaagggugcauuacccagagaaaauuaugaacacuuucucaucaguugcaccuuucaaggaucacuuuuacuuuuugccccagcuaaaucaucuaaggcaauccugacauuugcaucacuaaauagcuaacuacaaacaaucuuccagaagugacuuguugcucaccuuuuuggagccccgcugaauacugcaguucuugcaggacacauuuuuacugucccaauggucagcggcuccacaaguaagacagaggucagggucacacucucggacagccagguagcacgggcacugcuugguguugcacugugcuuugcagcggcaucccggaaagcgguuuugaccuucagagagagguuuggagguucuucacucaucaccguaugcaaaaacuugcagaaagauacguggcaagggcuguacugggcaucucacugacucucaacccucacaaccaccuuauuacccuacuauauagacaaggaaauggaaguauuaacagcgaaguuauagcuguuugcacugaaaaagaccaccacugaguuguuuuuccauuuuucauuuguuaaauaguguauauauuuaaagucggugugaauaaagggucuggauggaacaauauccaugguccuugaccauuccaauagccccuaguucuaaacacucccuuaauacccaagcuucaugugcagucucauuaaacaauuauaaaaaucuacuauguuuaugcuacauuccuuuaaucugaagacuaaaacccuccuaacucugacgauuucuggugcccaaaaauuauuuggguagcuccuucuagauuccucuuacaaucugugccaacuuuaauacaacuuaauuuaaaugaucaaagaagaaaaaaauaaaauucagguuccuuuaauacaacuuugccugccucacacacacagacacacaacacccaggcgacugacuggccacuggcacagggccagguauggggcucaauaaauacuugucaaauugaugaguuucgucaaguaaacaagggagugcucccauguucuuauuuuugauuuuuuaaauugcuaaccaaagaccuauuuaguucucaugcaauugcaucaaagcaacaaauacuuacacucugaacuacauugacaaaacuuuucacaaaaauuuugugcuaucacacaagggcacgaacugucacaaggcugccguggaugaucacaggguugauaguuguaaacaugguuagaggagccgucugaguaaagauaacaucaugcaggccaaugaauccagggagauggaaacgaucauacacaauuaacacgaguacauucuucccuacuaccuguggaguguagcuggccugccuuuacugaaugcauaacauuacacauauuccgguuuccacaacgauggcaaaaaauacucucccacccccaagugcuuaugaguuccaucuaaagcacggcuacaucucagucccaucccaaagcacuucuccuucaacugacucggacucacaccuuccagucagccuccacuuuacagaagagaauugacuggggauucaucaguagacguccuccauucaaauugguuuaacauacagaaggcaauuauauuagaauaacccaagcucuaauccaguuacuauucuaaaacaaaugaaaacaaagcagauauuguuaagcuaauaaugagaggaauggaaagaugcuaacccuuuuucagcuguaucuuucugcagugugcagcccacaaccugcaaaaacacaaagaaaauuaaaccaaauuucugcgggaagcuacaaauccaacagagagcugcuuaacuggaucuaucugugccaugaauacaggaaugcguuaaagccaagagucaugcccugcccaguuuauauuugccaucaguuugaagcaacucaaacagcuugauggcucaggcugccccagguguggcaagacgucauuuccuguguucauccaugacuccuggucagaacuccugagcucccaaugcugcacaaagcagcaggugugucugccuguugauuuauucugauguggaugacacugaucacuuccucuuauuucaggcaucauaaaccaagcaagugaacuacguggucagaaauaauucaaccaaaauuucagaagcaucuccuaaagccuaaaaaauaaaaauaaaaacuugacuuuaaaaaaauucuaaauuggguuggcccuacacuuauuuuuguuaaaguaagaaaauguaacaugagccuguacacaauuuaagaagcauaaucuaacugcacccuuaccuacccaauuagguuucucauuuuuaaaaaugugagguagagguauggggagauuagagcagauaguccacucaucaauuuuucugguucuacauuuacaaaucaaaucagccugaaaacauucgcuaaggugaaaauaacauucacacaagcuuaaaguaggguacccauuaggaguaucggaaugcaaugccacacaacuuagaaauucaagcuccuggaauaaaagauacuucuaaaaacuggcccagagcucacaucagaaacacagaacauuucaugauguuaaaguaauuguuuacguaaccuuuacugcaaaagcuacuaaauauguuuuucuuaacccaaaugcagucugguaaccguaauuuuuaugacucuuaacauaccaaauauacugaaggcugcuguauucuuauagaaaaauacuagcaauucccaguggaaauaagauuccauaguucuguuuuugauggcaguuuaagguuuuuuaaaaauagacuaaguagaaaccaacaacagcccuuaggaagggccuugccugcagugucuaucuauguugacuucucuaaggagcuucaugacagacucaccgguguuuccucuucuuuuuccuuggaggaguauccacauccucagcgggagcuggagcuaugaugcuagauucuuugacucuaaacucauacaccugacaagaggcacagucacagagccaugaggacagucuuauuuaggcaaaccauucuuauacucaugcauaccagaaaaaugucuuugucucuucugugacacugcuagaugcuggggauauaacacacaucgcugucccuacccucacauuagggguagcuguaauuauauucuggucaagaacugugaugcuaaauuucaauucuuacuagcuuuuaaaagcuacugcuaucuaaccuuaaaagucuacauuggggaaauucuguaacauaccuggagaauaauuuucauucaauucccucuugggaagaaaaaaaaauuauuuuuaggagaugaauaggagcuuaguaauaaccaagaauuuucuuuguuuggacaacgaguacaguuuuaucucuauguuugaagcucuuuuaacaacauuuuuaucggauaucuuaccugucuacauguuuuggucccaauuaaccuagcaauggcacagaaauugucauaguaagugccaaugaggacucuaaacauugaggcuucagcaccacuccacuccacauucucaggagguucaauauuuggcuucaucuuuauugguguuugacaccgagaauuugcuucuacaaaaccaaauguaagcacuggucaagaaaugauuggaaauaauauuaagaaguacaauucagggugugcuuaagaaaaaagcgaaaagaugaggacaacucaaauccaaucggcaaaacacuaacccaucguaguucacauuuuccaacaaaacuacucacagaacgucaagaauauuaaaccaaaugauccaaauuucauuauucccuaccugagaaagaucgaaaaaagaaaauggcacaaagaaugagaauaaagugcaucaucagcuuucaaacaaccaagcagggcaaacaccacaagcuaggguacgggugcaggcaggaaacagaaacaacacagcuacacauucuugagauaacucuggucuuuauacugaaacuaaccaacuaagaaaauuauucaaugcauuauacauccuuaauccucacaacacgaacuuucacagaacaguaaaacccaguuauuagacgugucuuaccagaggagcucgaaguuucaucuuucuucucuucuucuucuuuaucauuguucucuccccccguuucagucccugcuucccuaucacugucuguauccuuugauuccagcacauuaauggugggggugcugggccugcuacuguuauugggaagccguccucuucugcggccuccuggacguuuugguggggucuuuauccgcucagcggugagagcagcagcaaacuccuuugcucccuccuacgaaaugaaaaaugucaacaucagggcaaaguucuaaaacucauuuugauggaagagaaaaaaaaauacuauauaagccagguuagucaaaaaauguaucacauuauccauuuaucacaaauaaucauuugcaugucuaauauacuuguuuugauaugcuuuugauagucugaaaauuucagaaagagaaauauggguucuauauauuccuagaaugguacaaaaaucaggcaagacaguucuauauugugaauuuguaaaauauauuagcuaguuauaauuaaguuaaaauauaagaagauaaaguaugaaauauacuucauguaauaaagguaauuaucucuauggacauacagucuauuuaaaagugaaucuuuacaaaagaaucauauaccuaaugugcacggagucagacuaccuaugcagaguuuaagauaaugcauaccucuucguguuaauauuucaacuauacaagaacacaaaacacaaacaugcuugacuuugucacuuccugucuuacuauuaaaacauccaacauuuuuuuuuuuccugugaaggauacacagccacaggaagacaugaaaggaacuucaggaauaagacugugaggguuacaucuugcauuaugaaguacaauaauccagucucaaaguauaaaacaaugguaagagcaugguuuauagagaccacagaaacauuuuagaugagccaaacaaaauucugccuuguaaagaauauuauaaaacaagugcucaagaauuccauuuuuuuaguggaaauagaagggagaaguuugacagcagccaacaguuuuauacuucauucuacaaaaaccaaauugcuuaaaaauaggauaccuucugcaggugccauucaaugaaucuucuguccaaaauccaacaggcaauauauacccauuuaguuccuagguaggaguggcuugguucaaagaggggaaaugguaaaaauaagagaguacccguaaaaacaacuuuucuaccucauauuuuccuaaccccuuaccuguucuccaucauuuaaaaaaaaaaaaucuguggaaccuaucacauagcugaaaugacagugcaucuaaaacucaaguagagggauauggcuaugagaggggcuugggaucuacugcguaugauuacugcaugccugcuuucuaagcggacuaucugugccuugcaacucucauagacuuuguggaaggcauaaaaguccuugauccuaaagaccuugaaauguugcugaagagauaacacagauuuuaaaaagaauaauaccacauuaaugaaggacuaaaaugugcaguacaugagcuauggaagaaacagcaugggugagaaagcucugucuaucauauggcccauaacagcaugggugcagacaacauuaacgcugacuugaucaccuccaccaaagugcaaaguccucucaaguacccucugcaauaauuaggcacuaagucuuaccaaaugcugguaacacugugguccacaagguuuguugucuagagcuguuucuguguucuuccgcuuauaaguguuggguguugcaugaaaagcugcaaaauaaaugaaacaaagaaucuaauauaacuauaaaauacuuacuuuuucacucuuccaguuccacuggaaaagucaauuaauggauuauaaucuugcuaauaugugguuuacguuacuucauacaacuuuccuucaggcucuuacugaaugaucacaacguauucuccauuccuccuccuccaaccauuaagcaggaaggaaaaacaguaaauucuggaaugagucgugauuucucauuuuucuccuugcaaguaaaacugaugcgcauaacuaugguuauaaacauuuacuuaaauugaaucuuacuaucucugucuaagcaguugauagacccucuacaauuaaaucagauuuccuauuuuuaauucugacauacaauuucuugauuucuaaagaaaggucagcaaucagcuugucaccaguuguaaaaacucauuuuuaaugauaaagaggacagccccagauuacuaacauucaauuccugugaaucauacccaauccaagaaccuggugagagcuuauagugucuugccacagaaaauuacaaugucaaaaaaacggauuuuagaaagauacacuguuugaaaccuaaaauuccaaaauaauguaacagaaagauucaaaugcggguacacugcuacaugaaaagagugugaacauugacagcagugcuaacuucacagaauuucuugcaaaaacuuacuuccucauauacaaaagggaaaugcuggaaauggacuauucagaauuauacaagaugaaaauuaauuuggagaaaaacaagugacauuuccacaaaacaaaucaucuuuuaaauauuuguaaaaagccauauuuaaagacugagaaaaggaaggaaaaaaaaaaaaaaggacaaaguuguguuuuuaaagaagaaaaauucaaggcucagauucuguuggaagcgugugagcaauuaggcuccagacagccuaacaccaauacuaaucuggugcuggauuacguuuguuaaggaacccuaauacaacuguuuuucuguuuaugaguuaaacuaacauuguagcugguucucugaagaaaaaaauacauaauuuaaaauacaaaaaccacuucuuaacaaaaaagugacaaugaaauauauagagaacaagaauauuaacaaaaauaaaacgaacauuagagaacacauaaacuucauacaaauaaaucucaaaaccuggauguaaagaauaauuuucuaaaacucauccagaagagacagaacauuuaucucuaucuaccagcacuacuaauuuuuaaacuguacugaaacuacaagcuaaaguagguagaaaagacaguuacagcucuuuuagaauuugucuagcaggcuuucugguuuuuaucagaaagccuccccacuccccucccccgcccaaccaaaaaauaaauaaauaaaguagguagaaaagagaaagaagcuucaguuauaaagacuggauagaagguaaaaccauuaauaacuacagacaguauaauuacacagcuggaaaacuccuaagaauguacugagaaacugauaaaacaugaagacaaugcaguaagguagcaggguacaaaacagaagacaaaauguggaaaaagcccaacagcagcagcaaguuuaauaccuagaaauacucaacaaaaaauguacaagagucacauaaagaaaacuugggagauaauuaaaggacacaaaaagagaggugaugguaugguuaguuagacuuaacccuuauauuuuaaaaagaaauuagguaauuuauaaauuuaaugggauuccaauaaacauaccacuaauuuuuuuuaaaaagaacuagacaaacagauuuugaaauguauauaggcugggugcaguggcucacgccuguaauuccagcacuuugggagcccaaaguaggagcaucacuugaggccaggaguuuaagaccagccugggcaacauagugagacccuaucucaaaaaaagaaaaagaaaacuaaccagcaaugguggugcaugcuuguagucccagcuacgcaggaagcugagauaggagaagagcuugagcucaggaagucaagguugcagugagccaugauugugccacugcaccacucuggccugggugacagagcaagacccuguguauguauguauguguguauguauauauaucucucucucuaaauaaauaaauuuauauagaaaaacaagaauugccaggagaucucugaauaccgccucaugaauagacuaaaggaacacaauguugagaaacccaaauacauauggcaacaggcaaugaaggaaauaucucaagguagugaaagaugaacuuuucaguaaaugaaacaacuaggcaacuuuggaagugaggaggaggaucagauuuauaauccacaucauauuaaauuccaaauggaucaaagauuuauguuuuuaaaaaugaagccuaaaacauacuagaaaaagugagaaacgcuuuauaaucuuggaaugggaaagcuaacugauaaauucaacuacuuuuuaaaaaauguuuaaacugaccaggugcaguggcucacaccuguaaucucagcacuuucagaggcugaggcgggcagaucacuugaggucaggaguuugagaccggccuggccaacauggcaaaaccacaucucuacuaaaaauagaaaaauuagcuggaugugguagcacaugccuguagucccagcuacuccagaggcugaggcacaagaaucccuugaacccaggaggcaaaggcugcaaugagccaagaucacaccauugcacuccagccugagcgacagagcaagacugucucaaaaaaaaaaaaaaguuuaaacuuugcuuaugggacuuuuaccaaauaaacuugaaaaaaauugcaacucauauuucaaaaaaccuaauuuccugauuauauaaaaagcuccuaagacaucaaaaagaucuaugagaccaagaauaaaaauaggccaggcgcaguggcucacaccaguaauccuagcacugugagaggcugagguggguggauuaccuaaggucaggaguuugagaccagccuggccaacauggugaaacccuguuucuacuaaaaauaaaaauaugagccaggugagguggugcgcgccuguaaucccagcuacucagaaggcugaggcaggagaaucacuugaauccaggaggcagaggucgccgugagccaagacugcaccacugcacuccagccugggcgacagagcgagacccgucucacaaaaucaaaaaaacaaagaauaaaaauaguucacucuucaacauauaggaagauccuacccucauucaaaggaauuaaauccagauauuaaaacaaugcuuaucaccugugggaagcagagauuaaaaaacaaagaaaaacaagaauuuaaaaauaaugcuaaaagccauuuuucacuuauaaaaucaauuuuaaaaauuaguuugguaacaccuucuaugggcagggcucucugacuuugcugguagggcuuuaaagugcugcauccccauauggcaggucauuuggcaauaccuaaauagaguuuaucagguaaacuuaaacuugcaugaaauggguacagauauuugcuguggcaucguuacagcauaaggcucaaaauaauccaaauggucaccauuagagaccaguccaguaaguucuggaaccuccuacagcacaggcuaugcagcuauacagauaaagcuaauagcuacaauauuaaauccuauccuuauuccaaaaaaagggaaaagccugaaugcuaugccaccauguaaauaagacggucagaaaaaaggguaucuuuauacuugucaaagaaacuguaaaaaaaauacgagaaccaauaaaagugguuaacuacuaauaaaaguggaagagugagguaaaauuucgaaggauggggaacagaaagucauugggagacuuuauuguacacauuuucauacuuuuuuuuuuuuuuuaagagauggggucucacucugucacccagcuggaguacaguggcaugaucauagcucacugcagccucaaacuuuugggcucaagcaguccucccaccucugccucccaaagcacuggcauuaaaaggaugagccaccgcgcccagcacaucuucauauuaauacuuuuuggaaacguaaaccaugugaaugaugaccuauuuuaaaaacaacaauagcuaacaagagccagguaccauuuuaaguaucuuccccacauuaauucaucuaauccucacaacagcucuguaaaggaaguacuaccguauccccaagauaagagaccagaaaacuaaagcacaaaaugcuauauucaacauaaaaucgaccaggcgugguagcucacaccuguagucccaacacuuugggaggccagggcagguggaucacuugaggucaggaguucaagaccagccuggccaacauggugaaaccccaucucuacuaaaaauacaaaaauuagcuggacgugguggcgggcgccuguaaucccagcuacucaggaggcugagacaggagaauccuuugaauccagcaggcggagguugcagcgagcugaaaucacaccacugcacuucagacugagcaacagaacgagacuucgucucaaaaaaaaaaaaaaacaacaacaacaacaaaaaagaaacagucaugugcugcauaccaucugagucaaugauggaccgcauauacaacagugguaccauaagauaauauuguauuuuuacuguauauuuucuauguuuauuaugauuuaaacauacaaauacuugccaaugugucacaacugccuccaguauccaguacaguggcaugcugcagggauauguggccuaggugugucaugcgcuguaccaucuagguuuguguaaguacacucuguguuuacauaaugccaaaaucaccuaacaacacauuucucagaaugcaucuccguccauaaguaaugcaugauuauauauauuuaaugauuuauuuaguaacuuauuuuaccuaagaaaaauauaccaugugugguauuuugucgaaguuaacguaaaacaaugaaguuccuacagaacucaauaggacugaaugaugaagacacuggcucuacuguaaaaagaaguaaaagugggccuagcacaguuggacccauggccaccaaaugcuacaaggaggcagccaauuagccccaugaaagccaacuuuauuaaaguaaaauauuccacuguucuccccagcuagaaugagguaaguaacagguucaagauucaaguuaacaaaaaaaaaaauuacucaucucugaauggcacaauaaaaaacuuguaauguuuaaaaguaguguccuacuucuaugguucauuuuuacagcaaaaaaacuuuauuaaaugcuacaucuauaaacaacaaauuggaaggaccuuucagcgacuccaaaauagugcuuccacucaauucuuuugcuauagugauaucuacauacaauguccaauagucuuaauaaaaacucgauguaauucauaaauucaugguguguaaagggaaauuaaaaugaaauucaagacaacuauuucaagggcuuaacuguccaauggcugaagcaacaaauggaugacuuacuacgaauuuuuaaaacuaccaaaucaauuuaaacuagaugaggaguuagaacaagagcaaggagguaacaauauaaugauaauucuaaaaaucuacuucaaguuuuucuauuuuaagauaacuaaaccacuaauaugucacacacaaaaacaaaacuuaacauuuccagaccaauguauuacaucacucaacacauuauuagcugcagcaaaaacaaguagagcaaacacuuaggaggaggugagguacagcugcuugggcaagcuuaaaaagacguuaucauuggugaacgaggaggaauaaaucugucaaugguaggcacaggaacucaaaacaacaaagcaauguggggccguugaguacaggggaaaacgauuuuacaaugggucaaagccccuaaagaaauuaccaugccauagacagacguacuaaaauacaauauaggaaaaaccaaacuauaauaagcaaacuacucuaggaaaauuaggaaguauuaaauacauuuucaaaauaugugccucaaaaguaguugacgcuuuuaaacugugcuuagaaguuucaauuaccaggaaaauuuacuaagaaaccacauucccuagaaaugccagaggaaaaaaguauuuuuguauauaccauacuuacauuuucacuaagaacauuuuacguuuuacuuguauucaaaugcagguauuuuuaaaaaacaacuuacccagagggcaaaaaaauaaaauaaaauaaaauaaaauuacauuaaaucgacaagcacuuaccugaacauuuuuuuggccaauuucuuauuuaacacaauuuauucaucaauaucagcaauguugcucugggcuaccaguucauaauaauaguuuuauuguaaaacaacugcuuaguuagcacuuacgggggaaaaaaaaaaaaaucacugaccugaauuccauguuaguggaaaauaguaguccaaaugaaauacaugcaaaagauuucagagcaauccucaagcaacaaaguaaaaauaauaauacugagaucuaaagauauuugucaaaguaacuacaagauuaaaugauaaauucuaguuguaauaaaugauagcacucuccaagcugcuuuaaaacauaauuccacaacaaagauagaaaaugaaaacguacaauaauugcacuuacgauguaggaagcagucauauuuaaaacaucgccuacagaaaagcguaugaaaggaguguaagcuuugcucucucugaacagauuuagcauuugguccaucuauguuggggguacauucaggaggaagugcgccugggagcugcuguucggugaguucuuuauaucugacauuaaccaagaaaaauuuaaguaaacaugaaacaaaaaucacuuuuuugaaaacaguuucuaaaagguuuccauguguuacuuuugauguuuaucuugccuaaaacauaaaggaauggcucuauuuagauaaagagccaacuaaauauugugcaugguguuaucaagaaucaaauucaucgauaugauucaaauauaucauggaaaaggauauuauauuaguuuuaacuaaacaucaaauuucuaccaguauccagauaauuuuccuguaaauguacuacuguaaauuuuauguauauguguguguuuauguguauauauaaauuauacauauguauuuauucuaucuacaggaaauauuuuguaaugcagaguaccacaaguacacauguugcuucaaguaucuugcaaacacuguaaacaaaguguaguggcucauccgcuacauugauuccauuuguaauaaaccaaaauggugaguuacauaccauacagggcaagauugccucaaaggaacaaauucuuacuuuuccuuuaguucuucugcugugcccuuaucuggaaacauugaggaaauggcuucaaaaauuuuaucagaaggaaauuuccgaggugggcggcuuucuuuaucuaaacaggagaauaugaaaggaaaaaaagaauggaaguaaacaaguuuuugaucuuucauuuucucuacccaauuaugucucuauaacaaagcugauuuucuaagaaaucaucucuauuuuguguuuuacuuacuucucacauacuuuacaugucuguggaaugccagucagucaaaaacaaaauucaaauucaaauaugaaaagcuuuaagagcacugggaagcagaaaaccuagguucuacucccagcucugcuacuaacugauuuugugacuuagagugaucacuuuaccucuugggucuguuuacucaucuguaaaaugaaggagcugaacuagaugaucaauaaggucaauaagguaccuuuuuguuauuuucucuuuuuugaaauacgcuucuuagaaauugcuauuucacccgccaaauuauucuauucuaugcugccuuagcaugagcuuugccaaguagagaacaccaacuauugacucuguuucuucccaauaguguaaucuuauaaguuacuuaaccucucuaaaucuauccccucaaauagaaaauggaucugacagguggggcgcaguggcucacgccuguaauccuagcacuuugggaggccgaggcagguggaucacgaggucaggagauagagaccauccuggcuaacacggugaaaccccgucucuacuaaaaaauacaaaaaauuagcugggugugguggcaggugccuauagucccagcuacucgggaggcugaggcaggagaauggcgugaacccaggaggcgaagcuugcaguaagcugagauggggccacuguacucuagccugggcgacagagcgagacuccgucucgaaaaagaaaauggaucugauaauaacauccaucucaugaagccauuaugaggauuaagugagcuggugcauaagaagugauuaguacacaacuuguacacggugaauaucaauguuauauauuauaaugaugcccagugaagcacacaaaaaauuacguucuuugcuagccaaaggaaacaaagauacucaagugaagauaauguugcaaguauuaugcuuuuuuuuuucuuuuuuaaggcaaggucucacucugucacccagccagacugugcaguggcacaaucacagcucaaugcagccuacaccuccugggcucaagcaaucacccugucucauuuuuuuacuuuuuaguagagauggggucucacuauguugcccagguuggucuugaacuccugggcucaagcaaucugcccaccuuagccucccaagugcuaggauuacagaguuagccacccuaccuggccauaauauguuaauuuugauuauacugcuaucaaugugauauuuaacaaagaaagaaaaagagaaagaagaaacuaagcccuauuucuacucuuucuacuguuuuugaaagaaagcuguaauggcuacacagaauccuaauaaucaggcauaccaucucggugauccuccagaucuuucugcuuuucuucucuuucuucaggaucgucuccaucaucaucaucgucaucaucauuauauugaccaagggcauucaccaacuccacaaaaauuucaucauuuauaaacccacauucugaaacgcaucaaaugucagaaacacacaggagaagcaauaaugucaaaaguuuauguauccuuuuucuacuuggacaaaacaggcauagccuaguaacuggcacuaaaacauuauuauugaaaugaggggaggaaaagauaagaucauuuucaggacugguguuaggcaaaggaagcaaacuuaucuuuaauaccugcuacuuucuguagaauggccccuccccaaaacuuucuaguagaaaacugaaucuucuaggaacugauuguggcuuuggccuccucccaaacaauggaucuguccuuuaacugaucauuucagacccugcuuucugcugauaaugacaauggaugaugauauuacaaauauuauccuuucagacacuuuaacagggccuccuggacacaaaaaacugaaaccaugacucuaaggauugaauuucagguacuguagucccuagaggagcgguauuuuuuaguaguaggggcuguuggagccccuauaugccacagaagcagagccccaauccuaauuaauuuuacuacuaaagaaucuuaaaaucuacauacacucaaguucuauuuaauuuacauguuauugccauuauguuauaaccaacuaugcauaauuaucagguggcaaacaugauccuccuaacuaauuuucccaaaaauaguuagggaaaauacugaaaaucuuaggccugggcccagguucagucccuuauaguucagugcaaaacuuaauuuuaauauuaaaauuuuucucaugcccuauaugcuucauaaacaaaagugucucucaauucuuuagccccuuuuuccaagagaagaagcauauggcucaccucuauccccguguacuuucccaucauaauuuuuuauuaguucuucaaugaaaguaccauccugaucuaaaacuucaucucccauauaaggaauguuauguaaaacaguuucaucuuccaccuaaaagaaaaaaauauauuuaaaaagcagguuuacucuaaguaucaaaugugaaauaacuaaaauacaaccuuuuuuucauguguacaugucuuuacccaguucuccagauuuaaaauacuagucagagagcaaacucuaaaauuuaucaaaaaauaaaagaccccucucaccaauaagcauaucugagaaaacuguugacagaaaaaaaauuuaauucuagaaaaaauaaugcacuuagucugucaucaaucauuaaaacuuaccaccauuauuguacauaccucuaagaaagaaaaagaugcucuagauuaugagaagacaucgucuguuuuucuguuuuuguuuuuuaauugagacgagugucucacuaugcugcccaggcuggucucgaacuccugagcucaagugauccacccgccuuggcucccaaagugcugggauaacaggugucugacaccaugagccaccaugcccagccaucaucaguuuuaacgcgcacuuuagauguuaauagaggaugaugaaauaugguguaucaagaucaacuauaaagacccauaccaaaaaacuacccuaagacucccaaacuccacuugaugauccaguuauuaaaacagccauuaacuuguaauaguuuaagguaaaaugaaaaaaaaauguaagacauccaauauaauaaaauucuagggauacagaguauugauaguccauuaaaguuuaugccaaaaggauauguacuuauauguaaaauaagaacauucuacaaaaacauaaaauauuucaauauuuagaugaaugagaugaauaucaaaguugacagugcuaguaaagaugauagaugaguuuuuaucaagcuuuggaagacaacagagaagaaagaagaauagccaaucaaacaaaaguuaagacagaauagaauaguuaagcauacaagguaaagaaaguugacauucauaggaggaagagcauuuucaaugaagaauaaaaaugacagcaguuauagauaaagacuggacaguucugaaguacauguuuaaagagacuaauuccaagugaagacaagucuaagucuuaagaggccuuugaaaagaguauugguugaaaacagaauuuuagaaagauaauuauaauaagcagaauggacuggcuaugccugacugggaggacacagaagcucuuuaaagggugagauggcguaggcucggcccagcacuaugaucauggcccacagguaagaacacgcugggaaaggccacacacaggacuaguagcagccagggaauguggaaaaaaucucaaauaaucccuagguaacaaauuuaggacaacuggagaguucauaaagauaacaaguaccguagacagacaaggaaaagaaaaagugggauaaaaggagcauauaauuaaaaugcagguuuuaauguauucauauauucaaauucaagcuuauguacacacuagaggccuguuuucaucucauuucacuugcacuaaucucauuuaaacuagggguugauuucuuucuaucuaagccaaaaucaagugacacuuagauauuuugucuuuucaaucauauccacaucauccugcucuccaaaacguaucuuaguuacaauaaagauugugugccuaaucugcuuuggucagcaaaaucagacagggucuggcucugucacccaggcuagaccagcaaaauccaugggugauucauaaauuaaugacaaauuuaaauaauauauucuuccagaauuucagucugugaaaacaugaaacuucccucaaggucaugcaauguaauucucaaacuacacucaaauuuauacaacuacagaagaguaacugaaguugagacucuacuguacaaaguauaaaaguuacuaaaaacuuccccaaagcagguucaccaaggacuucuaucaacauuuuauuagccuucccacuuuauauaucaauuaaguaauacaacuauauauuuuuuauuuagcaauacaagucaagaacacaugcuucaguuucucuuuagcauuuuauuacaaaagcugcugcgucagaguuagcaauggaacuauguuucagcucauguuucacaagcccuaugaauuuuacaccauaauguacauuaucacaauaaaaugcuaccuaaaguuguuuuaaauaauaaguucucaauuaacaaaaacucaaagucagacuuagauuacaggacacugacuuuuuuaaggauaagaacuauaagcuucauuccuuuuguuuuuuucagacagggucuggcugucacccaagcuagaguacaauggcacaaucucagcucacuacaaccuccgccucccucaagccauccuuccaccucagccuccugaguagcuugggacuacagacaugcgccacacccagcuaacuuuuguuuugaggacacagcguuuugccauauugcccagguggaucuccaauucccagacucaaguaauccaucugccucagccucccaaagugcugggauuacaggcaugagccacaaugcccagcccaucuuuuaaauauuuuuaauccuagguaugguuacugcuuaacacuuuuccuuuggagaguauaggaaaagaguaauacugcacaggccuuaaaaaaacuaccuuaaucaauuuuuaaaaauuacuucaaguguuauuuugauagcuuuuuagaauuuauacugucuugauucaccuugacaauaaaauuaucuaugcuuuuuuacuucaaauaaguuauuaucaaauaagcagaagauaucuuauuuacauaccauaaaauucugcuguaggggagaccaagaauacauuauggguacugaagcaacugcauucagagucuuuaaugggaugacuuguguuggaaaauccaagucacuggucaccgaacacuaaaacagaaaaaauaaaauugacucuuaagaauaaaaggacaaccuuaagcuguagccaucauauuguaaagagaugcugccuacccaaauauuuaauuuugaaaaaaaaguccuuaccuaggacaguaaaguggucauauaaaccaaauaggauucucucuuuucuuuuacuuagggugcaaaaaugcuucaaauuuuccaaauuuucaaaaccuccaacccuucccauacuuaccaauaucaguaagaaucaaaaacuguacuuauaugagauucagcgaucugauuaacuccuccaugcuuuuccuauacauuuauuuccuagcucauccuucauuucucuuacauuccaaccacacagaauaguaauauguauaccaaauaagccacuuaaaucuuacuuaauaagaauaagaaaacuugggccgggcgcgguggcucacgccuguaaucccagcacuuugggaggccgagacgggcggaucacgaggucaggagaucgagaccauccuggcuaacacggugaaaccccgucucuacuaaaaauacaaaaauuagccaggcaugguggcgcgcgccuguagucccagcuacacgggaggcugaggcaggagaauggcgugaacccgggaggcggagcuugcagugagucgagaucgcgccacugcacuccagccugggcgacagagcgaaacuccgucucaaaaaaaaaaaaaauaaaauaaaauaaaauaaaaagaauaagaaaacuuguucaguuaaucuuccuuaucuuccuuuuuuaaaaucuaagugucaauugcugauauuaucagaugauacauaaauauuaaggguaauggguuuguguuucaaucacaacaaaguaaauuuaagucuauucugcaaaacuguaaucucugaauuaauaauauuagcugauuacuaaguacuuucuaugugcuaggcuauuuuaaacacauuacaugucuucuauuuaauccucauuacaacacuguaagauggguacuacucuuagcccccauuuuacaggugagaaaacuauagaaaagaaaggauaaguagcuugcccaaaguugcgcaugguucucgggcuagaauguaaacuccaaaagccugacucuggagccccugcucuucccgcuccuuauauugccaugauaccauauugcuaaaaugugucagugcacauagucccuugaaacaccauauuucauacaaucuaugaugacagcgauuucaagguacaucauuaucuucuguaucacuaagaaaaaaugcugccaacuaaacaaagguauaauccauucuuaucacagugauucuaagaugcauguuguuuccaauguuaaaaugugaaaaauuuugcaucuuugauucucugaaauaugguauaacucugugccuaaauaaccacagcacuuuccacccugucuacgaauccgagauuccuuaaagaguacuacugcccagguguaaguccuccagagccuucucaaaaauauccuagacauacauucauaauccacaaucaaugaaaauagagcaaaaaagaaguguaguaaaaugaaacugaaaaaucauuauauauauauauauacacacacacacacacacacacacacacacauauuaaauguuuaaauuuuuuauuuaaaaugucuuaaaaauagcagaacuaguuguggugaaauucagaguagaaaucuggcauaugggccacaccugacccucagcauuggguugcaucaggccagugggauaaucucucaaucaucacagucacugcagcacaaaaauaauuccuuccuuaguggaaguaaagguuuaaggauggaguaguuaggaagaacugugacagugauucaucuauuaauuugcuuuccaaaaaggcaaagauaaagguaauaauacuaauaaggcucuuaacucgaguaaacaagaaggugugaacaguuuacuaacacuccagagcccacaaucuuuccccuuccugcuauuuggccucugauacaauccuucauccauccauccaauaauccaauaaaaacagcaguuaacauuuauugagcacguacuauguugcaggcacugugcuaagugcuuguauauauuaucuuaauuauuccucauuacaaccuuaugguguaguuuuagcaucaaaacuucacaaaugaggacacugagguucagagaaguuauacaauuugucuagucagaaagguagcaaauuacaaaaccaggauuaaaaccuggauuuaaagucugacugcaacacccgugagcuuaauuaauuacugcacuguaguucuugcccuugcaaugcucaugggguaaaauaacaauuacagccaugcaguauuuacuauauaaaacagagacauggcugggcacaguggcucaagcguauaaucucagcacuuuggcaggccaagacgggcagaucgcuugagcccagaaguucaagaccagccugggcaacauggggaaacccugucucuacuaaaaacacacaaaaaauuagcccagcaagguagcacgugccuguagucccagcuacuugaggggcugaggugggaggaucacuugagccugggaggcaaaggcugcaguaaguugugaucagcaccacugcacuccagccugggugacgacgggagaccccgccucaaaaaaaaaaaaaaaaagaaaauagagacauaauguaauaggagcaucuccuccaacaacaacuuauuaauacuaccaagucuucuuuccuucuuucuacuuaacuggguaaauuuggggguggaggugcuuauaauuaccgaauauacugaauauaauuacugauacugauaguaucaaauacuauccagugacuuaaaguacaaaacaauuuucauuucuuaaaaaaaaaaaauuccgauuuuuuuaacauuuggcaggaauaaauuaauucuguggcuucugaaggaagaagugcuuugaaagcuuaauggggagugggcugccucuccgacugacuuauucaccugcuuuaacaccuaacuccaaagucgcacauaaggguuagagaaugaguuuucaacuaugacaaagaaggagcauuggcuuugcuucaucuaugguugcucuagugauacagcaaauacucugcaaauucugaaugaagucagcugauuuuucccauuaacagaaagaacuuauggaagcacagaaaauauuaaggcacaggcugcagcacuacguacuacuuccagucccauaccucugucauaccccaguaucccaucgccucaguucugagucaugcgagagucacuaagagacaagaaauaagcucucugagggcaaaagcagcugagccaaguguggcuucaccucugucuugaaacgauacucagcacagugucucaaaaaaacaguaggcacucaaaaaauguuucuggaaugaacagacuacacuugaugauuuucucuaauggagacuucaauuucuguuucaagcuaagagagcaccuauuuagaaaacugauggucuacccccaccucacuguauuucuaguaucuagaaaccuaucccauucuuuacuauuaaccguaacuaacaaccauauuccuuucauuuaugaaauauucaaaugcaaaagcauuuguuggugaaaacaaacgugggauucuuauuuauugacuuacagaaaaauuacucaaaaaucccaguuacuuaccagcaacuuauuuuucuuugaaaauguaucauccuugacaguuuacauaauuaagucucaugucacucagaguagugaaaagaauuuuuaccucaugggucuccacauuucaccuggucagagccauguguccuggacucaggaacuuacuaggagaccuuuaucaacaaauuagauucucuaauuccaguuccaacuugaggaucacacaaggaaguuagagaugauucaucaucaaugguuuaaaaaaaaaggggaugggggggacuagaaucauuaccaaggaugcuacauuuucagagaaacacagcuuacugguaaguaaccagguuccucugaggauggauagacuuacaucaaccagcugguacaauaggcgacuguguggcuggaccacugggagcuggagagggaagucaagccaaaaauaguaguuguaggaguacacaaccaaacugagacucuuggcagaaggcugguuccaaguaaaaacuguguuauggaaaaucguagagggaagagcaggugaauggccugcagggaagggaaagaaauuaacacacccuacuaugugccaagcacugugcuagagacuuuaccaaaguuagcuucuuuaaauuucacaacuacccugugagguagguaugacuccccauuuuacaguggacaucccaaagacaacagccauggccguccugccucugaauaaucuuuaacaugagaaaggcuaaguccaacuuccauauaguaggggaaaacauacaaucaauuagccaaguaaaaaauauucucagauacugguugguccauuuauuucaugccagagacauaguaaacuguugacauugucuaacauccuguagccuuuccaugugacaacagcgaggaaggugcaggaaggucggcacuccaggaaaggaagagucagaagaaagcaucagcugucaccaagucuagagaaaagcugggggugauuucugaaacuacccuauauucugcaggacuugaggaaagaaaagauaacacgcccaaguuuuaaauuagcuagcccuucuggugaaaaugaccguguauauaauuuaaguucaggcuacuuuuaugcaaaguaaguacugaagaaaaacugcaaugagauaaauagcaaauuuggauaaaguaaagagaagcucaauaauggaagugaauucauaaucagguugagaaggcaaaauaggagaagggagauugaagacgacacuugaaaagaaaugagucgcuccaacaggagagaggcagaaacaaaaacggaagaaaaaaccccauuaagauauugacacagauguauuuaaugaaagcaacuaaucaaguguuggaguuaagaaaugaaaaagaguaauucauaucagauuguaaauuauuucaguuuguguuguucaguauuuguuacagaccaauuccacauugggugaagaaccucuacccuacaacacaaggguauuugcuucucaguucacuuuuauccuguaauuaacgguuucuacauuccaaggggcggggaaugauaacacagcauuuaacauaggacauuuggaauacaguaucgggaaguuuagacuccuuuuuuuuuuuuuuuuuuuuuugagacagggucuagcucuuguugccaagguuagagugcaguggugcaaucauggcucacugcagccucaaacuccugggcucaaaugauuaucucaccucagccucccgaguagcugggacuacaaguacgugucaccacaucuggcuaauuuuuuuauuuuuuauugagaugggaucucacuauguugcucaggcugggaggaaauuuagauccuuaaagcucuuccccgcauccuaccuucagaagccgggcccugaaugaaaggaaucacaaacaugcaaaccuacuuaauccuagguuaaaauccugaagggcuguuaagguaaaucauucccucaucugcagcuuugcggaaaaacuccaguuuugcuaaguacuggagaucagaaacagaauaaucaucacagguaguaagcacucaaaaaaguacaugaagcagguaacaagagugauguucauccaccacauguaaauucaaauuucuaauucaauaacaguccugugaguagaaaaaagaacaauuucugucauugggggaaaaaucaacuaaaauggaacagagaguauuauauaaaucuauaguuuauauaggcuguggcaguaaaauuguuuugaagccuugcuuaaaucaguggaucuggguuuaauacuacaaaguaguagagguucaagugagugggcaagaccaggcgcaguggcucaggccuguaaucccagcacuuugggaggccaaggugggcggaucacuugaggucaggaguucaagaccagccuagccaacauggugaaacccugucuuuacuaaaauacaaaaauuagccaggugugguggugcaugccuguagucccagcugcucuggaggccaaggcacaagaauagcuugaacccaggaggcagagguugaggugagacaagaugacgccacugcacuccagcauggguaauagagcaaaacucugucaaauaaggaaggaaggaaggaaggaaggaaggaaggaaggaaggaaggaaggaaggaaagugagugagcaagauggcacaggcugugguuucugaagggaaacacuucaggucuugcucgagugguagaacugcccaggaaaccaccaaccaagaaggcugauucugcugaucuucaaaaacaaguuuacaacugccccucacuauucauuaauuacucaguaaauaguguugaaacaaccaggaaacuaaaaagaacaaaauuaaaaaccaaauccccuacccauucuuuacaccaaaggaaauuccugauggguuaaaugauauuagaauauaaaaaugaaaacagagaacuaaaggaaagauagguagauaauuuauaaucuugaagugaagaaagacuuuuggaaccuuuaagaaagacaaaaauuaaaagaaaaaacuguauaaccaagauauaucagaaauaacaucaaaauggggggggggcaaucugcaaaacauaugacaaaaaaaacuauuuuuuuuuguuuuuuguuuuuuugagauugagucuugugaucucggcucacugaaaccucugccuccuggguucaaggcauucuccugccucagccucccaaguagcugggacuacaggcgcacaccaccaugcccagcuaauuuuuuuguauuuuuaguaaagaugggcuuucaccauguuggucaggguggucuagaauuccugaucucaaaaggucugcccaccuuggccucccaaagugcugggauuacaggcgugagccacugcacccagccaaaacuaguauuuguaauauacaaaaaguccuuaugaaucauaagaaaagcccaaccuaauugcacaagauccaacacuguaacagccaauucacaaauauaaacaaacaguaacugacauuuaacuucacugaauaauuaagacacgguauaaccaauucuaacaauguuuuaccuauuggacugaagauuaagauugauaauauuguguugagaauauagguaaacagacauuccauaaacagcugguggggguguaauguaaaacuuuugagggugcauuugguaauaucugcuaaauuuuuaaacaugcauaucaucuugaucuaauaauucuauuuguaggaacuucuacagaauuacucaaaagaugcaaggauguauauaaaguucaguacagcacugauugcaaaaguaaaaauuaaaaaucuaaauguccaucaagaauggggcaauaaauuaugguauauccauaaugucaaacacuacauauuuuuuaaaagaaugaaaauuuggacagagguuguaaagugauggcccaaaauggaaaggauguauaucuggccaauaauuuuuaaaaauaaaauauuauuaaccuccuaguauauauagaaaaugaaaucugaaagaauaaaagccagagcaguuggacuacagggacuuuugcuuucuguuuuaccuauuucuguguuaucuaaauuuuuacaauaaucauuuuacaaugaucuguucaguggagagaaaaagauaaaacuuuuaaacuaguuucauuagcccaacagguagucacauuagcuaguauaaaacugccuuguuggguagcuuaugaaaucugcccagccuuuccaaaauguuacucaagugauauucuuuuauaaaaucugcuaagagaagguaagacagaauccuaaggaguaaauuuaagucaaucccuauuauaaagcuaaauuauggcaaaaguccucggucuaaugcaauuuucuuguuucuucagagaauaaaacaauuucuaacauuccagauuaaccaagcacuuuuguuuguuuggauuuguuguuuuauuuuuaaauaguugucagaacucgguuuugcauuuggggaagauacaugaucuuuauaacaauaauuuauaaaacacaaacuauauauacaauauucuaggagaaaaacuacaaaugaaaagcaacuucugcuaguuuuauuaguugccuaaauuugacuuuuuaaaauucaccuuuuaaacugaagauauauaaucaaauuuaaaauauaaacauaauaaaugacauguauuuaauauaugaugcuauaugaacucaaauaucacaaaugaccuuuuuuuuuuaagcuaacccuuuggaaaagcauaaaaugcuuauauuaguuucugcucacaagaaaaaaaaaauccuuauaugaucauuuaagaaauguuacaucuauuucagccuaaauaaagccagaaagaaagcaaaggcugcauggauuuacaaguuauacaggugggaaugacugacaguuaaccuaacaagacucaacucuccaaguaaauaccaauaauaguuaaaagaggcaaggagcuacagaaagcaacucagagaccacuuccuugaggcaauaagaaugaguguauauguucagacuaagaguaagacagacacuugaagagccauccacuuaauuuaaagacaugagaaaagugaccagcuuucugccauauuugcucaaaagguucaugagaaucuaaaccuauagggccuauaauccugcaauguauaaagaaaccauguuacuacacucaaagaauguaucugaguaaaguacacuaaauuauacaugaaauacacuaggauauuauuuuuucuuuguaaacagugacuaaauuuucauuuacaauuaacugaaggaacuucauuacuaaaucaauaaaaaaugcaaucgaguguuuacauguaacagguauuuuucuucuccuucaacaaaaauguuaaguccaaacugccaacauacaaaauaauuuacacauuauuuugauagaagcuucuccccccaaaaaaaucugcuaauaucaaaugcuaagcaaugaacuuaaaaucauuucaaauauuacuaugaagagcaaaucuguaaauauuuaaaaguccaaaaguuuuuaaauucuucauacgaggaccgugauccccuucugaugcugcuucuauuagacauucugaagccccaagaauauacaccauauucucucuuuucauuaguaaacaagauacaaaacucuuacaagaacauuauauucuccugggaaucuagaaauguauauuggcaagauggauuaaauuacuaaacuaaucauaccauuugcccagaagacaggcacuaucuaagcaaacuucucuuucagucauaacacauacaguagaaaacauuuugauaugaagucagugaaggagaagugucuugugauuaucagcaagaaaugggcagauguacgaaaaagaaauacauuaaugagaaccucaagaguaacucuuaaaccaguuucuucauuaaaaauggaaaaagagacacaaugaagaauauaacuaccaauaugaagaccuacagaacauaguuauuacugguugacaagacaaaguuaugaaagucaccuaguaacaauuucuugacuaacagugacauauuaugggaauaaaauguacaucccuugaccuauauguauugauuaaugacagugugaagcuggaugcuucuuuaaaagauuaacuuaagaauaaaagaaauaaacguaaaacagauauagucacugucuucaaaaagucagaaguguuuuuuaaaaguaaacacauucuguauuaaaauucuaugaacaauaaugcuuagguucuauaaucucaaaaacaaaaaaaaaagaguugcccuaaaguaucuuaaaaacacauuaagggacggguauggugacucacaccuguaaucccaguacuuugggaggccaaggcagauggauugcuugagcccaggaguucgagaccagccuggaaaacaugguaugacccugucucuacaaaauaauacaaaaaaauuagcccgaugugcucgguggcucacacuuguaaucccagcacuuugggaggccaagguggguggaucaccugaggucaggaguucgagaccagccugaccaaaaugaugaaaccccaucucuacuaaaaauacaaaaacuagccgggcgugguggcauaugccuguaaucccagcuacucaggaggcugaggcaggauaaucgcuugaaccugggaggcagagguugcagugagccgagacugcaccauugcacuccagccugggcaacaagaacgaaacuccgucucaaaaaaaaaaaaaaaaaaaauuagcccgaugugguggcgugugacuguaguccuagcuacucaggaggcugaggugagaggaucgccugagccugggaggucaaggcugcugugauuguaccacugcacuccagccuaggcaacagagcaagacccugucacaaaaacaaaacaaaaccacacacaguaagaaaaccacauacuggagauguggucuuuggguucaaaugcagagcucccugaccugaagucagcaucuaaagcacucacuucaguaaacuuuuguccgacauucuuuaccaaaauaacuuggagaaaaucagucauuuucaaacugaguauauccacuucuacaacuacaaaugggaguauaaguuuuuuuuuuuuuuuuuuuuuuuuuuuuuugagacagcgucucgcucugucgcccaggcuggagugcaguggcgcgaucucggcucacugcaagcuccgccucccagguucacgccauucuccugccucagccuccccaguagcugggacuacaggcgcccgcuaccacgcccggcuaauuuuuuguauuuuuaguagagacgggguuucaccuuguuagccaggauggucucgaucuccugaccucgugauccgcccgccucggccucccaaagugcugggauuacaggcgugagccaccgcgcccggccaaaugggaguauaaguuuaagaccugacaaaagaacuaaaaauugucauugauuugucaugcugcagaggauuuaaauugaagacaccagcacuuacauauaauuagcuuauaaaagcaagcaguuaauuaaaacaaugcuauaauggcacuucaaauguugaaugcuauagacuuuacguguuugaaucaauacugcagucugaaauucugccaagccuaccacuaggaaagucuuugccaaacaagaaucacuuuuauuuucuccucccuaccugaccuacuucagacuagaaucuuucaaauauauaaaagaaauaauauguagauggaaaugcuuaaacgaaagaaaaaauaaacagggauauauucucaucugaaaagucaggagguuggaccaugagaccacuacaguccuuuuuagcccuaaagcuuuacgauuuauugugauaacaccaagaagcuuaucacaaacgauauaaacucuggcuucuaaaagucaguggugaugguuuaaaaaggcggaaaggggaaauaauagauggaucaucugaagcaggaucagcuaccaacaccagcaacaaaaaaaaugacugaccuuaaucaggucagaguucuaugcaacaaaaacuggauuccuaaggcuggggauuauuuuccuccuuuucccccauacucugugaaaauguuuauucucaaucugcgugugugugugguacuguggaaguacuaacuuuagaaaacaauuuuguuuuauuaaaaugcugauuucuucucccaauuuuucacauaaacucacgaacauuagguaucuuuauauucaacgauuugucuccauuugacaaaauuaaaagaaaauuucaauuaguaaauauccacuugaacaaacaauacucuuaaauuuaaugccaaauauacuaugagcaauucaaguuguaugucaauaauguacuucacuaauacuucaugugucugagcaaagugugcucuucugggcccacaucagaucauuagagcaggcaaacugacuaaaugcuucuaaggcucaguuuccuugccuggauuaaaaaaaaaaaaguguaauacuccuuccuuaucaugaagauuaaaagagguaauguguacaaaguaccuagcacagugacacaauucauuauugcuguugacuuuuauuauaaaccuaaguuaggcuuuugauagcauucugagauucauaauggguggcaaaaauaaguuuuccaugugaaucuaccuaauuucuccaaauuucuaagauuuauuccuccagagagaaaaugagguuuuucuuucaauucaacauuucuaaaaggucaccaaauaaaaacuuucaaagcaauuacuuaaaagccccauccuuauucccuuuaagaacguucugaugggcaucaaaaagaaucccuuucccccaugccacugaccucuaacaucuaggcucuggccuguaccagaugaggaggaaagugucacuguauaaucaauauuuauacaauuauaagucagagcuuuacagaggugucaccuaacaaaacgcauaaaugacuaagaaucauuccaagugucaccaucaagaccaccagaauaucacuaaaaucugcauuaggauuaugucuguugcuacugggauaucacugacaagucuuugaagcucauaugucacacaaucuccagaaggccucauacaauagcaaauuguugcuuguuacaauaauguuauauuaaaaauggcuacucguugaaaaauuaucuuaaaacaaauuccauuguuuaggugcuucccauauuuagacauucagauaaacaaucuacuacauagugcaauuuuaauuccaacucgcucuuuccccuuuugcuucaacuccccuuuaaauauccuaugccaugucuuucuauacaacacaggcacuuaaaaacagaaaugccuaagcuauuuagacuuuugccauuuucuucucaucuugcugcaaucauguuuuaacgggauauuuaauuauagauucuaccauagauuuacugccuuucuuugaaaauaggaaacucuuggaguaauuaagagcuagcucguucagaaaguacuauagaaaaagaaauuccaaucucucaacaagaaauuuaaaaauucuuauagagaggcuuagccuuugaacaaaauauauaauaaaaagcuuucuuguccaugaauauuaaaacauuucuuaccacauggcuaauucaaauugggguuacaacagugagucagaaaaccuugcucuaaauagugaucugaugaggacauuaaagaguauuugauuuaaaagcuuuuuuuuuuaaaucaacauucuuauaaaaucuaggcaucuaccuaguucaaaguauauuccaaacacuuagaacucuguuauaggaauagcuaauagugugaucuacagcagucauuaacaguugcacauuaaaaagaaauagcaauaaaaagauggacacccugaggucaaugauuuccucccaauaaccaaacaaauguuccaauagcauaaaccaaaagaugaugauaauuacuacaacauguuauguuaaccaaccucccuagucccgcgcaaugagcucacagaagucaggaugugcacaggcuguauccuucgcuguuuccauucuugguuuaagauuuccguucuuuccaaaauuuucugacgauuggaacuaaacauacucuuaaaaaaaaaaaugaaggagaggaaaggagaaauuguucauuguuagaaaauguauaacaccuguaaagcagguuaaaaaucuaguguauccucaaaaauaucaagaacauuuucuuaggugcauauagauuuuacacuauaguuucccacauucaaauaauacaaaaacaccacaucuguuauuuuauugcaagugguuagagaacaggaaacgauugccauccuuucuuuguugacuguguguguguguguguguguguguguguguguguguguguguguauuuuuuuuuuuaaucacaaugacuuuagaaacauaaaaucaugaaaugcaucccuuuauauuuagggaggcauuucugcagcugcauaugcaaauaaaaguauacuaaacaaagacugauuaaugugcaugguauaauguuaagacagaucaagaaccuaagcuuccaaguauucacucaucuuauuguaaauacaaacuuggcuagaauuauuuuaaauaaaaacuuauugaacuuaggaggggaaaaaaccuauccuuaauuguauauucauuuucacaaaagauaaaauuauaccuuuacuucaucagcucgucugaaccucuugagcugucucagucgcauguacucugauuuuacacgcuuccgccaacaaacuggucccuucucagauuucuucccagucuggcccaugauuauucuaaaagcaaugguuucauauuaaaaucacuaaucuaaccagccugaauaugaucaccuguguuuuaauccgcagcaaacuaacaaucagugaagaaaugacacauauuacacuguuggcauuuacagaaaggugcucauuugugcugcaugguuaaauccuuaaaacacuucauugaaaguuuaaguuaaacuuaaaauacacuuuuauuuacaaaaauucuacacuaaauugcggccauauuauaggaacaugaucccauuacaggaauuagguauacuauacuauaucacaaccuaguuuucaacucuaugagauccacauuuguggagggaagaaaauauaaagacagauccuguuuuucaucauuagcuguuacaguagcaaggcauaauggaauaauauaacugaaaaagguaaauccaagaagaaguaaaauuuacaaacaguacuaaaaguagaaaacauacaguucaccauauaauaaaauguacaaagguacucucuccccacacacuuaaucaugcaccucuccuuaaacacugugauaaagucuguauuuuugccucuugugccaccuuuauuaacaugagggguuucugcuaucaagcgaaaagaggaaugcaggaaaugcaaaguaaauucuucugccuuaucuuuaguugcaggcucucagaaccaauuauguuuaaaugcggggacagcuuauaguucaccagaugucuaauucauacugcagaguccucaccuuaagucuaaacaagcgucuuuuccuagaacauuuucuccuaaaguauuaaaaucauccuguaccuucaaauuauuagcaggacauucucugucaggcuaugcaaagcuuuacaggccacacuaacaauuugugcuuuaucuuaagaacaaugagaagccacuuuuaguguuuuaaguaaaagggugugcggugagggagugaaagaauaacugcaaccagguuagaugaugcugcagcacagcaucccgacaaggggugacagaggcuucuacaccacacuggcgaugacagggaaaaguacgugaauucaagaguugcuuaggccaaaauuccaccaaaugaugauuuaaauauggaaagugaagaagaaggugacuuucuggcuugagcaaauaaaugaguagggcaggcuucaucuauuuguuuacauaaaaacuucaugcacagagaaaacugccuaagaagaagauuuagaguaagaguccugaggccaauggguaacuuucuacagaaauacucaaccaccaacagaugacagagaaggcagauggcuguuuacucagagcuguaacaaaggggcgaagaaauucauuuucucaagcauguaauaaauauuaugacccaagcaguguauacgaacuugaauaaaaugaauauacaaauauuauuaaauccuugccccuauggagcugauagucuaccuaagacaaagggaaaaauauaguaugagauagacagacauacuucaguaucccuggggaacugguuccaggacaccccucggauaccaaaauccacagaugcucaaaaguccgugauauaaagugguguaauauuugcauaucaccuaugcauagccucccauauacuuuuuuuuuuuaccuggcuuccugggauauaagagacucccauauacuuuaaaucaccucuagauuacuuauaaucccuaauacaauguaaaugccauguaaauaguuguuauacuguauuguuuagaaaauaaugacaagcaaaacaguacagacauguucaguacagaugcaaccaucuuuuuuuuucugaauauuuuuuaucugcagcugguuaaauccaugaauucaggauccauggauuuggaacucacggauauggaaggcugacuguuuauacaaaagcacuuugggagaaagaaaagaauauuaggaacugcagaaggauggcaggaaagguaacaaggaacucaaucuuaaaagcugagcuggauuucaaaaggcaaagaaagaaccuaaagaaaucuuaggucugagcaagagaaagcuggacagggggcaacuaaagucuggcuggcagacauuuaauaagaauggaccuggagaaugaaagucacaaauuaaaaggacuaaggaccugaagggaacgaagagauaagaaugggcaggaauuugaguguauuugacauaaagaaggcugaugaaaucaccaagauagaacuauuccaagugaaaaguuuccaaguguggccuugccugcgaguugcuaaaguggaauaaagcugacagucacucggauuaagcaggcuaaacucaagaugaccccagcuuugagguaaagcagaaaaugguguuaggaaggcagugagguaggaccaaaggacaucaaagaugagaagaaacuggagcauuauuauuuuuuaaauaauuucaugacaauaguuuucuuccuaucugcuaguuaguuaacagaugaacucaacuaauucuaugcaaauuacuuaagaccacuuagugcuuccaaggccuaggaacuagaaagaaaaggaaucagauaaaaaggaaugaucuguagccucauucgcucauaggcuaaucaccucuaguccaucugcugccuagacaaauuucuccuuggagguagcaccccugugcaauaaggccuaggguaguaacguguuuaguuuucacugauguauaauguggguguuauuacaauuucuuuuuuuuugagauggagucucacucugucccccaagcuggagugcgguggugcaaucuccgcucacugcaagcucugccucccggguucacgccauucuccugccucagccucccaaguaggugggacuaccggugcccgccaccacgccaggcuaauuuuuuguauuuuuaguagagacaggguuucaccguguuagccaggauggucucaaucuccugaccuugugauccacccgccucagccucccaaagugcugggauuacaggugugagccacugcgccuggcuuacaauuuauuuuuuaagauacauauuuuaugucuugaugaagacauuaguuagcauuuuauguuuuaguacuagaacuguccuugucuaauauucuggaagacuuuccaugcuguuucuaccauuaauaacauaccuaauaaaguauaucaugaaaaucuacagcauccagguaguucuuugaaaguguaagacuaaauagguagaccugugaaagaauauuaaaauuuaaaguaccaauuaaaaggauguuuuacacaaaacaaacucccaccaucauagcauuuauaacauauuaaaaucacauuuucauguauuucacucuauucccacuguaagugcuucaacagcaagaaccacuuuuacucauuuguaaaaucccagagccugugugugccugauaauuguacaguaguccccacuuaucucccaagaccgccccccgccaaccccacagcggaugccuaaagcugcagauaguacuaaacucuaaauauaccauguuuuuuccuauacguacauacccaugaaguuuaauuuauaaauaaggcacaguaagagacugacagcaauaacuaaugguaaaaugaacaauuauaacaauauauuguuacaaaaguuacguagcuagagucuucucucucucaaaauaucguaacauuuucagacugcaguuugaaugaguaacuaaaaccuuagaaggugaaauuguagauuggggguggggcggcuauagacuuaaaaacaagcaaacaaacaggucuauuaacccacaugaauaacgaguagcuuguaucuuaucagcauaucauuuguaaagcuuagcuauagguaugaaaaggaaggguggccuauccaugcuugagccaaaaaaugagguaaagugcacccuauuaucaagaaaccccccgcaaaaggagauaaaucgcagggucaguuaggacccugugguucaguugucccuacuaccaguuagagaucuucagccuaaaacucaguuuccggaauuucuuuuuuaaaaggaagcugauauugccuuaaagaccuuauccauaaaaccuaccucaaagucuggcaacaaaaacgaaauauacaugcaaacacacuugguucugugccuggcauauagugagccuuuagauguuagcuccccugaccuccuucccccacaacaaacgacuggcucaaaucaggccucugacuccauuuucagugaucuuuucacaacaccacagccaaguaagcauaguauuaaaacacagauucaaggccacguacagugguucaagccuguaaacccagcauuuugggaggccaagguuggaggauugagcccaggaguucaagaccagccuaggcaauauagugagacucccaucucaaaucaauaaauaagcaagcaagcaagccagguguaguggcgcacaccuguggucccaacuacucaggaagcugaggugggaggaucucuugagccugugagguggagacugcagugaacugucuucacaccacugcacuccagccuaggugacagagcgagacccugucucaaaaaaaguaaaauaauaaaauacagcucuaaauauucauauauuggcagaagccuuuauuuaaacgacuucuacugaauggacacuguguaaauacauaugguuuuuaaauuuuucaaagauuuguuuaguuucauaggugaaaucccacuaguaugaacuuuauccagaauacaaaagcagcuuuuccuguucaaaacagauuauaccucuauucauuaaaacaaaagucuaccuguauacagugaaaccaaaacaacaauggcucuuuaauacaaaagccaaaccagaauauggcaggagcccaucaaagcuuuagcagaauguagugacaccucacagauuuacauuuacauagguuaacuaaaauuaagggcaauuacaguguucacaaucuauuuugugaaucaaaccaaacucagaaauacccugaacaccaugccuuaccaucuuacuuuaucccacuagaguagaugcuauguuguuuuugccacccagggucaauucacccuucucuugggaacuucacaccaacucuucucugagaacuaccaaguacacuggaggaagcugacucaagcugcuugugacccuggccugaccaagguacaucucccuagacauagugaccaguacaggguuagauacacggccacaaucagugcagucacagugaaaaucucagguuuccugcaaugcuaggacaagaaugcucacucuucuccccuuaggucuaaaccuggaaaaauguuugcccaaggacuuguuggaagccaucuuggagaagagccucaaagaacagagucaacaacuacaaaaaacaaaagucaaagccaagaaagaacuguagucucaugaccuaagcccuaagucaggcagaccuucccaaauuucggaacuauucaguuauaugagccaagaaauucccaucuuuuuuuucuuaauacagaggguaucucagauacguauuuauuacugagaccauauauacaguuguuccuccauauccacggaggauuaguuccaggacccccaacagauaccaaaauccacgaagacucaagucccugauauaaaaugguacacuauuacauaacguauacacauucucccauauacuuuaaaccagcagucuccaacuuuuuugcaccagggacugguuuuguggaagacaguuuuuccacaaagaggggagaggguacaugguuucaggaugaaacuguuccaccucagaucaucaggcauuaguuagauucucauaaggauggccaggcaugguggcucauaucccagcacuuugggaggccaaggcaggcagaucacuugaggucaggaauucgagaccagucuggccaacaugguaaaacccuguuucuacuaaaaauacaaaaauuagcuggguguggaggcaggugccuguaaucccagcuacucaggaagcugaggcaggagaaucacuugaaccugggaggcagagguugaggugagccaggaucaugccacugcacuccagccuaggcaacacagugagacgagacuccgucuccaaaaaaaaaagauucuuuuaaggagugugcaaccuagaucccucacgugugcagcuuacaauaggguucacgcuuccgugagaaucuaaugcugcugccaaucugacaggaggcggagcucaccuccugcuguacagcccaguuccuaacgggccacagacggguaccaguccacggccuggggacuagggaccccugcuuuaaaaccaucucuagauuacuaaauaccuaauacaauguaaauauuacauaaauaguuguuaaacuauuauguuuagggaauaauggcaagaaaaaaguauguacauguucaguacacacacuuuuguuucuuuucaaguauuuuuacccacaguuggcugaaucuacaaauguagaaucccauuuacagagggccaacuguauaggaacaucugaauuaauggaagaugggcucucauagccuacuucauuaucaccaacagcaucgucagaaaaaguagagcuuccuccauccucucagguuuacagaggccccaggacauggccaagacacaccuuccuaccuaccucucagguggccaggccacacaaguccaaggaaucagcacuguucucuaccagauacgccccuacuccacuugugagagguauuuaccuaaaucagacauuccugucccucuuuacccagcugccaauaacugaauaauuugaaaaaagucccauagguauugucagagcccuuauugcuucuuuaaaaauucuaccgggaggcgcgguggcucacgccaauaaucccagcacuuugggaggccaagaugggcagaucaugaggucaggagaucgagacuaacacagugaaaccccgucucuacuaaaaauacaaaaaauuagccaggcgugguggcgggcaccuguagucccagcuacucgggaugcugaggcaggagaauggcgugaacccgggaggcagagcuugcagugagccgagaucgugccacugcauuccagccugggcgacacagugagacuccgucucaaaaaaaaaaaaaaaaaauucuaccucaaggauuugcuaaaucaagggaaugaccaccuauuuggucuggccaaauaaauguuucuguuucuauuucucuaaagaaaacaauaaacuacauguacuauuuauccuucucaacuaaauuaauagcagcaacuuugacucuuaacugaauaccaggcuauguaaggucaaauccaaacccaacaagauguaaguaauaugauuacaauauucucaauguccuuccuuuuaaaaauguuuacuucacagcaagacugccaaaaaauugccaauuuugauaacucuccagucuucaauagugccuguuuguauguuuaaaugcuuugaaggcagcuguuaguaucauuuggcaauuucauuuauuuuuaauguuacaauccauuguuucaauauacugaaauuuaaaucaaugguaaaugagauuuuguagguaaggauaagaaaaacaauauaaagagaacuuagacauauagauguuaaauuauugguaagugauaaaaauuaauuacuuaagagaaacagauccuaugccugagggggaauauagaaaaccugucccuguaaaaaggaagaccaugagagaggaauccaggagaagcaggcacgcagugccaugcacugggcacuagaaucaggauucaaaacagacaagaucagagauggcaaggagaguucaucucauacaaccacuuugaggguuguguccauaaggauuauuggccuuaggccaggccauguucuagcucagcagagagagugcugucaugauuaauaaugccuguuacacacauggggcaaagaauugggguagcagcacucucuauuucacaccaaauuccaaguaauaaacuaaacuaauaagagaagaguuaguuguauuaauucuaaguccuauacacagcauuaaacaaaaagcaagaguuuggacuccaaagcucauucccuggguucagauccaaguucucccacuuagcagcugggugugaaguuggccaaguuacugcacaucuuugugccucacucuccucaugaaaaaaggcuaauucaagagccuccaccucagagucauugugagaaguaaauuuauuuacggugcauagacagugccugacagaugguaagcacuauaucagcauuaaaaaaguaguggcuaucaggugggcgcuguggcucccgccuguaaucccagcacuuugggagaccgaggcagguggaucaugaggucaagaguucaagaccagccugcccaacauggugaaaccccgucucuacuaaaaauacaaaaauuauccgggcguggugaugcacgccuguaaucccagcuacucaggaggcugaggcaggagaaucgcuugaaccuaggaggcggagguugcagugagcugagaacacgucacugcacuccagccuaggcgacagagcaagacuccaucucaaaaaaaaaaaaaaaaaaaaaaaaguagugacuaucaacuacauaaauggcagaugaguaauaucaggaauuacaacauuuauauuaaaaaguuaacaacucaauauaaagacuuuuuuuaaaugguaaacuguaugcaaauaaaaacaaaacaggaugucaggggaucucaggauagaaugcaaacuauacagcaagucuaacaguauuauaauuuuaugagauaaucucauggaaggagcaggaggucggggggagcuaaucuacagaacuuuggacaaucuacucuguacucuagcugguaaauuuguuucucauaaggguaccagucuguaauucugaaaauacucuacauguacacuaggguuaaacaaauaaguaaauaaaauguagauaaugugugccaaguuucucaaugucacagaaagaaguuacaaauaagcaagagguggugaugaauuagucagauauaucaauaugaacucacguguauuuuaaaauauaugcggauagauacagaaacguagguauguaugcacaugcagguuagcugaaauaccugcauuuccagggucuguccaacagagggccuggaagcagugacaccccaggagcaauaaaauaagcauacccugcacccaagacuuuuguuucuaaauaccaccuuccaauaaauacaaggaagcagggucugcagaaacagcugauucuaggguugggacagggaaacuacaaggcaagccaguagaagaagggaaaugcuccaaagaugaaaggagacggauagguccgagacuggaagcaaacagaagaaacucucaguggccaaagcuggaauaauuugagcagcagaguaaaucauaacaguauuauaacagaauaaaauaauuauucaugagucuaugauauaaauaagugauuaaauaaacaacuggaggagaaggaacaacucuccugacaagaauuccaacugauacaugaguguauguccccauucugggagggagaauucaauuuccuucccccugagcgugagcuagauucaaugauucacuuccaaagaagagucuggaaagggaaacaguaauguuucugugaaaaaaaaccauaaccauuaacaugagcaaugguaaguacugcugucauuauguacuccccgaugugaugaaaugagauggggauuucaccucugugguauccuucccccagaccucaacccauaacuucagccuaaucauaagaaaacauccgauaagccgaaaucaaaggacauucuuacaaaacaucugaccaauacacuuuaaaacgauuaagaggucaugaaaaauaaggaaaugcugagaacaaccacagaucagaaaaacuuaggagacaugauaacuaaaugaacugugguaucuuggauuggauccugaaaccaaccaaccaaccaaccaaagaaagacauuaguggaauaacuggcaaaauccaaauaaagucuugaguuuaguuaaugacaacauacugauacugauuucuuaguuuuaacaaauauaccauggcuauauaaauccaaaaguauuccaaaauaggccaggugcaguggcucaugcuuguuaaucccagcacuuugggaggcugaggcaggcggaucacguaagucaggaguucaagagcagccuggccaauauggugaaacccagucucuacuaaaaauacaaaaauuagcugggcaugauggcgagcaccuguaaucccagcuacuugggaggcuaaggcaggagaauugcuugaacccaggagguggaggcugcagugagcagagaucgcaccucugcauuccagccugggcgacagagcgagacuccgucccaaauaaauaaauaaauaaauaaauaauuaaaaauaaaauuacuccaaaauaaaguuauuuguuaaagcaaauuagguuacauaacaacccaauguaaaggcauucauuuuuaaaaauaacauucacuuuuagaagugauaacagaaacaaauuuuaaaaucuaaaaauguuacauaaaauguuaaauaggagaaacaaaaaauaugaauagaugauuagaauuauuuaaaaacauaggauuaaaaaaaaaaacagguaguggccaggcgcaguggcucacgccuauaaucccagcacuuugggaggccaaggcaggcagaucacgaggucaggagaucgagaccauucuugcuaacaaggugaaaccccaucucuacuaaaaauacaaaaaauuagccaggcgugguggcgggcaccuguagucccagcuacucgggaggcugaggcaggagaauggcgugaacccgggaggcagagcuugcaaugagccuagauagcgccacugcacuccagccugggugacagagcaagacucugucucaaaaaaaaaacagguaguaauuaagagagcuuguacuauuauuauuauuuuuauuauuauuuugaggcagggcucacucuguuccccaggcuggaguuccguggcccgaccguagcucacugcagccuggaacaucugggcccaaaugauaaucccagcuuggccucccauacuuuuauaaaucuuaacuucaaaggaauuugaggaaaaaaacucccaaauauaauucuacuuuuucaauuuuuuuggaagggacaaggucucacucugucguccaggcuggagugcagugaugcaaucccaacucacugaagccucaaauuccugggcucaggcaaucuuucugccucagccucucgaguagcuggggacuacagguguacuccaccacacccagcuaauuuuuuuuaauuuauuuuuuguagagaaagugucucacuauaguguccaggcugguaauuccacuguuuuaaaacagaaacuguuacacaaacaauuuaaaaggaaaaaaaaagaucuccauagcagccuauaugaugacaugucuacuugaagagauaaugcacuuuuaggcuucuacagaaucugaaucaagggaaguaacugugccacugacugaacuuguacugaucaaacaacaaaucaaaaggauucuauacaauucagggccaguuuaguuguguuuaaaaugaagagaaaaacuggucuuuacccacagugagagcacacaacucagaaaagaguauuugaguuugcaguugaauaaagaaaagaaggguuaauaugcauucauuaagucaacaaauauuuauugagcaucuaauacaagccagagacuacaauagaaacugaagacuuagcaauuaacaauuaaaaaucugugcccuuauacagcuuaaaaucuaguuggacagaaacaguuaaaaacaaagugucaggugcaguagcucaugccugugaucccagcacuuugggaggcugaagcagguggaugaccugaggccaggaguucaagaccagccuggccaagacggugaaaccccgucucuacuaaaaauacaaaaauuagccaggagugguggcacacaccuguagucccggcuacuaaggaggcugaggcaugagaaucacuugagcccaggaagcagggauuucagugagccaagaugugccacugcaccagccugggcaacagagcaagacucugucucaaaaacaacaacaacaacaacaacaacaacaacaaaguaaaauguuuacauguaagaugauguugagugcuaugggagaaaaaacaauacagguaagugaguuaaggcaaggguggcaaacaaaggaaugugagcugaaguacucagagccccagcuguguggcaaagcccaugggacacagagaucccaccaaccaacggcaguucaccaacagcaaacccaggagcaaacuauguaagagcauguuuucugguaaagauuccagaaauaauuagauuaaauauccacuuaaugcaggcucaguauauccgcaacgccucagugaucaacacagcuuuacagaauuuugaucaggcauuaaaacuagcauucaagaguugcuugcuggccccguucugguuaacuaguaggucucauuauccugaacaaagacuaaaaguuaacaccauuuuauaaaacauauuuaugcaaauagccauucucuguuaguauuaucaagccaaauuuaaaaaaacugauuauaaagcugauccugaggcuaugccauucuauaagcucuaacauugacuauuugguuuuaacaaaaucucauccuuaaauauguacagcuaauuugauggucuauauuuaauuuguaaaucugcucugguuuuaucauaaggaacuuauaugaaaucauauucauaaaauuaaaguugaauuaacccugggauuccaaucaacacucaaguuugaaaaacaccacaugagaaaaaaaauggagaacugaaguaauucaagaauaaagugauaagggcccugacuggguugacagcagugggcauagaagaaaaaaaaaaaaagauuuuuaauuuuagaauuaaaaacuaagucuaaaauuaaaaaucgagaugcaaucauaugagaaggaagaacaggucaaaagacaacugagcccuaaaucagccacugcuacaacagagaauacagaacuucauugagguuaauuauucacauaguaauuagcuagcauagaaaaauaaaaacgguaauucaaaguaaguaagaacaccauuaacaccauucuucagcauuuuggucucaugaccuguuuaguuuauauguguuauagcuauuaacauuuaacauaauagaaaugaaaaacuaaagaguuuuuuacaauuuacuuuuauuuuauuuuauuuuuuugagacaaggucucacucuggcccuggcugaagugcacuggcgcaaucacggcucacuacagccucgcccuccugggcuuaggugauccucucaucucaacuucccagguagcugggaccacaugugcacacuaccaugucuggcuauuguuuucuauuuuuagcagagacaggguuucgccauguugcccaggcuggucuugaauuccugggcucaaacaaucaccucaccuuggccucccaaagugcugggauuacaggugugagccacuacaccuggccuguuuuuuauuuuuauuaaaaacuguuauagcaagcccucaguauccaugggggucuaggggguauugguuccaggaacuucauggauaccaaaauccacagaugcucaucucuuauauaaaauggcacaguauuugcauauaaccuaugcacauucuccuuuauacuuuaaaucaucuggcucuagauuacuuaugaucaucuaauacaauguaaaauguuauauaaauccuuguuauacuguauuauuuguaucuuuuuuuuuuuuuuuggagacagagucucacucugucacccaggcuggagugcaguggcgcaaucuuggcucacugcaaccuccgccuccaggguucaagcgauucuccugucucagccuccugaguagcugggauuacaggcacacacuaccaugcccagcuaauuuuuguauuuuuaguagagacaggguuucaccauguuggccaggcuggucucgaacuccugaccucaggugauccacccggauuggccucccaaagugcugggauuacaggcaugagccacagcgcccgcccuguucuauuauuuuauuggcuuuuuuccacaaguauuuuugaucugcaguuguugaaugcacagaagcugaaccugaaaauauggagggccaacuguaccuaauauaaauaacacauuuuuaaaaagaaacuuauuuuccuuuaaaaaaaauuagugagugagggcaagcgugguugcucaugccuauaauccuagcacuuugcggggcugaggcaggaggaccacuugagcccaggaguuucagaccagccugagcaacauagccuucuuuuauuuaaaaaaaaaaaaaaaaaauuaauuaguaaguggugcuuuacauuuuugccaauuucuuuaauaucugucuaauaggaaacggauucucguaacuguuucugcauucaaucuguuccaauauguuguuuugguucaaguauaugaagaaaauccagucucaaacauacuuagcuuagaaaagggagaguguuugaauagccuucugaggucauuguggaucucgugcuuugauauuacaccaaaacaguucuauuaaaaaguggcuaguucaguucacaacucaaucucacaggugcuuuuccucaaaauaaccaccauacuucaguuagcagugguaauuucuuucuuacaagauuagaugcaacauggaauccgaaauuguaucagugaacuuuuccuacucugccacauuaacauucauuagucuauucacuuuaaaugaaucuuuaacucaggcacaauguuauaaaucaucauuccucaucuaaaaaguacugguccacugaguuacgcagauuuuccagaaguuggcauauuucaaaaaaucauguuguuaaacccauuaaucucaucagaaagucuuuaaguacugggaagcugucaugcucacaguaacagacaaaaguuuuccaaaaauuuuaauuuuugcuugaaagcccaaauguucucucugccaacaaauauggucaguuguuuuccuugaagugacagucucacuucauugauuuaaaaaaagucugccaaauaccuaagucugaauaaucaugguuugucagacccucuuuuaaguaaaaaugaaauuuccaugaaaaaaguggcuaguggagcucacaacuuaaucacguaagugcuuuugcucaaaacccaacauaccucaauaugcagcagaagcacuuuacacacauucccaucuuguugcacagaauguuacaacugcaugcacgcaaggaucaagauuuaauaaaauuaaucauuuuuaguacuucaucaaggacauucucaaacaaaacuggcuuuuuuaacugcaagugcuaaggugccaacaguguuuauucauugcuuuugcaccguggguacaaauguccaacaugguuuuuuuguuuguuuuuguuuuguuuuguuuuuuuaaaaaaaagcaaggaacaacucaguauuauuaugaaaauaguuucugggagguugagacacaagaaucacuugaaccugggaggcagagguugcagugggccaagaugucgccacugcacuccagccuggaugacagagugagacccugucucaaaaaaaaaaaaaaaagaaagaaagaaagaaaaaauaguuuugaucccauaaucccaggccacacuuugagaacugcuccccuuaaauauauccagacaucauacgaauccgaagucauaauacccugccuuuucuugacucacagagaaccuagaacagacaauauauucaaauuauauauuucuaaaauuuauaaugaaacauagaaaucaccacucuugcaacuagaaaaaggcaaacaagaguauaugugaagaauauuuaaugaaggguacuuuauuauaccugucaaacuacagaauuuaaaugaaauaaucugucauaugucagugccaaauuaagagacuaauaucuacuaaaauucguuuaaacaaauugccucuguuuucacuuaucuucuccuucaccacuguaagauaucaucaguaguuacagucacccuucugauccuccugcaacccuaagacaacgccauccuaccaaccaucucccuaaauacucacaccucacccuaccaccauaaaagauaaaauaaaaaucuugacccagggaccuuuuugcuuccuuaaaugacucuauuguuuuuucaaaaaaagaaaaaagaaugacaaaaacacacaagcucauuacugugagggacucaaauaguccacucaacugaccugcaaagugcuagaagaaacuucuguugaaggacuuggggaaaggcaggaacaaagagguauuaucaagcagucaauaauaauuuacugagcauuccaaaaguguuaaauccugugagagaucuaucgaaauguggaaaauacaacagguuuuagugccuucacuacaguggauuacauguacaugaaaguacagaugagaaagcauaaugaacagcauucgccuucaagaagucucaugauaggggaaaauaacagaaaaaaguaaagaacauauuuguaguccugguuucuguagugcuaaaaaguucaaaggcaaaggaaaguuauacuaauuuagcaaucuuagcugaaugauagaaaacauuaacuugaccguugcagcaaaagugaguagauucugcagugauauauuuuccacaacaguaagaucacuuuccuccuuccagcaagacaguaaacuauugauuucaaacugaaguccauagaccagcauucugguguuuaucugagaguacugcuuagaaaagaaauggccauauaaauuucaaccaacugaagaacugaacuauuuuaaguguuuuaaagaauuugcuugaacaacagauaaaacagacucacuaacugaauugacaucuaaagguuaaaguuuucagcugggggccauggcucacaccuguaaucccagcacuuugggaggcuaaggcaggcagauugccugaguccaggaguuugagaccagccuggacaauauggugaaacccugucucuacuaaaaauacaaauuagccaggcgugauggcaugugccuauaguccaagauacucuggaggcugaggugggagaaccaaucaccugagcccaggaggccaaggcugcagugagccaagauugugccacugcacuccagccugggcaaucacagugagacugucucaaaaaaaaaaaaaaaaggaaaaaaagaaaaaaaaaguuuaaguuuuucuugaaaacuauacuaaaucgauuuuauaaguuaaaucuucucauuucaucgaguauauacucaguuuacagaaacacuguuggaggaaaaacggaaaaaaauagguaucagaggcuggggccaaguggcucacgccuguaauccuagcacuuugggaggccaaggcgggcgaaucaccugaggucaggaguuggagaucagccuggccaacacgguaaaaccccaucucuacuaaaaauacaaaaauuagccggguaugguggcaggugccugugaucucagcuauuugggagucugaggcaggagaaucgcuugaaccuaggaggcagaggaugcguuaagcugagaucgcgccacugcucuucagccugggugacagagcgagacuugucucaaaaaaaaaaaaaaaaaaguaccagaaacuaaagcuaugauacaaaauucauuauaauucaaagaugagacaugagauaccuguuauuucaacacuucacugaauaaaagcaaacaaaaugaagggguaagucaaucugauaccagguguucuuuuugcuaagaagucuauuuuaaaucuuauaccacgcauaagccaacaucuaauuuaacuuacacaaaucuaacauacauugagcaaaaaugucagagaaagcucaauuuugguaguaaauacaaggguucuacccaccauuccagacacuaagcguuugccuaagugagcaagagacaggugacaugaaucugcuguucccauaaccugcuggacaagucucucagacugaagauauuuagccacucaggagugauucuaacaggauugcccuuaaguacaaaccaacaacucugugcucaacagaagagcaaugaucuguucucauucuagaggaaaaaugggcuggucuugaaccuaaaaagaagguacugguuugugguaaggcaucuucccacaaacucugcauggguaacuuugccuacaugcuauuuugccuuguacacuaacuuuauauccuaauccccaaauaagaugcaauuccuucuauauucugaagacagaaucauaaaauggacuaggugguucaaacuacuaaucccaaagcauuuacagaaccucucauaauuuccaggcaaucuaaaccaaguaaccauuaucuaguaauuucaauuuuugaguucuguauaugccacagccaguucuuucaaggaaguaccaaugucugcaaagugccauuucuuuauucuauggcuaucaacagaaccccucacugaagcagacucuucagaaacuccucuggcuuaugucggccccacaguucaugaucuugcuaagaacaguaguaguuuagggaaagauagagguaaacgagguacggcaguuaugagcaguaagucuuuccaugauuuuccuauacuuaaaauuuaucacaaauauaaacacacugccgggguacuacaaaauuucaaacccuucaaguacuauuuacuuaauaauugaugagacuugucaguaucugugcuauggucugaaggugucccucaaaaacucagguguuguccauguaacaguauuaagagauggggccuuucagaggugauuagaccacgacgguuccugccuugugaaugcccuuauacaagagucugacugagggaguuauucccagcuugccccuucuaucuucugcuauaagaggacacaguaagaaagccuucaugagaugcagguaccuugaucuuaaacuucccagcccccaaaacugugaaaaauauauauacguauauacauauauauguguauauacauauauauacguauauacauauauauacauauauacauauauauacguauauacauauauuguauacacuauauauuauauauaauauauaugcauauauguauauauacauauacauauacguauauacguauaugcauauauauguacguauaugcauauauauauacauauaugcauauauauauauauuuauuccuuuugugagacagggucucacucuguugccugggcuagagggcaguggcguaauucugucucacugcaaccuccaccuccuggguucaagugauucucccaccucagccuuccaaguagcugagacuacaggugcacaucaacgcacccggcuaauuuuuauuuuuugguagagaugggguuucaccauguuggccaggcuggucucgaacuccuaaccucaagugauccacccgccucagccucccaaagugcugggauuacagacgugagccacugugccuggccaacuucuauucuuuauaaauuacccagucuuggccaggcgugguggcucacgccuguaaucccagcacuuugggaagccgaggcaggcagauaaccugagggcaggaguucaacaccagccuggccaacauggugaaacccugucucuacuaaaaauacaaaauuagcuaggcauggugguaggcaacuguaaucccagcuacucgggaggcugaggcaggagaaucacuugaacccaggaggcggagguugcagugggccgagaucgcaccauuguaguccagccugggcaaaaagagcaaaacucccaucucaaaaauaaauaaauaaauaauuuuaaaaauuacccagucucagauauuccguuauaccagcacaaaacagaugaagacaauuuguuuuaccgaaaguuaccaucuguugauuacuauaacauuacuuaucaaaagcccagagaaacugguuuucugagucuccacugaccuauggaaaugauacaaagacaugaccaagcacagggaaacccauuauauaauuccuacaguuaccuuccugcuauuuccagauuaauaccaaggcuuuuaggggaggaaaaagcauuuuaccccauguaucguccucuuauguaaauuucugcagccagcuugaauuucuccccagaaagugagauuuucuuuucuaccacauggcaggcugcaaauuuucuaaacuuuuauguucugcuucccuuuuaaauuuaaguuccaguuucaggucauuuauuugcuuaugcaaaugagcacaggcuuuuagaagcagccaggccacuucuugaacacguugcugcuuuuagaaauuucuuccgccagauacccuaaacaucucaaguuuaaaguucaacagaucccuagagcaggagcacaaugcugccagucucuuugcuaacacauagcaagagugacuuuuacuccaguuccccaauaaguuccucaucuucaucugagacuucaucagccuagccaucucuguccauaucacuaucagcauuuuggucaaaaccauucaacaagucucuaggaaguuccaaacauucccuuaucuuccugucuuguucugagcccuccaaacuguaccaaccugugcccauuacucaguccaaaagcugcauccacauuuucagguaucuuuauugugaugccccacuucugugguacauauuuucuguauuaguccauucucacauugcuauaaagagcugaggguggguaauuuauaaagaaaagagguuuaauuugcuuacaguucagcaggcuauacaggaagcauggcuggggaagccucaggaaacuuaucaucacaguggaaagcaaaggggaagccagcacauuauacguggcugaugcagggggaagagagagcaaaguggcaggugcuacauaauuuuaaacaaccagaucucacgagaacucacugucacgagaacucacugucaggagaacagcaagggaaaagucugcccccaugauucaaucacuucccaccagaccccuccuccaacuuuggggauuacaauuugacgcgugauuuggguggggccacagagccaaacuauaucacccuagaacuuccauaugggaaaagaagaaaaugagagggccaggaugaguggcugacauuaagaaucuauagccucuaggguagaaaaacaugacuuuuuuuuugguagucuagauuuaaaaguugguauuuccauuaguauagaaugucucuuucuagagaauaagagaauaucucauucuuuauuugaauagcccuaauggguaaaagacuaaggcacccaauaagaaauuugaagaaauuuucuuuucuagaaaauguguauaguacagcuggccaguuacaugcuauuuguaaauaacaagucauacuagacaaaugguaaaaaacaauuauuucuuuaacugcaaagguaaauucuauaagaaaaauuggguaaauuugaacuugccaauuuagauuugauuguuuauaaagguaauuuauucagauacaucauaguccauuauagcaaaagcuuuuaggugcuauuaugcccauagugcagagacacaagcaagauaauaggcuuauaaucagcauuagauguucuaugaauugaccaacuugauaaagaauuugggaaagaugcauauaaccacuggauuaaaugccagcuagggagaaucuuaccaucaccugugaugguaaucaaacucuccaaagaaauaguuugaccuggguaacagaaaccaagugcuuagaauccuaguauuugcacuaaaaaggacccuauaggcagcaauagccuuuuuuuuuuuuuuuuuuuuuuuuggagacacagucucacucugucacacaggcuggagugcaggggugcaaacacggcucacugcagucucuaccuucugggcucaagcgacccucucaccucacucucccaugcagcugggacuacaggcaaaugccaccacauguggcuaauuuuuuguagaaauggggccucacuuuguuguccaggcuggucuugaacuccugggcucaagcaauccucccaccucagccgcucaaagugcugggauuacuggcgugagccaaugcacuuggccauaaaagcccauucuucaagggcccacuaccugagggaaccuaggcaaguuauuuacuaauuacuucaucugcaaaaugaagacauccucucugcaggcacauacaugguagauacucaguaaacacaaguuguuccauuauuuauucaucucauucaugucaccaugaagaggagagauccacaaaagcuacgugccaaggaaauacaacuaguauaauggcagagccucgcccagagccuaccacucuuuguacaacaucaagcuacuggugggauguagcccuccaaaauaucuucuuggucuggcaugauggcucaugccuguaaucccugcacucugggaggccaaggugaaagggucacuugagcccacgaguuugagaccagccugggcaaugugagacccugucucuauuuuucaaaaagaaucuucauagcauaacuugaguucucuauuucaggcaaauauucuccaaagaggcaaaauuacuuaaggaauuaaguggggcaauucaacacuuucuuccucuacgccaguucaagcaacacuucugccaucuacagggccugcucaauuacucuagaaaaguauuucccaaccuuuucugauccauaaauaauuuucgaaguagcccaaaaugggguuuacaaauaaauuugccaauuuugcuugcauuauuaauuaauuuuaauauaacacguuuuagaucagaauuuuaugaauaaggauugcacaguuuuuuccuaucaucagcauacuguuuaauaaguauaaaguucuggcccaaugcaguggcucaugccuguaaucccagcaccuggggacuccaaggugggagaucacuugauccuaggaguucuagaccagccggggcaacauggcgaaaccccaucucuacaaaaaaauacaaaaauuagcuaggggugguggugcauaccuguaaucccagauaccugagaggcugagguggaggaucacuugagcccaggaggucaaggcugcagugagccaucaucgugccacugcaccuaggugacagagugggacucugucucaaaaaaaaaaaaaaaaguauaaaguucaucuuauuaccagccaggccaacauggugaaaccccgacucuauaaaaaugcaaaaauuagccaggugugguggugcauaccuguaauaccaacuacucaggaggcugaggcaggagaaucacuugaacccaggaggcagaggcugcaguaagccaagacugcgccacugcauuccagccuggaugacacagcgagaccuugucucaaagaaaaaaaaaaaaaagguucaccuuauuagaauauuuuauaauagucauaaggacaaauucuccuuuucccauuuaacaaaugaugcaugguauugaguuuuacauaauuaaaaugcaugauuuucaauaaauucaaaaguaaaauauuuggggugaauaaacaugaaggauacucaacauuguuaaugcaaaucaaaaccacaaugagauagcaccucacacccauuauguuggccacuaccaaaagaaacagaaaauaacaaguguuggcaaggaugcagagacaucgaaaccuuugugcacuguggguaggacuguaaaaaucgugcagccauuauggaaaacaguacugagguuacucaaaacauuaaaauagaacuaccauaugauccagcaaucacaauucuggauauacagucaucccacagcauaugcagaagagugguuccaaaaaauaaaagacgaauaauuaaaaaaaaaaaaaaaaaaaaaagaagaggaagaauaagacugguuccaggaccaccuguauacauccaaauucacucauacucaaacccccaaaucugaccuauggaaccugcauauacaaaaagcccacccacccuauacacaaguuucacaucccacaaauaguguauuuucuuuuuuuuuuuuuuugagcagggucuuguucuguugcccuggcuggagugcaauggcaugaauaacagcucacugcagccucgaccucccaggcucaagcaauccuccugucucagccuccuaaguagcugaaacuacaggcgcaugccaccacaccuagcuaacuuuuuuauuuuuuguagagaugaggucucacuauguuguccaggcuggucucgaacuccuggccucaacugauccucccaccccagccucccaagugcugggauuacaggcaucagccaccacgcccagccgaauaguauauuuucuaucuauggcugguugaaaaaaauccacuuauagauggauccacauaguucaaagcuguguuguucaaugggcaaccauauauccaaaagaauucaaagcaggaucucaaagagauauuuguauaccaacauuuacugcauauuacuccuggcuaaccaugaauagugaaucaccaaaucaccaagcaacccaaauguccaccaauagauaaauggauuuuaaaaugcagucuauacauacaacgaaauaguauacagccuuuacagaaaagaaaaaaauucugucacaugcuacaacauggaagaaccucaaugacauuaugcuaagcaaaauaagcuaaucacaaaggggcaaauacuguuuaaucccaugcauguaaguaucuaaaacagucaaaaaucauggaaacagaaaguagaaagguggcugccaagaauuuggggggagggggaagugggaauuagugcucaauggguacagaauuucaguucugcaagacaaaaaaguucuagagaucuguugugcaacaaugugaauguauuuaacacuacugaacuguacauuuuuaaaugguaaacaugauuaauuuacuaugggcuuuuuacaauuuuuaaaaaaaguaaaauguuugauuuagaaacuacauguauauuagguacagguuagguucucaacaaauaguaauuaguucuauuaugugcaagcauaucguaggaacucauguaucuacaaacagaauauaugaaauuucacuauaggcuaugacaucaaaaaauacaaaagcugcuuuaauuaugauugaaauucuuccacuguuuaaaaauaauuaacugucuauuuucuuagauuuuugugauuuguuaaagcauuucuccggucuagucuuuaguaucaaaaacuaagagacuaaaauagauaaagcagucaugacauacugucuuuuugauaccuuuuuuuuuuuaaacuuccugaagacaucuugauauacuauguaugaauuuagcccauauaaaugcagcugagggauaaagaucacugggaucugauucaagccuauaaucccagcuuugggaggacaagguggcaggccacccugggcaacauauaagaccccaacucuacaaaaaauaaaaaauguaaaaaauuagccagacaucgugucucacgucuauaguccuagcuacuugggaggcugagaugggaagauccccugaacccaggagucugaggauguagugagcuaugaucacgccacuauacuccagccugggcaacagagugaaacuguguacaaaaaagaaaagaaaaaagaaaaaaagaggccgggcaugguggcucaugccuguaauccuagcacuuugcaaggccaaggcaggcagaucaccugaggucaggaguucaagaccagucuggccaacauagugaaaccccaucucuacuaaaaauacaaaaacuagccgggcguaguggcgugugccuguaaucccagcuaccugggaggcugaagcaggagaaucacuggaaccugggaggcagagacugcagugagccaagauccugccacugcacgccagccugggugacagagugagacucugucucaaaaaaaaaaaaaaaaaaagaaagaucauuguaagaucaguuugcagaaucauuucaugcucuucauuuuuuuuuuuuuuuuuuuuuuuugccucagaguuucucaagcuuucugacuuugaucaacagucuaccaaggauauacuuuaaaauuuuacaguaaucaauaucauaacagcagcuaacaguacacugggugaggaugguacuuaaauaauuauuuauugaguugcuuacagaagagaggucucccaagucccaaaucaacuucacaaauauuuuauuaguacuuacaauauacaaaaaccuuuuucuaagcucugcccuacagauuaauaaaaaggagcuuaaaaugaagggaaggagagagaaaaaaaaaaagauuaauacacauguuaugguacuucuaagcaggaaagaagcugcuuaacuugguugggaugggagaggggugguuucaagccagaagcugaacagcauguugagaugcuaaaauaaggaagauauuccagaaagaggacaggcacagaaucuccacgugaaauuuccuguagacuaguaagaaaaucaagugagaucaacaggagaaagauauaagaagaaaacuaccagggccaggcacagcggcucaugccuguaaucccagcacuuugggaggccaagaugggaacaucgcuugagcucaggaaucuugagaccaaccugggcaacauagugaaacucugucucuaacaaaaauauaaaaaauuagcugggcaugguggcaugugccuguggucccagcuacucaggagacugaugugggaggauuguuucagcccaggagguggagguugcaguaagccaagauugugccacugaaauccaggcugggugacagagcaaaaccccgucucaaauaaaaaagcaaagaaaaaaaaaacaccuaucagagauaauacuaauucagagaguuugggcuguucuacagacuaccuggaaugcuaccuucaggaauuucuuaacuugaauccacagccaugagaagacugagguggacaaugccacgaucaccuacaguggugguaaacaacacccaauggagguccaacagcuugcuuuauauauuuuuuucuuuguuaaacaggaaaaggaaaaguuauguauuacuugaauauugaagaaaaacuaaaaauuuauugugggggcaauucagguguugagcaaaagaacugcuacuuuacaaaaauaaaauaguguauagaaaccaaguauauauaaucugaaaagccauccauuucuauaauaaaaaaauuuacgggaggcuuaggcaggagaacagcgugaacccaggaggcagagcuugcagugagccgagaucgcgccaccgcacuccagccugggggacagagcaagacuccgucucaaaaaaaaaaaaaaaaaauuuuacuugauugucaaaguagggaaacuaaguuuggcaaucaucauuucuacauaccccauucuaagaucaaggucacuuuuuacuuuuaauauucucauuuauccuuugaagaaaaaauuuaaggcuuaacucacuaauaaaugaaaagguuugaauuaugcaaaaugaagagaauuacuaaauacaauaauuuucaaaacuaguuuaauuaaaaaaaauuaucauccauacaccuaacagcauaugaauaauauccuuuuaguuuacaaguuucugcaaaugcauaacauuuuguuacacuaauuaaaugacucgugaauuaaggacaauuuguuucacauaauuuaucugauuaugcuucccauauuaaaguuuuaacuugaucuuuauaguauuaaaaauacacaaaaucaaacaaaaaugaacaauaaaauauuugcaacacaaucugacagauaaugugacuauguacccagaacauauaaagaccucuugccacucaaccagacaaacaauccaauuuuuuaaagggacaaaaggcuugaaccaaaaaaaguacacaaauggccaauaagcauaugaaaagauguuccaacaucauugaucaucugagaaacacaaacccacaaugagauacuuaauacucauuugauggccaaaauuuaaaagacuggcaacacgaagugucaaugaaaaugugaagaaacuguaacuccugcacaguuacaacuguaacuuucaauuuaaaaugguacaacuauuuuggaaaagaguuuaacgguuucuuacaaaguaaaaucaauauuuaccacuaaaacauguccaggaaagacauacaaauggugauagcagcuuuaucaacagcugacaacaguccuauguguccauccauggguaaaugaauuuaaaaacuguagcacaugccuacaauggaauauuaauucagagaguuuacuacaagucaggugccgcggcucaugccuguaaucccaacacuuugggaggccaaggcagaaucauuugagcccaggaguuggaaaccauccugggcgacacaggaaaaccccaucucuacaaaaaaauauuaauaauaaauguuagcugggcauggugguacaugccugugguccuagcuacuugggaggcugaggugagagguucgauugagcccaggaggucaagguugcagugagcugagaucucgccuaaaacuacaaaaauuagcugggugugguggcagacgccuguaaucccagcuacucgggagacugaggcaggagaauugcuugaacccaggaggcggagguugcagugagccgagaucaugccauugcacuccagccugggugacagagcaagacuccaucuuggagggaaaaaaaaaaaaguugagagaaugacuguaaaagaggaugaaaggacucugagaugauggcaaccauuauagaucuugauccaggcagcggugcaggugcauacauuugucaaaacuccucaaaucauacccuucaaaugugugcuuuuuauuguauguaaauuauacuucaauacaguuguuguuuuaacuaaaaauuaauauaacuugacaacaccuauuaaaacuagaaauguucauaaucuugaaagagccaacucuauagaaaauugucacacaaauguucaaagauacauaaggauguucacuucuuuucaggagagaaaacaaugucaaucacaacagauugguuugcugcguaaugcacauucauaaacuggaauacuaugcaccccccuuacaccaaagagguacagcuggauggcuuagagcaaggggcagcaaacuuucucuguaaagggccacaugguaaguauuuuaggcuuggcaggcgguaucuagucucccuuauauguucuucagggaaguggggugguauuguuuuacaacucuuuuaaaaguguuaacguuuccagcucacaggccuuaccaaaaaugaucccuggcugggagaucaggacuuugaagcuaacguacccaaauuaaaauccuuccucuaccacuaacuaguuguuacuuaaucucuccaucucucgauauuauaguaucuauauaaaauaaugacuuagaagaguaccaagcauauagugagcccuaaaggaauaucaauuauuuuuuaauaaaacagaucuuuguauugaccuuaaaaaaaagccauguuagaaccaaauaacuuggucccauuuuuauaaaauguauguaaaaauacauauucauauaugaauauauuugaaaauuuggggaagaauauacaccaaaccguuaaagguagcgaaugagauaacagggaucaauacgcuuucauuuuauaaaugucuacauuguuucaguaguuuaaagcgaacacauuuaaucaacagacauuucuaaauugaaauagauaaaacgugugguaccauuuuuguaacuuaccaguccuaagcacguaauuuuaacuugagaaguguuugguuccauuaaugagaaaguacaucaacucuaaaauaauauuggcacaauaacugaaaaucauuuaucaaacacuuuuugccagguacaguucuaaggauuucacauguaucaauuccuuuaauccucacaaccaccuuaucagauguuaucauuauccucaccaauuuacagauagggaugcuaagacaucaagaggauaacaccccagacacaaauugguagcucagggacuggaacccaagaaacugucuccaaagaccacauccuuagaacucuacucuccuccccucucaaaugcauacuauuaccacucuggcugagaaagaaauccucaaaguuaaccuuuagucugucuaggguuucacacuguaccuuccaucaaacuacaauuaccuacuuuuaaauguaacuuucugaaugauucaaauaaacucauucuucucggagcugacauaucuuuaaucacccagaaagccagcagauaacacagaacagauaauauggaguagauaauauguagugaaacagaacuaaguuuggaucccgaaugcaaauucccagcugaauaauccugggcaaauucuuaacuccuccccuguagacaguuuucuucaguuuccucaucuguaaagguuuucggaguguguuauuaaauuuuguauucugguaagauauauagauauagagagagauauauauagauacagauacauaucguguaaaauuuaccauuuuaaccauuuuuaaguguacaauucuguggcauuaaauauauucaaaauauuguucaaccaucacuauuauccaucuccagaauuuuuucaccauuccaaacagaaacucuguauucauuaaacuccccauucaccucuccccucacagcccugguaaccucuauucuacuuucugucuccauagaguugccucuucuaacuaccucauauaaaugagaucauacaauuuuguauuuuuguacaaaagguuguaucuggcuuauuucacuaagcauaauauucuccagcuccauccauguaucagaauuucacuccuuuuaugucugaauuauuuugaaaucuuuuuacuuuuauuuugaaauuucacuccuuuuacgucuuuauuucacuccuuuuauguuuucauugguuuauauaccacauuuuguuaauucgccuguuggcagacacaaggugguucuuacaaauauuaaaaacaaaagcugggugcagugggucacaccuauaaucccagcacuuugggaggcugagguagguggaucucuugaguucaggaguucaagaccagccugggcaacauggcaaaacccugucucuacaaaaaauacaaaaauuagccaggcgugguggcaugcacuuguagucccagcuacuugggaggcugagauggaaggaucgcuugagcccaggaggcagagguugcagugaacugagaucacgcaucugcacuccagccugggugacaacaagacccugucuccaaaaaaaaauuuuuaauuuaaaaauguuuaaaaaguauccaggccaggcgugcgcaguagcucacgccuguaaucccagcacuuugggaggccgaggcaggcggaucaucugaggucagcaguucgagacuagcuuggccaacguggugaaaccccaucucaacuaaaaauacaaaaauuagccaggugugguggugcguucccguaaucccagcuacucgggaggcugagguaggagaaucgcuugaacccaggaggcagagguugcagugagccgagaucacgccacugcacuccagccugggcaacaagugugagacuccauaucaaaaaacaaaaacaaaaacaaaaaacaaaaacaaaaacaacacagcagggugugguggcucacaccuauaaucccaccacuuugggaggacgaggcaggucaaucacuugaggucaggaguuccagaccagccuggccaacacagugaaacccaguuucuacuaaaauauaaaaauuaucggaggcugggcacagugacugacgccuguaauccuaguacuuugggaggccagggcagguggaucaccugaggucgggaguucgagaccagccuggccaacauggugaaaucccaucacuacuaaaaauacaaaaauuagccaggccugguggugcaugccuguaaucccaacuacuugagaggugaggcaggagaaucauuugaacccaggagguggagguugcagugagccaagauggugccacugcacuccagucuaggugacagagugacacugcaucucaaaaaaauaaauaauaaauaauaaauaaauaaauuagccgagcgugguggcgcacgcuuguagucccagcuacucaggaggcugaggcacaagaaucacuuucgagacuccgucucaaaaaaaaaaaguaucugggucaaacacaauggcucagccugucaucccuguacuuuaagaggccaaggcaggaggauugccuggagccaggaguuugagaucaacgugggcaacaaagcaggaucccaucucuacaaaaaauuaaaaaauuaaauaagucaccacaauggugugcacugguaauaccaguuacucaggaggcugagacaggaggaucccuugagcccaggaguuuaaggaugcagugagcuaugaucuuguucugucuugcuauuguuaauggaaaacaagaccaauuauuaagaaacugcuaaccacauaaucuaaacacaaauuugucauauuuuuauaccaaguaguggaacaguggcaagauauggaauggugcaacuaucuuagaaauuuaccagcuguaacuuuugagguaucacuaaauuugcuaaucuguauuuaaaucauuuuaaaagaaugaugaaaagcaucccaauaaaugauccaauuacacugucgcuacauccuucaguuuuagcuccaaaaccuaccucaauuuacuccaauaaagaacucaugaauuauaacaaaacagcuuuucaguuaaaagaucuacuacccucucucgcccuuucccuuccuuauauuuuugcaaagagaucaucaauaucaacauuaaaucaaauuaagcaaauacuauuacuaaauauccagaugauucaucaaguucucuccaguuguccgaguguaauaguugcaucuaaaggauaucuaauguuuaguacuacagauuauaacuaggaaaaacuuggaacuuguucaccuugacaacuauuuuucuuuguaaucauucccuauuaaagagggagaaaaacacauuucaaaguuccucacaugaauacuaacauauccuguucacuuugcaaguuccuuugucaaauuauuucccuacauuuuucauauuuccuuaauucauucaacuauauuuaaaaccccuauucucuagcaaauaccaacguagguacuagguauacaaagaaaaaaauaagacagagccucuaccaggaggcacuuugacuguagggaagagagggaugcauaaacaagugauuacaauacaauugagucaugcuacaauaaaauaugauaaaacccugugggaacacaagagugggaauucagggaagaccuccagaagguaaaguauguaucaucugaccaugaaccuuucucugaauuuaaugaauugcugcuguucacuuaugcucucccccgaagauuucaccuacucauauagaaucuaucaugauuuacagaaaauuugucaucuauacugauauaaagacuucaaggcuaauccauaaaucauugcuaauuaaccacagaauacauuauauuggaggauuuguccuuguugguuuuuaaaaagcagaucaacuuucucaaucacugcucauguaaaggguaauacugaaauaaauucagaauccuugagcacacuaccucaaaagaaggaagguauccugggaaaauuccaguaugacuuggagaaauuugccuaaaauuuuuaaauggccaacauaaagauauucacuuaaauguauuugugcaaggcaaagcuagguaucaaaguaucagaacuuuuucuaacuacacuagaucaacaaguguguuuuaagucacugcuacuuaaacugacuaaauacauucucaauuguaccagaaaauaauuuaauaugaauuuuuaaaccaauuccccaaagagauguuuuucaaaauaucucauggcaaguacaaagaauaguaauuaucaaauacagagaacacucaagggcaaaguuagaaauuuuuauccuaggcugggcgugguggcucacgucuggaucagcauuuugggaggcggaggcggguacaucacuucaggucaggaguucgagaccagccuggccaacauggugaaacccugucucugcuaaaaauacaaaaauuagccgggugucguggugcgugccuguaguuccagcuacucgggaggcugaggcaggggaauuccuuaaacccgggaggcagagauuguagugagcccagauccagccacugcacuccagccuggacgacagagcaaggcucugucucaaaaaaaaaaaaacauauacacacacacacacgcgcgcgcacacacacacacacacacacacacacauauguauccuaaaauauccgaauuucugccaaaaaucugcauaacuaccuuaucucauaauggacaagauuauuaauaggauuuuuuaaauacagaauuaauaguaacuaauauaaacguuacuuuuuuguuauaaugucucaacacuuagaccagcaccuggaaugcccguacaguggugucaacacucuccaaaauauauguaauaaauuuauauugcauuuauuugucuccauuuuuaugaaaccuuaaguuagcagaugcacauuagaucuuuaucauauaggacagugcaaccagaagaacgccuauguuuuucuaacuuguuuucuuggaauauauucacuuuccacaaaaacgagaauuuaagaugcaguguuccuguuuccgggaaaccuuaaauauuacaucacccaacacaccuccgaaaagagagaacaagacgcuuuauaucuaugacuagaauccuaccuauuccuaacuuuagagaccaugaauagaaaauuaaaauauaucuuaaauacuuguuuuccugcaaauaaaauuacaaauaaacaaguuaggauuacacacuuguacaguauuccuaaacaugaauuaguugcuaaugcuuaugaagaguaauagaaaauaaacuccaaaaccccuaaaaguauaaacuacauucaauugugacagcauucguguuuuucaaagguuuauuaaaugcuguuuuaugaugacaucaaaacgccacaaaauuaaacuaauaauaacuugcuugaacccuaaaaagcaagccuuuaaguaaauagcaaagacacauuuuuauuuccaaaugaauuuaaauguuacagauccugugugauaaaggaaguuuaacuguggacagcacacguuaaauuucuuaggcaacaaacauuucuccaugcagucuuuucugaaucaccaaagcuauuguucacagaaaacgagaccaauuaauaagaaacugcuaaccguauaaucuaaacacacauuugucauagccauucuauuuugaucaccuacuucuaccaccucauccucauucaacccgucgggauuuggggaauaaucuggcugaaugacaguugauuucguuagcaccugucgccauucucagauguaucacacaaguuggccaaaacagcuuguaauguuuaaggauuacgauucuuuagaaaguggcaacucacuaggcguucaccaaguuuuccaaaagaucgugcuucucgauuccucccgcuuucaaaaaguaacccuguggcacagauuuuuggggggaacggaaggggauguacacaaugaagugggaauucaacaggacgcccuccagaaacacaaucaauagagagcagagcagcucgacucuucccucaaacuuagcauaaagccagaccaggcggcgagggcagcccgcgaccgccggagcucagggggauuucggggugcgucguggggaaacgucagaggcgaagcuacuccgaguuccccgccgcgaacgucgucccgcgagcgccgcggccccagcccggggucggcgcgcccgggaccgggggcgugcgcgaggcgagggccgagcccugcccaccccggcagcggcccgcgccuccccacgccccucucccgcccgccggcgggcccgggugucaugccccuuccccucgcgccgagcccuccggagacacaguccguccuuugucugagugcggacucggcggcugggucccaccaacuugugucugucccgucccacccgggcgcucccgccgcggccgcgccacacaaaggagacuugaggcucgagcugccacccuggaccgggcaccggaacgccccgaccccggccccggcgccccggccaggacaagcaccgggaaaggagccccccacacgccccccgccccgcagcuccaggggugugcgcugccucacucgcagggucccgcgggccagcccgaagcucacagcuccuuccggggaggggggcucuccccucacccuccaccccccgcacgccuacaaacgcggcgccccggugagccccgcucggcgauacccgggaccggcacagcaguggcggggagguccuggcgccgccgccgccgcccgguucgcacucccggagccccgccggccgggccgcccgcagcggcgcguuaccuucgucccgcgcgccgacucgcguuguucccgcgcgucgcccccgcgcgccgccgccgccgccgccggggcuccacugccuucugagucccaccgggugucggacgcgaccggaccgagcgccaaacgcggcagcccaaucgccaucgcuuuuauuuggcccccccagcccaaucaagcgccgcc

SEQ ID NO: 191605 - RNA, 76978 nt, Homo sapiens
ggcggcgcuugauugggcugggggggccaaauaaaagcgauggcgauugggcugccgcguuuggcgcucgguccggucgcguccgacacccggugggacucagaaggcaguggagccccggcggcggcggcggcggcgcgcgggggcgacgcgcgggaacaacgcgagucggcgcgcgggacgaagguaacgcgccgcugcgggcggcccggccggcggggcuccgggagugcgaaccgggcggcggcggcggcgccaggaccuccccgccacugcugugccggucccggguaucgccgagcggggcucaccggggcgccgcguuuguaggcgugcgggggguggagggugaggggagagccccccuccccggaaggagcugugagcuucgggcuggcccgcgggacccugcgagugaggcagcgcacaccccuggagcugcggggcggggggcguguggggggcuccuuucccggugcuuguccuggccggggcgccggggccggggucggggcguuccggugcccgguccaggguggcagcucgagccucaagucuccuuuguguggcgcggccgcggcgggagcgcccgggugggacgggacagacacaaguuggugggacccagccgccgaguccgcacucagacaaaggacggacugugucuccggagggcucggcgcgaggggaaggggcaugacacccgggcccgccggcgggcgggagaggggcguggggaggcgcgggccgcugccggggugggcagggcucggcccucgccucgcgcacgcccccggucccgggcgcgccgaccccgggcuggggccgcggcgcucgcgggacgacguucgcggcggggaacucggaguagcuucgccucugacguuuccccacgacgcaccccgaaaucccccugagcuccggcggucgcgggcugcccucgccgccuggucuggcuuuaugcuaaguuugagggaagagucgagcugcucugcucucuauugauuguguuucuggagggcguccuguugaauucccacuucauuguguacauccccuuccguuccccccaaaaaucugugccacaggguuacuuuuugaaagcgggaggaaucgagaagcacgaucuuuuggaaaacuuggugaacgccuagugaguugccacuuucuaaagaaucguaauccuuaaacauuacaagcuguuuuggccaacuugugugauacaucugagaauggcgacaggugcuaacgaaaucaacugucauucagccagauuauuccccaaaucccgacggguugaaugaggaugaggugguagaaguaggugaucaaaauagaauggcuaugacaaauguguguuuagauuauacgguuagcaguuucuuauuaauuggucucguuuucugugaacaauagcuuuggugauucagaaaagacugcauggagaaauguuuguugccuaagaaauuuaacgugugcuguccacaguuaaacuuccuuuaucacacaggaucuguaacauuuaaauucauuuggaaauaaaaaugugucuuugcuauuuacuuaaaggcuugcuuuuuaggguucaagcaaguuauuauuaguuuaauuuuguggcguuuugaugucaucauaaaacagcauuuaauaaaccuuugaaaaacacgaaugcugucacaauugaauguaguuuauacuuuuagggguuuuggaguuuauuuucuauuacucuucauaagcauuagcaacuaauucauguuuaggaauacuguacaaguguguaauccuaacuuguuuauuuguaauuuuauuugcaggaaaacaaguauuuaagauauauuuuaauuuucuauucauggucucuaaaguuaggaauagguaggauucuagucauagauauaaagcgucuuguucucucuuuucggagguguguugggugauguaauauuuaagguuucccggaaacaggaacacugcaucuuaaauucucguuuuuguggaaagugaauauauuccaagaaaacaaguuagaaaaacauaggcguucuucugguugcacuguccuauaugauaaagaucuaaugugcaucugcuaacuuaagguuucauaaaaauggagacaaauaaaugcaauauaaauuuauuacauauauuuuggagaguguugacaccacuguacgggcauuccaggugcuggucuaaguguugagacauuauaacaaaaaaguaacguuuauauuaguuacuauuaauucuguauuuaaaaaauccuauuaauaaucuuguccauuaugagauaagguaguuaugcagauuuuuggcagaaauucggauauuuuaggauacauaugugugugugugugugugugugugugugcgcgcgcguguguguguguguauauguuuuuuuuuuuuugagacagagccuugcucugucguccaggcuggagugcaguggcuggaucugggcucacuacaaucucugccucccggguuuaaggaauuccccugccucagccucccgaguagcuggaacuacaggcacgcaccacgacacccggcuaauuuuuguauuuuuagcagagacaggguuucaccauguuggccaggcuggucucgaacuccugaccugaagugauguacccgccuccgccucccaaaaugcugauccagacgugagccaccacgcccagccuaggauaaaaauuucuaacuuugcccuugaguguucucuguauuugauaauuacuauucuuuguacuugccaugagauauuuugaaaaacaucucuuuggggaauugguuuaaaaauucauauuaaauuauuuucugguacaauugagaauguauuuagucaguuuaaguagcagugacuuaaaacacacuuguugaucuaguguaguuagaaaaaguucugauacuuugauaccuagcuuugccuugcacaaauacauuuaagugaauaucuuuauguuggccauuuaaaaauuuuaggcaaauuucuccaagucauacuggaauuuucccaggauaccuuccuucuuuugagguagugugcucaaggauucugaauuuauuucaguauuacccuuuacaugagcagugauugagaaaguugaucugcuuuuuaaaaaccaacaaggacaaauccuccaauauaauguauucugugguuaauuagcaaugauuuauggauuagccuugaagucuuuauaucaguauagaugacaaauuuucuguaaaucaugauagauucuauaugaguaggugaaaucuucgggggagagcauaagugaacagcagcaauucauuaaauucagagaaagguucauggucagaugauacauacuuuaccuucuggaggucuucccugaauucccacucuuguguucccacaggguuuuaucauauuuuauuguagcaugacucaauuguauuguaaucacuuguuuaugcaucccucucuucccuacagucaaagugccuccugguagaggcucugucuuauuuuuuucuuuguauaccuaguaccuacguugguauuugcuagagaauagggguuuuaaauauaguugaaugaauuaaggaaauaugaaaaauguagggaaauaauuugacaaaggaacuugcaaagugaacaggauauguuaguauucaugugaggaacuuugaaauguguuuuucucccucuuuaauagggaaugauuacaaagaaaaauaguugucaaggugaacaaguuccaaguuuuuccuaguuauaaucuguaguacuaaacauuagauauccuuuagaugcaacuauuacacucggacaacuggagagaacuugaugaaucaucuggauauuuaguaauaguauuugcuuaauuugauuuaauguugauauugaugaucucuuugcaaaaauauaaggaagggaaagggcgagagaggguaguagaucuuuuaacugaaaagcuguuuuguuauaauucaugaguucuuuauuggaguaaauugagguagguuuuggagcuaaaacugaaggauguagcgacaguguaauuggaucauuuauugggaugcuuuucaucauucuuuuaaaaugauuuaaauacagauuagcaaauuuagugauaccucaaaaguuacagcugguaaauuucuaagauaguugcaccauuccauaucuugccacuguuccacuacuugguauaaaaauaugacaaauuuguguuuagauuaugugguuagcaguuucuuaauaauuggucuuguuuuccauuaacaauagcaagacagaacaagaucauagcucacugcauccuuaaacuccugggcucaagggauccuccugucucagccuccugaguaacugguauuaccagugcacaccauuguggugacuuauuuaauuuuuuaauuuuuuguagagaugggauccugcuuuguugcccacguugaucucaaacuccuggcuccaggcaauccuccugccuuggccucuuaaaguacagggaugacaggcugagccauuguguuugacccagauacuuuuuuuuuuugagacggagucucgaaagugauucuugugccucagccuccugaguagcugggacuacaagcgugcgccaccacgcucggcuaauuuauuuauuuauuauuuauuauuuauuuuuuugagaugcagugucacucugucaccuagacuggagugcaguggcaccaucuuggcucacugcaaccuccaccuccuggguucaaaugauucuccugccucaccucucaaguaguugggauuacaggcaugcaccaccaggccuggcuaauuuuuguauuuuuaguagugaugggauuucaccauguuggccaggcuggucucgaacucccgaccucaggugauccaccugcccuggccucccaaaguacuaggauuacaggcgucagucacugugcccagccuccgauaauuuuuauauuuuaguagaaacuggguuucacuguguuggccaggcuggucuggaacuccugaccucaagugauugaccugccucguccucccaaaguggugggauuauaggugugagccaccacacccugcuguguuguuuuuguuuuuguuuuuuguuuuuguuuuuguuuuuugauauggagucucacacuuguugcccaggcuggagugcaguggcgugaucucggcucacugcaaccucugccuccuggguucaagcgauucuccuaccucagccucccgaguagcugggauuacgggaacgcaccaccacaccuggcuaauuuuuguauuuuuaguugagaugggguuucaccacguuggccaagcuagucucgaacugcugaccucagaugauccgccugccucggccucccaaagugcugggauuacaggcgugagcuacugcgcacgccuggccuggauacuuuuuaaacauuuuuaaauuaaaaauuuuuuuuuggagacagggucuuguugucacccaggcuggagugcagaugcgugaucucaguucacugcaaccucugccuccugggcucaagcgauccuuccaucucagccucccaaguagcugggacuacaagugcaugccaccacgccuggcuaauuuuuguauuuuuuguagagacaggguuuugccauguugcccaggcuggucuugaacuccugaacucaagagauccaccuaccucagccucccaaagugcugggauuauaggugugacccacugcacccagcuuuuguuuuuaauauuuguaagaaccaccuugugucugccaacaggcgaauuaacaaaaugugguauauaaaccaaugaaaacauaaaaggagugaaauaaagacguaaaaggagugaaauuucaaaauaaaaguaaaaagauuucaaaauaauucagacauaaaaggagugaaauucugauacauggauggagcuggagaauauuaugcuuagugaaauaagccagauacaaccuuuuguacaaaaauacaaaauuguaugaucucauuuauaugagguaguuagaagaggcaacucuauggagacagaaaguagaauagagguuaccagggcugugaggggagaggugaauggggaguuuaaugaauacagaguuucuguuuggaauggugaaaaaauucuggagauggauaauagugaugguugaacaauauuuugaauauauuuaaugccacagaauuguacacuuaaaaaugguuaaaaugguaaauuuuacacgauauguaucuguaucuauauauaucucucucuauaucuauauaucuuaccagaauacaaaauuuaauaacacacuccgaaaaccuuuacagaugaggaaacugaagaaaacugucuacaggggaggaguuaagaauuugcccaggauuauucagcugggaauuugcauucgggauccaaacuuaguucuguuucacuacauauuaucuacuccauauuaucuguucuguguuaucugcuggcuuucugggugauuaaagauaugucagcuccgagaagaaugaguuuauuugaaucauucagaaaguuacauuuaaaaguagguaauuguaguuugauggaagguacagugugaaacccuagacagacuaaagguuaacuuugaggauuucuuucucagccagagugguaauaguaugcauuugagaggggaggagaguagaguucuaaggauguggucuuuggagacaguuucuuggguuccagucccugagcuaccaauuugugucugggguguuauccucuugaugucuuagcaucccuaucuguaaauuggugaggauaaugauaacaucugauaaggugguugugaggauuaaaggaauugauacaugugaaauccuuagaacuguaccuggcaaaaaguguuugauaaaugauuuucaguuauugugccaauauuauuuuagaguugauguacuuucucauuaauggaaccaaacacuucucaaguuaaaauuacgugcuuaggacugguaaguuacaaaaaugguaccacacguuuuaucuauuucaauuuagaaaugucuguugauuaaauguguucgcuuuaaacuacugaaacaauguagacauuuauaaaaugaaagcguauugaucccuguuaucucauucgcuaccuuuaacgguuugguguauauucuuccccaaauuuucaaauauauucauauaugaauauguauuuuuacauacauuuuauaaaaaugggaccaaguuauuugguucuaacauggcuuuuuuuuaaggucaauacaaagaucuguuuuauuaaaaaauaauugauauuccuuuagggcucacuauaugcuugguacucuucuaagucauuauuuuauauagauacuauaauaucgagagauggagagauuaaguaacaacuaguuagugguagaggaaggauuuuaauuuggguacguuagcuucaaaguccugaucucccagccagggaucauuuuugguaaggccugugagcuggaaacguuaacacuuuuaaaagaguuguaaaacaauaccaccccacuucccugaagaacauauaagggagacuagauaccgccugccaagccuaaaauacuuaccauguggcccuuuacagagaaaguuugcugccccuugcucuaagccauccagcuguaccucuuugguguaaggggggugcauaguauuccaguuuaugaaugugcauuacgcagcaaaccaaucuguugugauugacauuguuuucucuccugaaaagaagugaacauccuuauguaucuuugaacauuugugugacaauuuucuauagaguuggcucuuucaagauuaugaacauuucuaguuuuaauagguguugucaaguuauauuaauuuuuaguuaaaacaacaacuguauugaaguauaauuuacauacaauaaaaagcacacauuugaaggguaugauuugaggaguuuugacaaauguaugcaccugcaccgcugccuggaucaagaucuauaaugguugccaucaucucagaguccuuucauccucuuuuacagucauucucucaacuuuuuuuuuuuucccuccaagauggagucuugcucugucacccaggcuggagugcaauggcaugaucucggcucacugcaaccuccgccuccuggguucaagcaauucuccugccucagucucccgaguagcugggauuacaggcgucugccaccacacccagcuaauuuuuguaguuuuaggcgagaucucagcucacugcaaccuugaccuccugggcucaaucgaaccucucaccucagccucccaaguagcuaggaccacaggcauguaccaccaugcccagcuaacauuuauuauuaauauuuuuuuguagagaugggguuuuccugugucgcccaggaugguuuccaacuccugggcucaaaugauucugccuuggccucccaaaguguugggauuacaggcaugagccgcggcaccugacuuguaguaaacucucugaauuaauauuccauuguaggcaugugcuacaguuuuuaaauucauuuacccauggauggacacauaggacuguugucagcuguugauaaagcugcuaucaccauuuguaugucuuuccuggacauguuuuagugguaaauauugauuuuacuuuguaagaaaccguuaaacucuuuuccaaaauaguuguaccauuuuaaauugaaaguuacaguuguaacugugcaggaguuacaguuucuucacauuuucauugacacuucguguugccagucuuuuaaauuuuggccaucaaaugaguauuaaguaucucauuguggguuuguguuucucagaugaucaaugauguuggaacaucuuuucauaugcuuauuggccauuuguguacuuuuuuugguucaagccuuuugucccuuuaaaaaauuggauuguuugucugguugaguggcaagaggucuuuauauguucuggguacauagucacauuaucugucagauuguguugcaaauauuuuauuguucauuuuuguuugauuuuguguauuuuuaauacuauaaagaucaaguuaaaacuuuaauaugggaagcauaaucagauaaauuaugugaaacaaauuguccuuaauucacgagucauuuaauuaguguaacaaaauguuaugcauuugcagaaacuuguaaacuaaaaggauauuauucauaugcuguuagguguauggaugauaauuuuuuuuaauuaaacuaguuuugaaaauuauuguauuuaguaauucucuucauuuugcauaauucaaaccuuuucauuuauuagugaguuaagccuuaaauuuuuucuucaaaggauaaaugagaauauuaaaaguaaaaagugaccuugaucuuagaaugggguauguagaaaugaugauugccaaacuuaguuucccuacuuugacaaucaaguaaaauuuuuuuuuuuuuuuuuugagacggagucuugcucugucccccaggcuggagugcgguggcgcgaucucggcucacugcaagcucugccuccuggguucacgcuguucuccugccuaagccucccguaaauuuuuuuauuauagaaauggauggcuuuucagauuauauauacuugguuucuauacacuauuuuauuuuuguaaaguagcaguucuuuugcucaacaccugaauugcccccacaauaaauuuuuaguuuuucuucaauauucaaguaauacauaacuuuuccuuuuccuguuuaacaaagaaaaaaauauauaaagcaagcuguuggaccuccauuggguguuguuuaccaccacuguaggugaucguggcauuguccaccucagucuucucauggcuguggauucaaguuaagaaauuccugaagguagcauuccagguagucuguagaacagcccaaacucucugaauuaguauuaucucugauagguguuuuuuuuuucuuugcuuuuuuauuugagacgggguuuugcucugucacccagccuggauuucaguggcacaaucuuggcuuacugcaaccuccaccuccugggcugaaacaauccucccacaucagucuccugaguagcugggaccacaggcacaugccaccaugcccagcuaauuuuuuauauuuuuguuagagacagaguuucacuauguugcccagguuggucucaagauuccugagcucaagcgauguucccaucuuggccucccaaagugcugggauuacaggcaugagccgcugugccuggcccugguaguuuucuucuuauaucuuucuccuguugaucucacuugauuuucuuacuagucuacaggaaauuucacguggagauucugugccuguccucuuucuggaauaucuuccuuauuuuagcaucucaacaugcuguucagcuucuggcuugaaaccaccccucucccaucccaaccaaguuaagcagcuucuuuccugcuuagaaguaccauaacauguguauuaaucuuuuuuuuuuucucucuccuucccuucauuuuaagcuccuuuuuauuaaucuguagggcagagcuuagaaaaagguuuuuguauauuguaaguacuaauaaaauauuugugaaguugauuugggacuugggagaccucucuucuguaagcaacucaauaaauaauuauuuaaguaccauccucacccaguguacuguuagcugcuguuaugauauugauuacuguaaaauuuuaaaguauauccuugguagacuguugaucaaagucagaaagcuugagaaacucugaggcaaaaaaaaaaaaaaaaaaaaaaaaugaagagcaugaaaugauucugcaaacugaucuuacaaugaucuuucuuuuuuuuuuuuuuuuuuugagacagagucucacucugucacccaggcuggcgugcaguggcaggaucuuggcucacugcagucucugccucccagguuccagugauucuccugcuucagccucccagguagcugggauuacaggcacacgccacuacgcccggcuaguuuuuguauuuuuaguagagaugggguuucacuauguuggccagacuggucuugaacuccugaccucaggugaucugccugccuuggccuugcaaagugcuaggauuacaggcaugagccaccaugcccggccucuuuuuuucuuuuuucuuuucuuuuuuguacacaguuucacucuguugcccaggcuggaguauaguggcgugaucauagcucacuacauccucagacuccuggguucaggggaucuucccaucucagccucccaaguagcuaggacuauagacgugagacacgaugucuggcuaauuuuuuacauuuuuuauuuuuuguagaguuggggucuuauauguugcccaggguggccugccaccuuguccucccaaagcugggauuauaggcuugaaucagaucccagugaucuuuaucccucagcugcauuuauaugggcuaaauucauacauaguauaucaagaugucuucaggaaguuuaaaaaaaaaaagguaucaaaaagacaguaugucaugacugcuuuaucuauuuuagucucuuaguuuuugauacuaaagacuagaccggagaaaugcuuuaacaaaucacaaaaaucuaagaaaauagacaguuaauuauuuuuaaacaguggaagaauuucaaucauaauuaaagcagcuuuuguauuuuuugaugucauagccuauagugaaauuucauauauucuguuuguagauacaugaguuccuacgauaugcuugcacauaauagaacuaauuacuauuuguugagaaccuaaccuguaccuaauauacauguaguuucuaaaucaaacauuuuacuuuuuuuaaaaauuguaaaaagcccauaguaaauuaaucauguuuaccauuuaaaaauguacaguucaguaguguuaaauacauucacauuguugcacaacagaucucuagaacuuuuuugucuugcagaacugaaauucuguacccauugagcacuaauucccacuucccccuccccccaaauucuuggcagccaccuuucuacuuucuguuuccaugauuuuugacuguuuuagauacuuacaugcaugggauuaaacaguauuugccccuuugugauuagcuuauuuugcuuagcauaaugucauugagguucuuccauguuguagcaugugacagaauuuuuuucuuuucuguaaaggcuguauacuauuucguuguauguauagacugcauuuuaaaauccauuuaucuauugguggacauuuggguugcuuggugauuuggugauucacuauucaugguuagccaggaguaauaugcaguaaauguugguauacaaauaucucuuugagauccugcuuugaauucuuuuggauauaugguugcccauugaacaacacagcuuugaacuauguggauccaucuauaaguggauuuuuuucaaccagccauagauagaaaauauacuauucggcugggcgugguggcugaugccuguaaucccagcacuugggaggcuggggugggaggaucaguugaggccaggaguucgagaccagccuggacaacauagugagaccucaucucuacaaaaaauaaaaaaguuagcuaggugugguggcaugcgccuguaguuucagcuacuuaggaggcugagacaggaggauugcuugagccugggaggucgaggcugcagugagcuguuauucaugccauugcacuccagccagggcaacagaacaagacccugcucaaaaaaaaaaaaaaagaaaauacacuauuugugggaugugaaacuuguguauagggugggugggcuuuuuguauaugcagguuccauaggucagauuuggggguuugaguaugagugaauuuggauguauacaggugguccuggaaccagucuuauucuuccucuucuuuuuuuuuuuuuuuuuuuuuuaauuauucgucuuuuauuuuuuggaaccacucuucugcauaugcugugggaugacuguauauccagaauugugauugcuggaucauaugguaguucuauuuuaauguuuugaguaaccucaguacuguuuuccauaauggcugcacgauuuuuacaguccuacccacagugcacaaagguuucgaugucucugcauccuugccaacacuuguuauuuucuguuucuuuugguaguggccaacauaaugggugugaggugcuaucucauugugguuuugauuugcauuaacaauguugaguauccuucauguuuauucaccccaaauauuuuacuuuugaauuuauugaaaaucaugcauuuuaauuauguaaaacucaauaccaugcaucauuuguuaaaugggaaaaggagaauuuguccuuaugacuauuauaaaauauucuaauaaggugaaccuuuuuuuuuuuuuucuuugagacaaggucucgcugugucauccaggcuggaaugcaguggcgcagucuuggcuuacugcagccucugccuccuggguucaagugauucuccugccucagccuccugaguaguugguauuacagguaugcaccaccacaccuggcuaauuuuugcauuuuuauagagucgggguuucaccauguuggccuggcugguaauaagaugaacuuuauacuuuuuuuuuuuuuuuugagacagagucccacucugucaccuaggugcaguggcacgaugauggcucacugcagccuugaccuccugggcucaagugauccuccaccucagccucucagguaucugggauuacagguaugcaccaccaccccuagcuaauuuuuguauuuuuuuguagagaugggguuucgccauguugccccggcuggucuagaacuccuaggaucaagugaucucccaccuuggaguccccaggugcugggauuacaggcaugagccacugcauugggccagaacuuuauacuuauuaaacaguaugcugaugauaggaaaaaacugugcaauccuuauucauaaaauucugaucuaaaacguguuauauuaaaauuaauuaauaaugcaagcaaaauuggcaaauuuauuuguaaaccccauuuugggcuacuucgaaaauuauuuauggaucagaaaagguugggaaauacuuuucuagaguaauugagcaggcccuguagauggcagaaguguugcuugaacuggcguagaggaagaaaguguugaauugccccacuuaauuccuuaaguaauuuugccucuuuggagaauauuugccugaaauagagaacucaaguuaugcuaugaagauucuuuuugaaaaauagagacagggucucacauugcccaggcuggucucaaacucgugggcucaagugacccuuucaccuuggccucccagagugcagggauuacaggcaugagccaucaugccagaccaagaagauauuuuggagggcuacaucccaccaguagcuugauguuguacaaagagugguaggcucugggcgaggcucugccauuauacuaguuguauuuccuuggcacguagcuuuuguggaucucuccucuucauggugacaugaaugagaugaauaaauaauggaacaacuuguguuuacugaguaucuaccauguaugugccugcagagaggaugucuucauuuugcagaugaaguaauuaguaaauaacuugccuagguucccucagguagugggcccuugaagaaugggcuuuuauggccaagugcauuggcucacgccaguaaucccagcacuuugagcggcugaggugggaggauugcuugagcccaggaguucaagaccagccuggacaacaaagugaggccccauuucuacaaaaaauuagccacaugugguggcauuugccuguagucccagcugcaugggagagugaggugagagggucgcuugagcccagaagguagagacugcagugagccguguuugcaccccugcacuccagccugugugacagagugagacugugucuccaaaaaaaaaaaaaaaaaaaaaaaaggcuauugcugccuauaggguccuuuuuagugcaaauacuaggauucuaagcacuugguuucuguuacccaggucaaacuauuucuuuggagaguuugauuaccaucacaggugaugguaagauucucccuagcuggcauuuaauccagugguuauaugcaucuuucccaaauucuuuaucaaguuggucaauucauagaacaucuaaugcugauuauaagccuauuaucuugcuugugucucugcacuaugggcauaauagcaccuaaaagcuuuugcuauaauggacuaugauguaucugaauaaauuaccuuuauaaacaaucaaaucuaaauuggcaaguucaaauuuacccaauuuuucuuauagaauuuaccuuugcaguuaaagaaauaauuguuuuuuaccauuugucuaguaugacuuguuauuuacaaauagcauguaacuggccagcuguacuauacacauuuucuagaaaagaaaauuucuucaaauuucuuauugggugccuuagucuuuuacccauuagggcuauucaaauaaagaaugagauauucucuuauucucuagaaagagacauucuauacuaauggaaauaccaacuuuuaaaucuagacuaccaaaaaaaaagucauguuuuucuacccuagaggcuauagauucuuaaugucagccacucauccuggcccucucauuuucuucuuuucccauauggaaguucuagggugauauaguuuggcucuguggccccacccaaaucacgcgucaaauuguaauccccaaaguuggaggaggggucuggugggaagugauugaaucaugggggcagacuuuucccuugcuguucuccugacagugaguucucgugacagugaguucucgugagaucugguuguuuaaaauuauguagcaccugccacuuugcucucucuucccccugcaucagccacguauaaugugcuggcuuccccuuugcuuuccacugugaugauaaguuuccugaggcuuccccagccaugcuuccuguauagccugcugaacuguaagcaaauuaaaccucuuuucuuuauaaauuacccacccucagcucuuuauagcaaugugagaauggacuaauacagaaaauauguaccacagaaguggggcaucacaauaaagauaccugaaaauguggaugcagcuuuuggacugaguaaugggcacagguugguacaguuuggagggcucagaacaagacaggaagauaagggaauguuuggaacuuccuagagacuuguugaaugguuuugaccaaaaugcugauagugauauggacagagauggcuaggcugaugaagucucagaugaagaugaggaacuuauuggggaacuggaguaaaagucacucuugcuauguguuagcaaagagacuggcagcauugugcuccugcucuagggaucuguugaacuuuaaacuugagauguuuaggguaucuggcggaagaaauuucuaaaagcagcaacguguucaagaaguggccuggcugcuucuaaaagccugugcucauuugcauaagcaaauaaaugaccugaaacuggaacuuaaauuuaaaagggaagcagaacauaaaaguuuagaaaauuugcagccugccaugugguagaaaagaaaaucucacuuucuggggagaaauucaagcuggcugcagaaauuuacauaagaggacgauacaugggguaaaaugcuuuuuccuccccuaaaagccuugguauuaaucuggaaauagcaggaagguaacuguaggaauuauauaauggguuucccugugcuuggucaugucuuuguaucauuuccauaggucaguggagacucagaaaaccaguuucucugggcuuuugauaaguaauguuauaguaaucaacagaugguaacuuucgguaaaacaaauugucuucaucuguuuugugcugguauaacggaauaucugagacuggguaauuuuuaaaauuauuuauuuauuuauuuuugagaugggaguuuugcucuuuuugcccaggcuggacuacaauggugcgaucucggcccacugcaaccuccgccuccuggguucaagugauucuccugccucagccucccgaguagcugggauuacaguugccuaccaccaugccuagcuaauuuuguauuuuuaguagagacaggguuucaccauguuggccaggcugguguugaacuccugcccucagguuaucugccugccucggcuucccaaagugcugggauuacaggcgugagccaccacgccuggccaagacuggguaauuuauaaagaauagaaguuggccaggcacaguggcucacgucuguaaucccagcacuuugggaggcugaggcggguggaucacuugagguuaggaguucgagaccagccuggccaacauggugaaaccccaucucuaccaaaaaauaaaaauuagccgggugcguugaugugcaccuguagucucagcuacuuggaaggcugaggugggagaaucacuugaacccaggagguggagguugcagugagacagaauuacgccacugcccucuagcccaggcaacagagugagacccugucucacaaaaggaauaaauauauauauauaugcauauauguauauauauaugcauauacguacauauauaugcauauacguauauacguauauguauauguauauauacauauaugcauauauauuauauauaauauauaguguauacaauauauguauauacguauauauauguauauauguauauauauguauauacguauauauauguauauacacauauauauguauauacguauauauauuuuucacaguuuugggggcugggaaguuuaagaucaagguaccugcaucucaugaaggcuuucuuacuguguccucuuauagcagaagauagaaggggcaagcugggaauaacucccucagucagacucuuguauaagggcauucacaaggcaggaaccgucguggucuaaucaccucugaaaggccccaucucuuaauacuguuacauggacaacaccugaguuuuugagggacaccuucagaccauagcacagauacugacaagucucaucaauuauuaaguaaauaguacuugaaggguuugaaauuuuguaguaccccggcaguguguuuauauuugugauaaauuuuaaguauaggaaaaucauggaaagacuuacugcucauaacugccguaccucguuuaccucuaucuuucccuaaacuacuacuguucuuagcaagaucaugaacuguggggccgacauaagccagaggaguuucugaagagucugcuucagugagggguucuguugauagccauagaauaaagaaauggcacuuugcagacauugguacuuccuugaaagaacuggcuguggcauauacagaacucaaaaauugaaauuacuagauaaugguuacuugguuuagauugccuggaaauuaugagagguucuguaaaugcuuugggauuaguaguuugaaccaccuaguccauuuuaugauucugucuucagaauauagaaggaauugcaucuuauuuggggauuaggauauaaaguuaguguacaaggcaaaauagcauguaggcaaaguuacccaugcagaguuugugggaagaugccuuaccacaaaccaguaccuucuuuuuagguucaagaccagcccauuuuuccucuagaaugagaacagaucauugcucuucuguugagcacagaguuguugguuuguacuuaagggcaauccuguuagaaucacuccugaguggcuaaauaucuucagucugagagacuuguccagcagguuaugggaacagcagauucaugucaccugucucuugcucacuuaggcaaacgcuuagugucuggaaugguggguagaacccuuguauuuacuaccaaaauugagcuuucucugacauuuuugcucaauguauguuagauuuguguaaguuaaauuagauguuggcuuaugcgugguauaagauuuaaaauagacuucuuagcaaaaagaacaccugguaucagauugacuuaccccuucauuuuguuugcuuuuauucagugaaguguugaaauaacagguaucucaugucucaucuuugaauuauaaugaauuuuguaucauagcuuuaguuucugguacuuuuuuuuuuuuuuuuuugagacaagucucgcucugucacccaggcugaagagcaguggcgcgaucucagcuuaacgcauccucugccuccuagguucaagcgauucuccugccucagacucccaaauagcugagaucacaggcaccugccaccauacccggcuaauuuuuguauuuuuaguagagaugggguuuuaccguguuggccaggcugaucuccaacuccugaccucaggugauucgcccgccuuggccucccaaagugcuaggauuacaggcgugagccacuuggccccagccucugauaccuauuuuuuuccguuuuuccuccaacaguguuucuguaaacugaguauauacucgaugaaaugagaagauuuaacuuauaaaaucgauuuaguauaguuuucaagaaaaacuuaaacuuuuuuuuucuuuuuuuccuuuuuuuuuuuuuuuugagacagucucacugugauugcccaggcuggagugcaguggcacaaucuuggcucacugcagccuuggccuccugggcucaggugauugguucucccaccucagccuccagaguaucuuggacuauaggcacaugccaucacgccuggcuaauuuguauuuuuaguagagacaggguuucaccauauuguccaggcuggucucaaacuccuggacucaggcaaucugccugccuuagccucccaaagugcugggauuacaggugugagccauggcccccagcugaaaacuuuaaccuuuagaugucaauucaguuagugagucuguuuuaucuguuguucaagcaaauucuuuaaaacacuuaaaauaguucaguucuucaguugguugaaauuuauauggccauuucuuuucuaagcaguacucucagauaaacaccagaaugcuggucuauggacuucaguuugaaaucaauaguuuacugucuugcuggaaggaggaaagugaucuuacuguuguggaaaauauaucacugcagaaucuacucacuuuugcugcaacggucaaguuaauguuuucuaucauucagcuaagauugcuaaauuaguauaacuuuccuuugccuuugaacuuuuuagcacuacagaaaccaggacuacaaauauguucuuuacuuuuuucuguuauuuuccccuaucaugagacuucuugaaggcgaaugcuguucauuaugcuuucucaucuguacuuucauguacauguaauccacuguagugaaggcacuaaaaccuguuguauuuuccacauuucgauagaucucucacaggauuuaacacuuuuggaaugcucaguaaauuauuauugacugcuugauaauaccucuuuguuccugccuuuccccaaguccuucaacagaaguuucuucuagcacuuugcaggucaguugaguggacuauuugagucccucacaguaaugagcuuguguguuuuugucauucuuuuuucuuuuuuugaaaaaacaauagagucauuuaaggaagcaaaaaggucccugggucaagauuuuuauuuuaucuuuuauggugguagggugaggugugaguauuuagggagaugguugguaggauggcguugucuuaggguugcaggaggaucagaagggugacuguaacuacugaugauaucuuacaguggugaaggagaagauaagugaaaacagaggcaauuuguuuaaacgaauuuuaguagauauuagucucuuaauuuggcacugacauaugacagauuauuucauuuaaauucuguaguuugacagguauaauaaaguacccuucauuaaauauucuucacauauacucuuguuugccuuuuucuaguugcaagaguggugauuucuauguuucauuauaaauuuuagaaauauauaauuugaauauauugucuguucuagguucucugugagucaagaaaaggcaggguauuaugacuucggauucguaugaugucuggauauauuuaaggggagcaguucucaaaguguggccugggauuaugggaucaaaacuauuuuuucuuucuuucuuucuuuuuuuuuuuuuuuugagacagggucucacucugucauccaggcuggagugcaguggcgacaucuuggcccacugcaaccucugccucccagguucaagugauucuugugucucaaccucccagaaacuauuuucauaauaauacugaguuguuccuugcuuuuuuuuaaaaaaacaaaacaaaacaaaaacaaacaaaaaaaccauguuggacauuuguacccacggugcaaaagcaaugaauaaacacuguuggcaccuuagcacuugcaguuaaaaaagccaguuuuguuugagaauguccuugaugaaguacuaaaaaugauuaauuuuauuaaaucuugauccuugcgugcaugcaguuguaacauucugugcaacaagaugggaauguguguaaagugcuucugcugcauauugagguauguuggguuuugagcaaaagcacuuacgugauuaaguugugagcuccacuagccacuuuuuucauggaaauuucauuuuuacuuaaaagagggucugacaaaccaugauuauucagacuuagguauuuggcagacuuuuuuuaaaucaaugaagugagacugucacuucaaggaaaacaacugaccauauuuguuggcagagagaacauuugggcuuucaagcaaaaauuaaaauuuuuggaaaacuuuugucuguuacugugagcaugacagcuucccaguacuuaaagacuuucugaugagauuaauggguuuaacaacaugauuuuuugaaauaugccaacuucuggaaaaucugcguaacucaguggaccaguacuuuuuagaugaggaaugaugauuuauaacauugugccugaguuaaagauucauuuaaagugaauagacuaaugaauguuaauguggcagaguaggaaaaguucacugauacaauuucggauuccauguugcaucuaaucuuguaagaaagaaauuaccacugcuaacugaaguauggugguuauuuugaggaaaagcaccugugagauugaguugugaacugaacuagccacuuuuuaauagaacuguuuugguguaauaucaaagcacgagauccacaaugaccucagaaggcuauucaaacacucucccuuuucuaagcuaaguauguuugagacuggauuuucuucauauacuugaaccaaaacaacauauuggaacagauugaaugcagaaacaguuacgagaauccguuuccuauuagacagauauuaaagaaauuggcaaaaauguaaagcaccacuuacuaauuaauuuuuuuuuuuuuuuuuuaaauaaaagaaggcuauguugcucaggcuggucugaaacuccugggcucaagugguccuccugccucagccccgcaaagugcuaggauuauaggcaugagcaaccacgcuugcccucacucacuaauuuuuuuuaaaggaaaauaaguuucuuuuuaaaaauguguuauuuauauuagguacaguuggcccuccauauuuucagguucagcuucugugcauucaacaacugcagaucaaaaauacuuguggaaaaaagccaauaaaauaauagaacagggcgggcgcuguggcucaugccuguaaucccagcacuuugggaggccaauccggguggaucaccugaggucaggaguucgagaccagccuggccaacauggugaaacccugucucuacuaaaaauacaaaaauuagcugggcaugguagugugugccuguaaucccagcuacucaggaggcugagacaggagaaucgcuugaacccuggaggcggagguugcagugagccaagauugcgccacugcacuccagccugggugacagagugagacucugucuccaaaaaaaaaaaaaaagauacaaauaauacaguauaacaaggauuuauauaacauuuuacauuguauuagaugaucauaaguaaucuagagccagaugauuuaaaguauaaaggagaaugugcauagguuauaugcaaauacugugccauuuuauauaagagaugagcaucuguggauuuugguauccaugaaguuccuggaaccaauacccccuagacccccauggauacugagggcuugcuauaacaguuuuuaauaaaaauaaaaaacaggccagguguaguggcucacaccuguaaucccagcacuuugggaggccaaggugaggugauuguuugagcccaggaauucaagaccagccugggcaacauggcgaaacccugucucugcuaaaaauagaaaacaauagccagacaugguagugugcacauguggucccagcuaccugggaaguugagaugagaggaucaccuaagcccaggagggcgaggcuguagugagccgugauugcgccagugcacuucagccagggccagagugagaccuugucucaaaaaaauaaaauaaaauaaaaguaaauuguaaaaaacucuuuaguuuuucauuucuauuauguuaaauguuaauagcuauaacacauauaaacuaaacaggucaugagaccaaaaugcugaagaaugguguuaaugguguucuuacuuacuuugaauuaccguuuuuauuuuucuaugcuagcuaauuacuaugugaauaauuaaccucaaugaaguucuguauucucuguuguagcaguggcugauuuagggcucaguugucuuuugaccuguucuuccuucucauaugauugcaucucgauuuuuaauuuuagacuuaguuuuuaauucuaaaauuaaaaaucuuuuuuuuuuuuucuucuaugcccacugcugucaacccagucagggcccuuaucacuuuauucuugaauuacuucaguucuccauuuuuuuucucaugugguguuuuucaaacuugaguguugauuggaaucccaggguuaauucaacuuuaauuuuaugaauaugauuucauauaaguuccuuaugauaaaaccagagcagauuuacaaauuaaauauagaccaucaaauuagcuguacauauuuaaggaugagauuuuguuaaaaccaaauagucaauguuagagcuuauagaauggcauagccucaggaucagcuuuauaaucaguuuuuuuaaauuuggcuugauaauacuaacagagaauggcuauuugcauaaauauguuuuauaaaaugguguuaacuuuuagucuuuguucaggauaaugagaccuacuaguuaaccagaacggggccagcaagcaacucuugaaugcuaguuuuaaugccugaucaaaauucuguaaagcuguguugaucacugaggcguugcggauauacugagccugcauuaaguggauauuuaaucuaauuauuucuggaaucuuuaccagaaaacaugcucuuacauaguuugcuccuggguuugcuguuggugaacugccguugguuggugggaucucugugucccaugggcuuugccacacagcuggggcucugaguacuucagcucacauuccuuuguuugccacccuugccuuaacucacuuaccuguauuguuuuuucucccauagcacucaacaucaucuuacauguaaacauuuuacuuuguuguuguuguuguuguuguuguuguuguuuuugagacagagucuugcucuguugcccaggcuggugcaguggcacaucuuggcucacugaaaucccugcuuccugggcucaagugauucucaugccucagccuccuuaguagccgggacuacaggugugugccaccacuccuggcuaauuuuuguauuuuuaguagagacgggguuucaccgucuuggccaggcuggucuugaacuccuggccucaggucauccaccugcuucagccucccaaagugcugggaucacaggcaugagcuacugcaccugacacuuuguuuuuaacuguuucuguccaacuagauuuuaagcuguauaagggcacagauuuuuaauuguuaauugcuaagucuucaguuucuauuguagucucuggcuuguauuagaugcucaauaaauauuuguugacuuaaugaaugcauauuaacccuucuuuucuuuauucaacugcaaacucaaauacucuuuucugaguugugugcucucacuguggguaaagaccaguuuuucucuucauuuuaaacacaacuaaacuggcccugaauuguauagaauccuuuugauuuguuguuugaucaguacaaguucagucaguggcacaguuacuucccuugauucagauucuguagaagccuaaaagugcauuaucucuucaaguagacaugucaucauauaggcugcuauggagaucuuuuuuuuuccuuuuaaauuguuuguguaacaguuucuguuuuaaaacaguggaauuaccagccuggacacuauagugagacacuuucucuacaaaaaauaaauuaaaaaaaauuagcugggugugguggaguacaccuguaguccccagcuacucgagaggcugaggcagaaagauugccugagcccaggaauuugaggcuucagugaguugggauugcaucacugcacuccagccuggacgacagagugagaccuugucccuuccaaaaaaauugaaaaaguagaauuauauuugggaguuuuuuuccucaaauuccuuugaaguuaagauuuauaaaaguaugggaggccaagcugggauuaucauuugggcccagauguuccaggcugcagugagcuacggucgggccacggaacuccagccuggggaacagagugagcccugccucaaaauaauaauaaaaauaauaauaauaguacaagcucucuuaauuacuaccuguuuuuuuuuugagacagagucuugcucugucacccaggcuggagugcaguggcgcuaucuaggcucauugcaagcucugccucccggguucacgccauucuccugccucagccucccgaguagcugggacuacaggugcccgccaccacgccuggcuaauuuuuuguauuuuuaguagagaugggguuucaccuuguuagcaagaauggucucgaucuccugaccucgugaucugccugccuuggccucccaaagugcugggauuauaggcgugagccacugcgccuggccacuaccuguuuuuuuuuuuaauccuauguuuuuaaauaauucuaaucaucuauucauauuuuuuguuucuccuauuuaacauuuuauguaacauuuuuagauuuuaaaauuuguuucuguuaucacuucuaaaagugaauguuauuuuuaaaaaugaaugccuuuacauuggguuguuauguaaccuaauuugcuuuaacaaauaacuuuauuuuggaguaauuuuauuuuuaauuauuuauuuauuuauuuauuuauuugggacggagucucgcucugucgcccaggcuggaaugcagaggugcgaucucugcucacugcagccuccaccuccuggguucaagcaauucuccugccuuagccucccaaguagcugggauuacaggugcucgccaucaugcccagcuaauuuuuguauuuuuaguagagacuggguuucaccauauuggccaggcugcucuugaacuccugacuuacgugauccgccugccucagccucccaaagugcugggauuaacaagcaugagccacugcaccuggccuauuuuggaauacuuuuggauuuauauagccaugguauauuuguuaaaacuaagaaaucaguaucaguauguugucauuaacuaaacucaagacuuuauuuggauuuugccaguuauuccacuaaugucuuucuuugguugguugguugguugguuucaggauccaauccaagauaccacaguucauuuaguuaucaugucuccuaaguuuuucugaucugugguuguucucagcauuuccuuauuuuucaugaccucuuaaucguuuuaaaguguauuggucagauguuuuguaagaauguccuuugauuucggcuuaucggauguuuucuuaugauuaggcugaaguuauggguugaggucugggggaaggauaccacagaggugaaauccccaucucauuucaucacaucggggaguacauaaugacagcaguacuuaccauugcucauguuaaugguuaugguuuuuuuucacagaaacauuacuguuucccuuuccagacucuucuuuggaagugaaucauugaaucuagcucacgcucagggggaaggaaauugaauucucccucccagaauggggacauacacucauguaucaguuggaauucuugucaggagaguuguuccuucuccuccaguuguuuauuuaaucacuuauuuauaucauagacucaugaauaauuauuuuauucuguuauaauacuguuaugauuuacucugcugcucaaauuauuccagcuuuggccacugagaguuucuucuguuugcuuccagucucggaccuauccgucuccuuucaucuuuggagcauuucccuucuucuacuggcuugccuuguaguuucccugucccaacccuagaaucagcuguuucugcagacccugcuuccuuguauuuauuggaaggugguauuuagaaacaaaagucuugggugcaggguaugcuuauuuuauugcuccuggggugucacugcuuccaggcccucuguuggacagacccuggaaaugcagguauuucagcuaaccugcaugugcauacauaccuacguuucuguaucuauccgcauauauuuuaaaauacacgugaguucauauugauauaucugacuaauucaucaccaccucuugcuuauuuguaacuucuuucugugacauugagaaacuuggcacacauuaucuacauuuuauuuacuuauuuguuuaacccuaguguacauguagaguauuuucagaauuacagacugguacccuuaugagaaacaaauuuaccagcuagaguacagaguagauuguccaaaguucuguagauuagcuccccccgaccuccugcuccuuccaugagauuaucucauaaaauuauaauacuguuagacuugcuguauaguuugcauucuauccugagauccccugacauccuguuuuguuuuuauuugcauacaguuuaccauuuaaaaaaagucuuuauauugaguuguuaacuuuuuaauauaaauguuguaauuccugauauuacucaucugccauuuauguaguugauagucacuacuuuuuuuuuuuuuuuuuuuuuuuugagauggagucuugcucugucgccuaggcuggagugcagugacguguucucagcucacugcaaccuccgccuccuagguucaagcgauucuccugccucagccuccugaguagcugggauuacaggcgugcaucaccacgcccggauaauuuuuguauuuuuaguagagacgggguuucaccauguugggcaggcuggucuugaacucuugaccucaugauccaccugccucggucucccaaagugcugggauuacaggcgggagccacagcgcccaccugauagccacuacuuuuuuaaugcugauauagugcuuaccaucugucaggcacugucuaugcaccguaaauaaauuuacuucucacaaugacucugagguggaggcucuugaauuagccuuuuuucaugaggagagugaggcacaaagaugugcaguaacuuggccaacuucacacccagcugcuaagugggagaacuuggaucugaacccagggaaugagcuuuggaguccaaacucuugcuuuuuguuuaaugcuguguauaggacuuagaauuaauacaacuaacucuucucuuauuaguuuaguuuauuacuuggaauuuggugugaaauagagagugcugcuaccccaauucuuugccccauguguguaacaggcauuauuaaucaugacagcacucucucugcugagcuagaacauggccuggccuaaggccaauaauccuuauggacacaacccucaaagugguuguaugagaugaacucuccuugccaucucugaucuugucuguuuugaauccugauucuagugcccagugcauggcacugcgugccugcuucuccuggauuccucucucauggucuuccuuuuuacagggacagguuuucuauauucccccucaggcauaggaucuguuucucuuaaguaauuaauuuuuaucacuuaccaauaauuuaacaucuauaugucuaaguucucuuuauauuguuuuucuuauccuuaccuacaaaaucucauuuaccauugauuuaaauuucaguauauugaaacaauggauuguaacauuaaaaauaaaugaaauugccaaaugauacuaacagcugccuucaaagcauuuaaacauacaaacaggcacuauugaagacuggagaguuaucaaaauuggcaauuuuuuggcagucuugcugugaaguaaacauuuuuaaaaggaaggacauugagaauauuguaaucauauuacuuacaucuuguuggguuuggauuugaccuuacauagccugguauucaguuaagagucaaaguugcugcuauuaauuuaguugagaaggauaaauaguacauguaguuuauuguuuucuuuagagaaauagaaacagaaacauuuauuuggccagaccaaauagguggucauucccuugauuuagcaaauccuugagguagaauuuuuuuuuuuuuuuuuugagacggagucucacugugucgcccaggcuggaaugcaguggcacgaucucggcucacugcaagcucugccucccggguucacgccauucuccugccucagcaucccgaguagcugggacuacaggugcccgccaccacgccuggcuaauuuuuuguauuuuuaguagagacgggguuucacuguguuagucucgaucuccugaccucaugaucugcccaucuuggccucccaaagugcugggauuauuggcgugagccaccgcgccucccgguagaauuuuuaaagaagcaauaagggcucugacaauaccuaugggacuuuuuucaaauuauucaguuauuggcagcuggguaaagagggacaggaaugucugauuuagguaaauaccucucacaaguggaguaggggcguaucugguagagaacagugcugauuccuuggacuuguguggccuggccaccugagagguagguaggaaggugugucuuggccauguccuggggccucuguaaaccugagaggauggaggaagcucuacuuuuucugacgaugcuguuggugauaaugaaguaggcuaugagagcccaucuuccauuaauucagauguuccuauacaguuggcccucuguaaaugggauucuacauuuguagauucagccaacuguggguaaaaauacuugaaaagaaacaaaaguguguguacugaacauguacauacuuuuuucuugccauuauucccuaaacauaauaguuuaacaacuauuuauguaauauuuacauuguauuagguauuuaguaaucuagagaugguuuuaaagcaggggucccuaguccccaggccguggacugguacccgucuguggcccguuaggaacugggcuguacagcaggaggugagcuccgccuccugucagauuggcagcagcauuagauucucacggaagcgugaacccuauuguaagcugcacacgugagggaucuagguugcacacuccuuaaaagaaucuuuuuuuuuuggagacggagucucgucucacuguguugccuaggcuggagugcaguggcaugauccuggcucaccucaaccucugccucccagguucaagugauucuccugccucagcuuccugaguagcugggauuacaggcaccugccuccacacccagcuaauuuuuguauuuuuaguagaaacaggguuuuaccauguuggccagacuggucucgaauuccugaccucaagugaucugccugccuuggccucccaaagugcugggauaugagccaccaugccuggccauccuuaugagaaucuaacuaaugccugaugaucugagguggaacaguuucauccugaaaccauguacccucuccccucuuuguggaaaaacugucuuccacaaaaccagucccuggugcaaaaaaguuggagacugcugguuuaaaguauaugggagaauguguauacguuauguaauaguguaccauuuuauaucagggacuugagucuucguggauuuugguaucuguuggggguccuggaacuaauccuccguggauauggaggaacaacuguauauauggucucaguaauaaauacguaucugagauacccucuguauuaagaaaaaaaagaugggaauuucuuggcucauauaacugaauaguuccgaaauuugggaaggucugccugacuuagggcuuaggucaugagacuacaguucuuucuuggcuuugacuuuuguuuuuuguaguuguugacucuguucuuugaggcucuucuccaagauggcuuccaacaaguccuugggcaaacauuuuuccagguuuagaccuaaggggagaagagugagcauucuuguccuagcauugcaggaaaccugagauuuucacugugacugcacugauuguggccguguaucuaacccuguacuggucacuaugucuagggagauguaccuuggucaggccagggucacaagcagcuugagucagcuuccuccaguguacuugguaguucucagagaagaguuggugugaaguucccaagagaagggugaauugacccuggguggcaaaaacaacauagcaucuacucuagugggauaaaguaagaugguaaggcaugguguucaggguauuucugaguuugguuugauucacaaaauagauugugaacacuguaauugcccuuaauuuuaguuaaccuauguaaauguaaaucugugaggugucacuacauucugcuaaagcuuugaugggcuccugccauauucugguuuggcuuuuguauuaaagagccauuguuguuuugguuucacuguauacagguagacuuuuguuuuaaugaauagagguauaaucuguuuugaacaggaaaagcugcuuuuguauucuggauaaaguucauacuagugggauuucaccuaugaaacuaaacaaaucuuugaaaaauuuaaaaaccauauguauuuacacaguguccauucaguagaagucguuuaaauaaaggcuucugccaauauaugaauauuuagagcuguauuuuauuauuuuacuuuuuuugagacagggucucgcucugucaccuaggcuggagugcaguggugugaagacaguucacugcagucuccaccucacaggcucaagagauccucccaccucagcuuccugaguaguugggaccacaggugugcgccacuacaccuggcuugcuugcuugcuuauuuauugauuugagaugggagucucacuauauugccuaggcuggucuugaacuccugggcucaauccuccaaccuuggccucccaaaaugcuggguuuacaggcuugaaccacuguacguggccuugaaucuguguuuuaauacuaugcuuacuuggcugugguguugugaaaagaucacugaaaauggagucagaggccugauuugagccagucguuuguugugggggaaggaggucaggggagcuaacaucuaaaggcucacuauaugccaggcacagaaccaaguguguuugcauguauauuucguuuuuguugccagacuuugagguagguuuuauggauaaggucuuuaaggcaauaucagcuuccuuuuaaaaaagaaauuccggaaacugaguuuuaggcugaagaucucuaacugguaguagggacaacugaaccacaggguccuaacugacccugcgauuuaucuccuuuugcgggggguuucuugauaauagggugcacuuuaccucauuuuuuggcucaagcauggauaggccacccuuccuuuucauaccuauagcuaagcuuuacaaaugauaugcugauaagauacaagcuacucguuauucauguggguuaauagaccuguuuguuugcuuguuuuuaagucuauagccgccccacccccaaucuacaauuucaccuucuaagguuuuaguuacucauucaaacugcagucugaaaauguuacgauauuuugagagagagaagacucuagcuacguaacuuuuguaacaauauauuguuauaauuguucauuuuaccauuaguuauugcugucagucucuuacugugccuuauuuauaaauuaaacuucauggguauguacguauaggaaaaaacaugguauauuuagaguuuaguacuaucugcagcuuuaggcauccgcugugggguuggcggggggcggucuugggagauaaguggggacuacuguacaauuaucaggcacacacaggcucugggauuuuacaaaugaguaaaagugguucuugcuguugaagcacuuacagugggaauagagugaaauacaugaaaaugugauuuuaauauguuauaaaugcuaugauggugggaguuuguuuuguguaaaacauccuuuuaauugguacuuuaaauuuuaauauucuuucacaggucuaccuauuuagucuuacacuuucaaagaacuaccuggaugcuguagauuuucaugauauacuuuauuagguauguuauuaaugguagaaacagcauggaaagucuuccagaauauuagacaaggacaguucuaguacuaaaacauaaaaugcuaacuaaugucuucaucaagacauaaaauauguaucuuaaaaaauaaauuguaagccaggcgcaguggcucacaccuguaaucccagcacuuugggaggcugaggcggguggaucacaaggucaggagauugagaccauccuggcuaacacggugaaacccugucucuacuaaaaauacaaaaaauuagccuggcgugguggcgggcaccgguagucccaccuacuugggaggcugaggcaggagaauggcgugaacccgggaggcagagcuugcagugagcggagauugcaccaccgcacuccagcuugggggacagagugagacuccaucucaaaaaaaaagaaauuguaauaacacccacauuauacaucagugaaaacuaaacacguuacuacccuaggccuuauugcacaggggugcuaccuccaaggagaaauuugucuaggcagcagauggacuagaggugauuagccuaugagcgaaugaggcuacagaucauuccuuuuuaucugauuccuuuucuuucuaguuccuaggccuuggaagcacuaaguggucuuaaguaauuugcauagaauuaguugaguucaucuguuaacuaacuagcagauaggaagaaaacuauugucaugaaauuauuuaaaaaauaauaaugcuccaguuucuucucaucuuugauguccuuugguccuaccucacugccuuccuaacaccauuuucugcuuuaccucaaagcuggggucaucuugaguuuagccugcuuaauccgagugacugucagcuuuauuccacuuuagcaacucgcaggcaaggccacacuuggaaacuuuucacuuggaauaguucuaucuuggugauuucaucagccuucuuuaugucaaauacacucaaauuccugcccauucuuaucucuucguucccuucagguccuuaguccuuuuaauuugugacuuucauucuccagguccauucuuauuaaaugucugccagccagacuuuaguugcccccuguccagcuuucucuugcucagaccuaagauuucuuuagguucuuucuuugccuuuugaaauccagcucagcuuuuaagauugaguuccuuguuaccuuuccugccauccuucugcaguuccuaauauucuuuucuuucucccaaagugcuuuuguauaaacagucagccuuccauauccgugaguuccaaauccauggauccugaauucauggauuuaaccagcugcagauaaaaaauauucagaaaaaaaaagaugguugcaucuguacugaacaugucuguacuguuuugcuugucauuauuuucuaaacaauacaguauaacaacuauuuacauggcauuuacauuguauuagggauuauaaguaaucuagaggugauuuaaaguauaugggagucucuuauaucccaggaagccagguaaaaaaaaaaaguauaugggaggcuaugcauaggugauaugcaaauauuacaccacuuuauaucacggacuuuugagcaucuguggauuuugguauccgagggguguccuggaaccaguuccccagggauacugaaguaugucugucuaucucauacuauauuuuucccuuugucuuagguagacuaucagcuccauaggggcaaggauuuaauaauauuuguauauucauuuuauucaaguucguauacacugcuugggucauaauauuuauuacaugcuugagaaaaugaauuucuucgccccuuuguuacagcucugaguaaacagccaucugccuucucugucaucuguuggugguugaguauuucuguagaaaguuacccauuggccucaggacucuuacucuaaaucuucuucuuaggcaguuuucucugugcaugaaguuuuuauguaaacaaauagaugaagccugcccuacucauuuauuugcucaagccagaaagucaccuucuucuucacuuuccauauuuaaaucaucauuugguggaauuuuggccuaagcaacucuugaauucacguacuuuucccugucaucgccagugugguguagaagccucugucaccccuugucgggaugcugugcugcagcaucaucuaaccugguugcaguuauucuuucacucccucaccgcacacccuuuuacuuaaaacacuaaaaguggcuucucauuguucuuaagauaaagcacaaauuguuaguguggccuguaaagcuuugcauagccugacagagaauguccugcuaauaauuugaagguacaggaugauuuuaauacuuuaggagaaaauguucuaggaaaagacgcuuguuuagacuuaaggugaggacucugcaguaugaauuagacaucuggugaacuauaagcuguccccgcauuuaaacauaauugguucugagagccugcaacuaaagauaaggcagaagaauuuacuuugcauuuccugcauuccucuuuucgcuugauagcagaaaccccucauguuaauaaagguggcacaagaggcaaaaauacagacuuuaucacaguguuuaaggagaggugcaugauuaaguguguggggagagaguaccuuuguacauuuuauuauauggugaacuguauguuuucuacuuuuaguacuguuuguaaauuuuacuucuucuuggauuuaccuuuuucaguuauauuauuccauuaugccuugcuacuguaacagcuaaugaugaaaaacaggaucugucuuuauauuuucuucccuccacaaauguggaucucauagaguugaaaacuagguugugauauaguauaguauaccuaauuccuguaaugggaucauguuccuauaauauggccgcaauuuaguguagaauuuuuguaaauaaaaguguauuuuaaguuuaacuuaaacuuucaaugaaguguuuuaaggauuuaaccaugcagcacaaaugagcaccuuucuguaaaugccaacaguguaauaugugucauuucuucacugauuguuaguuugcugcggauuaaaacacaggugaucauauucaggcugguuagauuagugauuuuaauaugaaaccauugcuuuuagaauaaucaugggccagacugggaagaaaucugagaagggaccaguuuguuggcggaagcguguaaaaucagaguacaugcgacugagacagcucaagagguucagacgagcugaugaaguaaagguauaauuuuaucuuuugugaaaaugaauauacaauuaaggauagguuuuuuccccuccuaaguucaauaaguuuuuauuuaaaauaauucuagccaaguuuguauuuacaauaagaugagugaauacuuggaagcuuagguucuugaucugucuuaacauuauaccaugcacauuaaucagucuuuguuuaguauacuuuuauuugcauaugcagcugcagaaaugccucccuaaauauaaagggaugcauuucaugauuuuauguuucuaaagucauugugauuaaaaaaaaaaauacacacacacacacacacacacacacacacacacacacacacacagucaacaaagaaaggauggcaaucguuuccuguucucuaaccacuugcaauaaaauaacagaugugguguuuuuguauuauuugaaugugggaaacuauaguguaaaaucuauaugcaccuaagaaaauguucuugauauuuuugaggauacacuagauuuuuaaccugcuuuacagguguuauacauuuucuaacaaugaacaauuucuccuuuccucuccuucauuuuuuuuuuuaagaguauguuuaguuccaaucgucagaaaauuuuggaaagaacggaaaucuuaaaccaagaauggaaacagcgaaggauacagccugugcacauccugacuucugugagcucauugcgcgggacuagggagguugguuaacauaacauguuguaguaauuaucaucaucuuuugguuuaugcuauuggaacauuuguuugguuauugggaggaaaucauugaccucaggguguccaucuuuuuauugcuauuucuuuuuaaugugcaacuguuaaugacugcuguagaucacacuauuagcuauuccuauaacagaguucuaaguguuuggaauauacuuugaacuagguagaugccuagauuuuauaagaauguugauuuaaaaaaaaaagcuuuuaaaucaaauacucuuuaauguccucaucagaucacuauuuagagcaagguuuucugacucacuguuguaaccccaauuugaauuagccaugugguaagaaauguuuuaauauucauggacaagaaagcuuuuuauuauauauuuuguucaaaggcuaagccucucuauaagaauuuuuaaauuucuuguugagagauuggaauuucuuuuucuauaguacuuucugaacgagcuagcucuuaauuacuccaagaguuuccuauuuucaaagaaaggcaguaaaucuaugguagaaucuauaauuaaauaucccguuaaaacaugauugcagcaagaugagaagaaaauggcaaaagucuaaauagcuuaggcauuucuguuuuuaagugccuguguuguauagaaagacauggcauaggauauuuaaaggggaguugaagcaaaaggggaaagagcgaguuggaauuaaaauugcacuauguaguagauuguuuaucugaaugucuaaauaugggaagcaccuaaacaauggaauuuguuuuaagauaauuuuucaacgaguagccauuuuuaauauaacauuauuguaacaagcaacaauuugcuauuguaugaggccuucuggagauugugugacauaugagcuucaaagacuugucagugauaucccaguagcaacagacauaauccuaaugcagauuuuagugauauucugguggucuugauggugacacuuggaaugauucuuagucauuuaugcguuuuguuaggugacaccucuguaaagcucugacuuauaauuguauaaauauugauuauacagugacacuuuccuccucaucugguacaggccagagccuagauguuagaggucaguggcaugggggaaagggauucuuuuugaugcccaucagaacguucuuaaagggaauaaggauggggcuuuuaaguaauugcuuugaaaguuuuuauuuggugaccuuuuagaaauguugaauugaaagaaaaaccucauuuucucucuggaggaauaaaucuuagaaauuuggagaaauuagguagauucacauggaaaacuuauuuuugccacccauuaugaaucucagaaugcuaucaaaagccuaacuuagguuuauaauaaaagucaacagcaauaaugaauugugucacugugcuagguacuuuguacacauuaccucuuuuaaucuucaugauaaggaaggaguauuacacuuuuuuuuuuuuaauccaggcaaggaaacugagccuuagaagcauuuagucaguuugccugcucuaaugaucugaugugggcccagaagagcacacuuugcucagacacaugaaguauuagugaaguacauuauugacauacaacuugaauugcucauaguauauuuggcauuaaauuuaagaguauuguuuguucaaguggauauuuacuaauugaaauuuucuuuuaauuuugucaaauggagacaaaucguugaauauaaagauaccuaauguucgugaguuuaugugaaaaauugggagaagaaaucagcauuuuaauaaaacaaaauuguuuucuaaaguuaguacuuccacaguaccacacacacacgcagauugagaauaaacauuuucacagaguaugggggaaaaggaggaaaauaauccccagccuuaggaauccaguuuuuguugcauagaacucugaccugauuaaggucagucauuuuuuuuguugcugguguugguagcugauccugcuucagaugauccaucuauuauuuccccuuuccgccuuuuuaaaccaucaccacugacuuuuagaagccagaguuuauaucguuugugauaagcuucuugguguuaucacaauaaaucguaaagcuuuagggcuaaaaaggacuguaguggucucaugguccaaccuccugacuuuucagaugagaauauaucccuguuuauuuuuucuuucguuuaagcauuuccaucuacauauuauuucuuuuauauauuugaaagauucuagucugaaguaggucagguagggaggagaaaauaaaagugauucuuguuuggcaaagacuuuccuagugguaggcuuggcagaauuucagacugcaguauugauucaaacacguaaagucuauagcauucaacauuugaagugccauuauagcauuguuuuaauuaacugcuugcuuuuauaagcuaauuauauguaagugcuggugucuucaauuuaaauccucugcagcaugacaaaucaaugacaauuuuuaguucuuuugucaggucuuaaacuuauacucccauuuggccgggcgcgguggcucacgccuguaaucccagcacuuugggaggccgaggcgggcggaucacgaggucaggagaucgagaccauccuggcuaacaaggugaaaccccgucucuacuaaaaauacaaaaaauuagccgggcgugguagcgggcgccuguagucccagcuacuggggaggcugaggcaggagaauggcgugaaccugggaggcggagcuugcagugagccgagaucgcgccacugcacuccagccugggcgacagagcgagacgcugucucaaaaaaaaaaaaaaaaaaaaaaaaaaaaaacuuauacucccauuuguaguuguagaaguggauauacucaguuugaaaaugacugauuuucuccaaguuauuuugguaaagaaugucggacaaaaguuuacugaagugagugcuuuagaugcugacuucaggucagggagcucugcauuugaacccaaagaccacaucuccaguaugugguuuucuuacugugugugguuuuguuuuguuuuugugacagggucuugcucuguugccuaggcuggagugcagugguacaaucacagcagccuugaccucccaggcucaggcgauccucucaccucagccuccugaguagcuaggacuacagucacacgccaccacaucgggcuaauuuuuuuuuuuuuuuuuuuugagacggaguuucguucuuguugcccaggcuggagugcaauggugcagucucggcucacugcaaccucugccucccagguucaagcgauuauccugccucagccuccugaguagcugggauuacaggcauaugccaccacgcccggcuaguuuuuguauuuuuaguagagaugggguuucaucauuuuggucaggcuggucucgaacuccugaccucaggugauccacccaccuuggccucccaaagugcugggauuacaagugugagccaccgagcacaucgggcuaauuuuuuuguauuauuuuguagagacagggucauaccauguuuuccaggcuggucucgaacuccugggcucaagcaauccaucugccuuggccucccaaaguacugggauuacaggugugagucaccauacccgucccuuaauguguuuuuaagauacuuuagggcaacucuuuuuuuuuuguuuuugagauuauagaaccuaagcauuauuguucauagaauuuuaauacagaauguguuuacuuuuaaaaaacacuucugacuuuuugaagacagugacuauaucuguuuuacguuuauuucuuuuauucuuaaguuaaucuuuuaaagaagcauccagcuucacacugucauuaaucaauacauauaggucaagggauguacauuuuauucccauaauaugucacuguuagucaagaaauuguuacuaggugacuuucauaacuuugucuugucaaccaguaauaacuauguucuguaggucuucauauugguaguuauauucuucauugugucucuuuuuccauuuuuaaugaagaaacugguuuaagaguuacucuugagguucucauuaauguauuucuuuuucguacaucugcccauuucuugcugauaaucacaagacacuucuccuucacugacuucauaucaaaauguuuucuacuguauguguuaugacugaaagagaaguuugcuuagauagugccugucuucugggcaaaugguaugauuaguuuaguaauuuaauccaucuugccaauauacauuucuagauucccaggagaauauaauguucuuguaagaguuuuguaucuuguuuacuaaugaaaagagagaauaugguguauauucuuggggcuucagaaugucuaauagaagcagcaucagaaggggaucacgguccucguaugaagaauuuaaaaacuuuuggacuuuuaaauauuuacagauuugcucuucauaguaauauuugaaaugauuuuaaguucauugcuuagcauuugauauuagcagauuuuuuuggggggagaagcuucuaucaaaauaauguguaaauuauuuuguauguuggcaguuuggacuuaacauuuuuguugaaggagaagaaaaauaccuguuacauguaaacacucgauugcauuuuuuauugauuuaguaaugaaguuccuucaguuaauuguaaaugaaaauuuagucacuguuuacaaagaaaaaauaauauccuaguguauuucauguauaauuuaguguacuuuacucagauacauucuuugaguguaguaacaugguuucuuuauacauugcaggauuauaggcccuauagguuuagauucucaugaaccuuuugagcaaauauggcagaaagcuggucacuuuucucaugucuuuaaauuaaguggauggcucuucaagugucugucuuacucuuagucugaacauauacacucauucuuauugccucaaggaaguggucucugaguugcuuucuguagcuccuugccucuuuuaacuauuauugguauuuacuuggagaguugagucuuguuagguuaacugucagucauucccaccuguauaacuuguaaauccaugcagccuuugcuuucuuucuggcuuuauuuaggcugaaauagauguaacauuucuuaaaugaucauauaaggauuuuuuuuuucuugugagcagaaacuaauauaagcauuuuaugcuuuuccaaaggguuagcuuaaaaaaaaaaggucauuugugauauuugaguucauauagcaucauauauuaaauacaugucauuuauuauguuuauauuuuaaauuugauuauauaucuucaguuuaaaaggugaauuuuaaaaagucaaauuuaggcaacuaauaaaacuagcagaaguugcuuuucauuuguaguuuuucuccuagaauauuguauauauaguuuguguuuuauaaauuauuguuauaaagaucauguaucuuccccaaaugcaaaaccgaguucugacaacuauuuaaaaauaaaacaacaaauccaaacaaacaaaagugcuugguuaaucuggaauguuagaaauuguuuuauucucugaagaaacaagaaaauugcauuagaccgaggacuuuugccauaauuuagcuuuauaauagggauugacuuaaauuuacuccuuaggauucugucuuaccuucucuuagcagauuuuauaaaagaauaucacuugaguaacauuuuggaaaggcugggcagauuucauaagcuacccaacaaggcaguuuuauacuagcuaaugugacuaccuguugggcuaaugaaacuaguuuaaaaguuuuaucuuuuucucuccacugaacagaucauuguaaaaugauuauuguaaaaauuuagauaacacagaaauagguaaaacagaaagcaaaagucccuguaguccaacugcucuggcuuuuauucuuucagauuucauuuucuauauauacuaggagguuaauaauauuuuauuuuuaaaaauuauuggccagauauacauccuuuccauuuugggccaucacuuuacaaccucuguccaaauuuucauucuuuuaaaaaauauguaguguuugacauuauggauauaccauaauuuauugccccauucuugauggacauuuagauuuuuaauuuuuacuuuugcaaucagugcuguacugaacuuuauauacauccuugcaucuuuugaguaauucuguagaaguuccuacaaauagaauuauuagaucaagaugauaugcauguuuaaaaauuuagcagauauuaccaaaugcacccucaaaaguuuuacauuacacccccaccagcuguuuauggaaugucuguuuaccuauauucucaacacaauauuaucaaucuuaaucuucaguccaauagguaaaacauuguuagaauugguuauaccgugucuuaauuauucagugaaguuaaaugucaguuacuguuuguuuauauuugugaauuggcuguuacaguguuggaucuugugcaauuagguugggcuuuucuuaugauucauaaggacuuuuuguauauuacaaauacuaguuuuggcugggugcaguggcucacgccuguaaucccagcacuuugggaggccaaggugggcagaccuuuugagaucaggaauucuagaccacccugaccaacauggugaaagcccaucuuuacuaaaaauacaaaaaaauuagcugggcaugguggugugcgccuguagucccagcuacuugggaggcugaggcaggagaaugccuugaacccaggaggcagagguuucagugagccgagaucacaagacucaaucucaaaaaaacaaaaaacaaaaaaaaauaguuuuuuuugucauauguuuugcagauugccccccccccauuuugauguuauuucugauauaucuugguuauacaguuuuuucuuuuaauuuuugucuuucuuaaagguuccaaaagucuuucuucacuucaagauuauaaauuaucuaccuaucuuuccuuuaguucucuguuuucauuuuuauauucuaauaucauuuaacccaucaggaauuuccuuugguguaaagaauggguaggggauuugguuuuuaauuuuguucuuuuuaguuuccugguuguuucaacacuauuuacugaguaauuaaugaauagugaggggcaguuguaaacuuguuuuugaagaucagcagaaucagccuucuugguuggugguuuccugggcaguucuaccacucgagcaagaccugaaguguuucccuucagaaaccacagccugugccaucuugcucacucacuuuccuuccuuccuuccuuccuuccuuccuuccuuccuuccuuccuuccuuccuuauuugacagaguuuugcucuauuacccaugcuggagugcaguggcgucaucuugucucaccucaaccucugccuccuggguucaagcuauucuugugccuuggccuccagagcagcugggacuacaggcaugcaccaccacaccuggcuaauuuuuguauuuuaguaaagacaggguuucaccauguuggcuaggcuggucuugaacuccugaccucaagugauccgcccaccuuggccucccaaagugcugggauuacaggccugagccacugcgccuggucuugcccacucacuugaaccucuacuacuuuguaguauuaaacccagauccacugauuuaagcaaggcuucaaaacaauuuuacugccacagccuauauaaacuauagauuuauauaauacucucuguuccauuuuaguugauuuuucccccaaugacagaaauuguucuuuuuucuacucacaggacuguuauugaauuagaaauuugaauuuacaugugguggaugaacaucacucuuguuaccugcuucauguacuuuuuugagugcuuacuaccugugaugauuauucuguuucugaucuccaguacuuagcaaaacuggaguuuuuccgcaaagcugcagaugagggaaugauuuaccuuaacagcccuucaggauuuuaaccuaggauuaaguagguuugcauguuugugauuccuuucauucagggcccggcuucugaagguaggaugcggggaagagcuuuaaggaucuaaauuuccucccagccugagcaacauagugagaucccaucucaauaaaaaauaaaaaaauuagccagauguggugacacguacuuguagucccagcuacucgggaggcugaggugagauaaucauuugagcccaggaguuugaggcugcagugagccaugauugcaccacugcacucuaaccuuggcaacaagagcuagacccugucucaaaaaaaaaaaaaaaaaaaaaaggagucuaaacuucccgauacuguauuccaaauguccuauguuaaaugcuguguuaucauuccccgccccuuggaauguagaaaccguuaauuacaggauaaaagugaacugagaagcaaauacccuuguguuguaggguagagguucuucacccaauguggaauuggucuguaacaaauacugaacaacacaaacugaaauaauuuacaaucugauaugaauuacucuuuuucauuucuuaacuccaacacuugauuaguugcuuucauuaaauacaucugugucaauaucuuaaugggguuuuuucuuccguuuuuguuucugccucucuccuguuggagcgacucauuucuuuucaagugucgucuucaaucucccuucuccuauuuugccuucucaaccugauuaugaauucacuuccauuauugagcuucucuuuacuuuauccaaauuugcuauuuaucucauugcaguuuuucuucaguacuuacuuugcauaaaaguagccugaacuuaaauuauauacacggucauuuucaccagaagggcuagcuaauuuaaaacuugggcguguuaucuuuucuuuccucaaguccugcagaauauaggguaguuucagaaaucacccccagcuuuucucuagacuuggugacagcugaugcuuucuucugacucuuccuuuccuggagugccgaccuuccugcaccuuccucgcuguugucacauggaaaggcuacaggauguuagacaaugucaacaguuuacuaugucucuggcaugaaauaaauggaccaaccaguaucugagaauauuuuuuacuuggcuaauugauuguauguuuuccccuacuauauggaaguuggacuuagccuuucucauguuaaagauuauucagaggcaggacggccauggcuguugucuuugggauguccacuguaaaauggggagucauaccuaccucacaggguaguugugaaauuuaaagaagcuaacuuugguaaagucucuagcacagugcuuggcacauaguaggguguguuaauuucuuucccuucccugcaggccauucaccugcucuucccucuacgauuuuccauaacacaguuuuuacuuggaaccagccuucugccaagagucucaguuugguuguguacuccuacaacuacuauuuuuggcuugacuucccucuccagcucccagugguccagccacacagucgccuauuguaccagcugguugauguaagucuauccauccucagaggaaccugguuacuuaccaguaagcuguguuucucugaaaauguagcauccuugguaaugauucuagucccccccauccccuuuuuuuuuaaaccauugaugaugaaucaucucuaacuuccuugugugauccucaaguuggaacuggaauuagagaaucuaauuuguugauaaaggucuccuaguaaguuccugaguccaggacacauggcucugaccaggugaaauguggagacccaugagguaaaaauucuuuucacuacucugagugacaugagacuuaauuauguaaacugucaaggaugauacauuuucaaagaaaaauaaguugcugguaaguaacugggauuuuugaguaauuuuucuguaagucaauaaauaagaaucccacguuuguuuucaccaacaaaugcuuuugcauuugaauauuucauaaaugaaaggaauaugguuguuaguuacgguuaauaguaaagaaugggauagguuucuagauacuagaaauacagugagguggggguagaccaucaguuuucuaaauaggugcucucuuagcuugaaacagaaauugaagucuccauuagagaaaaucaucaaguguagucuguucauuccagaaacauuuuuugagugccuacuguuuuuuugagacacugugcugaguaucguuucaagacagaggugaagccacacuuggcucagcugcuuuugcccucagagagcuuauuucuugucucuuagugacucucgcaugacucagaacugaggcgaugggauacugggguaugacagagguaugggacuggaaguaguacguagugcugcagccugugccuuaauauuuucugugcuuccauaaguucuuucuguuaaugggaaaaaucagcugacuucauucagaauuugcagaguauuugcuguaucacuagagcaaccauagaugaagcaaagccaaugcuccuucuuugucauaguugaaaacucauucucuaacccuuaugugcgacuuuggaguuagguguuaaagcaggugaauaagucagucggagaggcagcccacuccccauuaagcuuucaaagcacuucuuccuucagaagccacagaauuaauuuauuccugccaaauguuaaaaaaaucggaauuuuuuuuuuuuaagaaaugaaaauuguuuuguacuuuaagucacuggauaguauuugauacuaucaguaucaguaauuauauucaguauauucgguaauuauaagcaccuccacccccaaauuuacccaguuaaguagaaagaaggaaagaagacuugguaguauuaauaaguuguuguuggaggagaugcuccuauuacauuaugucucuauuuucuuuuuuuuuuuuuuuuugaggcggggucucccgucgucacccaggcuggagugcaguggugcugaucacaacuuacugcagccuuugccucccaggcucaagugauccucccaccucagccccucaaguagcugggacuacaggcacgugcuaccuugcugggcuaauuuuuuguguguuuuuaguagagacaggguuuccccauguugcccaggcuggucuugaacuucugggcucaagcgaucugcccgucuuggccugccaaagugcugagauuauacgcuugagccacugugcccagccaugucucuguuuuauauaguaaauacugcauggcuguaauuguuauuuuaccccaugagcauugcaagggcaagaacuacagugcaguaauuaauuaagcucacggguguugcagucagacuuuaaauccagguuuuaauccugguuuuguaauuugcuaccuuucugacuagacaaauuguauaacuucucugaaccucaguguccucauuugugaaguuuugaugcuaaaacuacaccauaagguuguaaugaggaauaauuaagauaauauauacaagcacuuagcacagugccugcaacauaguacgugcucaauaaauguuaacugcuguuuuuauuggauuauuggauggauggaugaaggauuguaucagaggccaaauagcaggaaggggaaagauugugggcucuggaguguuaguaaacuguucacaccuucuuguuuacucgaguuaagagccuuauuaguauuauuaccuuuaucuuugccuuuuuggaaagcaaauuaauagaugaaucacugucacaguucuuccuaacuacuccauccuuaaaccuuuacuuccacuaaggaaggaauuauuuuugugcugcagugacugugaugauugagagauuaucccacuggccugaugcaacccaaugcugagggucagguguggcccauaugccagauuucuacucugaauuucaccacaacuaguucugcuauuuuuaagacauuuuaaauaaaaaauuuaaacauuuaauauguguguguguguguguguguguguguguguauauauauauauauaaugauuuuucaguuucauuuuacuacacuucuuuuuugcucuauuuucauugauuguggauuaugaauguaugucuaggauauuuuugagaaggcucuggaggacuuacaccugggcaguaguacucuuuaaggaaucucggauucguagacaggguggaaagugcugugguuauuuaggcacagaguuauaccauauuucagagaaucaaagaugcaaaauuuuucacauuuuaacauuggaaacaacaugcaucuuagaaucacugugauaagaauggauuauaccuuuguuuaguuggcagcauuuuuucuuagugauacagaagauaaugauguaccuugaaaucgcugucaucauagauuguaugaaauaugguguuucaagggacuaugugcacugacacauuuuagcaauaugguaucauggcaauauaaggagcgggaagagcaggggcuccagagucaggcuuuuggaguuuacauucuagcccgagaaccaugcgcaacuuugggcaagcuacuuauccuuucuuuucuauaguuuucucaccuguaaaaugggggcuaagaguaguacccaucuuacaguguuguaaugaggauuaaauagaagacauguaauguguuuaaaauagccuagcacauagaaaguacuuaguaaucagcuaauauuauuaauucagagauuacaguuuugcagaauagacuuaaauuuacuuuguugugauugaaacacaaacccauuacccuuaauauuuauguaucaucugauaauaucagcaauugacacuuagauuuuaaaaaaggaagauaaggaagauuaacugaacaaguuuucuuauucuuuuuauuuuauuuuauuuuauuuuuuuuuuuuuugagacggaguuucgcucugucgcccaggcuggagugcaguggcgcgaucucgacucacugcaagcuccgccucccggguucacgccauucuccugccucagccucccguguagcugggacuacaggcgcgcgccaccaugccuggcuaauuuuuguauuuuuaguagagacgggguuucaccguguuagccaggauggucucgaucuccugaccucgugauccgcccgucucggccucccaaagugcugggauuacaggcgugagccaccgcgcccggcccaaguuuucuuauucuuauuaaguaagauuuaaguggcuuauuugguauacauauuacuauucugugugguuggaauguaagagaaaugaaggaugagcuaggaaauaaauguauaggaaaagcauggaggaguuaaucagaucgcugaaucucauauaaguacaguuuuugauucuuacugauauugguaaguaugggaaggguuggagguuuugaaaauuuggaaaauuugaagcauuuuugcacccuaaguaaaagaaaagagagaauccuauuugguuuauaugaccacuuuacuguccuagguaaggacuuuuuuuucaaaauuaaauauuuggguaggcagcaucucuuuacaauaugauggcuacagcuuaagguuguccuuuuauucuuaagagucaauuuuauuuuuucuguuuuaguguucggugaccagugacuuggauuuuccaacacaagucaucccauuaaagacucugaaugcaguugcuucaguacccauaauguauucuuggucuccccuacagcagaauuuuaugguauguaaauaagauaucuucugcuuauuugauaauaacuuauuugaaguaaaaaagcauagauaauuuuauugucaaggugaaucaagacaguauaaauucuaaaaagcuaucaaaauaacacuugaaguaauuuuuaaaaauugauuaagguaguuuuuuuaaggccugugcaguauuacucuuuuccuauacucuccaaaggaaaaguguuaagcaguaaccauaccuaggauuaaaaauauuuaaaagaugggcugggcauuguggcucaugccuguaaucccagcacuuugggaggcugaggcagauggauuacuugagucugggaauuggagauccaccugggcaauauggcaaaacgcuguguccucaaaacaaaaguuagcuggguguggcgcaugucuguagucccaagcuacucaggaggcugagguggaaggauggcuugagggaggcggagguuguagugagcugagauugugccauuguacucuagcuugggugacagccagacccugucugaaaaaaacaaaaggaaugaagcuuauaguucuuauccuuaaaaaagucaguguccuguaaucuaagucugacuuugaguuuuuguuaauugagaacuuauuauuuaaaacaacuuuagguagcauuuuauugugauaauguacauuaugguguaaaauucauagggcuugugaaacaugagcugaaacauaguuccauugcuaacucugacgcagcagcuuuuguaauaaaaugcuaaagagaaacugaagcauguguucuugacuuguauugcuaaauaaaaaauauauaguuguauuacuuaauugauauauaaagugggaaggcuaauaaaauguugauagaaguccuuggugaaccugcuuuggggaaguuuuuaguaacuuuuauacuuuguacaguagagucucaacuucaguuacucuucuguaguuguauaaauuugaguguaguuugagaauuacauugcaugaccuugagggaaguuucauguuuucacagacugaaauucuggaagaauauauuauuuaaauuugucauuaauuuaugaaucacccauggauuuugcuggucuagccugggugacagagccagacccugucugauuuugcugaccaaagcagauuaggcacacaaucuuuauuguaacuaagauacguuuuggagagcaggaugauguggauaugauugaaaagacaaaauaucuaagugucacuugauuuuggcuuagauagaaagaaaucaaccccuaguuuaaaugagauuagugcaagugaaaugagaugaaaacaggccucuaguguguacauaagcuugaauuugaauauaugaauacauuaaaaccugcauuuuaauuauaugcuccuuuuaucccacuuuuucuuuuccuugucugucuacgguacuuguuaucuuuaugaacucuccaguuguccuaaauuuguuaccuagggauuauuugagauuuuuuccacauucccuggcugcuacuaguccuguguguggccuuucccagcguguucuuaccugugggccaugaucauagugcugggccgagccuacgccaucucacccuuuaaagagcuucuguguccucccagucaggcauagccaguccauucugcuuauuauaauuaucuuucuaaaauucuguuuucaaccaauacucuuuucaaaggccucuuaagacuuagacuugucuucacuuggaauuagucucuuuaaacauguacuucagaacuguccagucuuuaucuauaacugcugucauuuuuauucuucauugaaaaugcucuuccuccuaugaaugucaacuuucuuuaccuuguaugcuuaacuauucuauucugucuuaacuuuuguuugauuggcuauucuucuuucuucucuguugucuuccaaagcuugauaaaaacucaucuaucaucuuuacuagcacugucaacuuugauauucaucucauucaucuaaauauugaaauauuuuauguuuuuguagaauguucuuauuuuacauauaaguacauauccuuuuggcauaaacuuuaauggacuaucaauacucuguaucccuagaauuuuauuauauuggaugucuuacauuuuuuuuucauuuuaccuuaaacuauuacaaguuaauggcuguuuuaauaacuggaucaucaaguggaguuugggagucuuaggguaguuuuuugguaugggucuuuauaguugaucuugauacaccauauuucaucauccucuauuaacaucuaaagugcgcguuaaaacugaugauggcugggcaugguggcucauggugucagacaccuguuaucccagcacuuugggagccaaggcggguggaucacuugagcucaggaguucgagaccagccugggcagcauagugagacacucgucucaauuaaaaaacaaaaacagaaaaacagacgaugucuucucauaaucuagagcaucuuuuucuuucuuagagguauguacaauaauggugguaaguuuuaaugauugaugacagacuaagugcauuauuuuuucuagaauuaaauuuuuuuucugucaacaguuuucucagauaugcuuauuggugagaggggucuuuuauuuuuugauaaauuuuagaguuugcucucugacuaguauuuuaaaucuggagaacuggguaaagacauguacacaugaaaaaaagguuguauuuuaguuauuucacauuugauacuuagaguaaaccugcuuuuuaaauauauuuuuuucuuuuagguggaagaugaaacuguuuuacauaacauuccuuauaugggagaugaaguuuuagaucaggaugguacuuucauugaagaacuaauaaaaaauuaugaugggaaaguacacggggauagaggugagccauaugcuucuucucuuggaaaaaggggcuaaagaauugagagacacuuuuguuuaugaagcauauagggcaugagaaaaauuuuaauauuaaaauuaaguuuugcacugaacuauaagggacugaaccugggcccaggccuaagauuuucaguauuuucccuaacuauuuuugggaaaauuaguuaggaggaucauguuugccaccugauaauuaugcauaguugguuauaacauaauggcaauaacauguaaauuaaauagaacuugaguguauguagauuuuaagauucuuuaguaguaaaauuaauuaggauuggggcucugcuucuguggcauauaggggcuccaacagccccuacuacuaaaaaauaccgcuccucuagggacuacaguaccugaaauucaauccuuagagucaugguuucaguuuuuuguguccaggaggcccuguuaaagugucugaaaggauaauauuuguaauaucaucauccauugucauuaucagcagaaagcagggucugaaaugaucaguuaaaggacagauccauuguuugggaggaggccaaagccacaaucaguuccuagaagauucaguuuucuacuagaaaguuuuggggaggggccauucuacagaaaguagcagguauuaaagauaaguuugcuuccuuugccuaacaccaguccugaaaaugaucuuaucuuuuccuccccucauuucaauaauaauguuuuagugccaguuacuaggcuaugccuguuuuguccaaguagaaaaaggauacauaaacuuuugacauuauugcuucuccuguguguuucugacauuugaugcguuucagaauguggguuuauaaaugaugaaauuuuuguggaguuggugaaugcccuuggucaauauaaugaugaugacgaugaugaugauggagacgauccugaagaaagagaagaaaagcagaaagaucuggaggaucaccgagaugguaugccugauuauuaggauucuguguagccauuacagcuuucuuucaaaaacaguagaaagaguagaaauagggcuuaguuucuucuuucucuuuuucuuucuuuguuaaauaucacauugauagcaguauaaucaaaauuaacauauuauggccagguaggguggcuaacucuguaauccuagcacuugggaggcuaaggugggcagauugcuugagcccaggaguucaagaccaaccugggcaacauagugagaccccaucucuacuaaaaaguaaaaaaaugagacagggugauugcuugagcccaggagguguaggcugcauugagcugugauugugccacugcacagucuggcugggugacagagugagaccuugccuuaaaaaagaaaaaaaaaagcauaauacuugcaacauuaucuucacuugaguaucuuuguuuccuuuggcuagcaaagaacguaauuuuuugugugcuucacugggcaucauuauaauauauaacauugauauucaccguguacaaguuguguacuaaucacuucuuaugcaccagcucacuuaauccucauaauggcuucaugagauggauguuauuaucagauccauuuucuuuuucgagacggagucucgcucugucgcccaggcuagaguacaguggccccaucucagcuuacugcaagcuucgccuccuggguucacgccauucuccugccucagccucccgaguagcugggacuauaggcaccugccaccacacccagcuaauuuuuuguauuuuuuaguagagacgggguuucaccguguuagccaggauggucucuaucuccugaccucgugauccaccugccucggccucccaaagugcuaggauuacaggcgugagccacugcgccccaccugucagauccauuuucuauuugaggggauagauuuagagagguuaaguaacuuauaagauuacacuauugggaagaaacagagucaauaguugguguucucuacuuggcaaagcucaugcuaaggcagcauagaauagaauaauuuggcgggugaaauagcaauuucuaagaagcguauuucaaaaaagagaaaauaacaaaaagguaccuuauugaccuuauugaucaucuaguucagcuccuucauuuuacagaugaguaaacagacccaagagguaaagugaucacucuaagucacaaaaucaguuaguagcagagcugggaguagaaccuagguuuucugcuucccagugcucuuaaagcuuuucauauuugaauuugaauuuuguuuuugacugacuggcauuccacagacauguaaaguaugugagaaguaaguaaaacacaaaauagagaugauuucuuagaaaaucagcuuuguuauagagacauaauuggguagagaaaaugaaagaucaaaaacuuguuuacuuccauucuuuuuuuccuuucauauucuccuguuuagauaaagaaagccgcccaccucggaaauuuccuucugauaaaauuuuugaagccauuuccucaauguuuccagauaagggcacagcagaagaacuaaaggaaaaguaagaauuuguuccuuugaggcaaucuugcccuguaugguauguaacucaccauuuugguuuauuacaaauggaaucaauguagcggaugagccacuacacuuuguuuacaguguuugcaagauacuugaagcaacauguguacuugugguacucugcauuacaaaauauuuccuguagauagaauaaauacauauguauaauuuauauauacacauaaacacacacauauacauaaaauuuacaguaguacauuuacaggaaaauuaucuggauacugguagaaauuugauguuuaguuaaaacuaauauaauauccuuuuccaugauauauuugaaucauaucgaugaauuugauucuugauaacaccaugcacaauauuuaguuggcucuuuaucuaaauagagccauuccuuuauguuuuaggcaagauaaacaucaaaaguaacacauggaaaccuuuuagaaacuguuuucaaaaaagugauuuuuguuucauguuuacuuaaauuuuucuugguuaaugucagauauaaagaacucaccgaacagcagcucccaggcgcacuuccuccugaauguacccccaacauagauggaccaaaugcuaaaucuguucagagagagcaaagcuuacacuccuuucauacgcuuuucuguaggcgauguuuuaaauaugacugcuuccuacaucguaagugcaauuauuguacguuuucauuuucuaucuuuguuguggaauuauguuuuaaagcagcuuggagagugcuaucauuuauuacaacuagaauuuaucauuuaaucuuguaguuacuuugacaaauaucuuuagaucucaguauuauuauuuuuacuuuguugcuugaggauugcucugaaaucuuuugcauguauuucauuuggacuacuauuuuccacuaacauggaauucaggucagugauuuuuuuuuuuuucccccguaagugcuaacuaagcaguuguuuuacaauaaaacuauuauuaugaacugguagcccagagcaacauugcugauauugaugaauaaauuguguuaaauaagaaauuggccaaaaaaauguucagguaagugcuugucgauuuaauguaauuuuauuuuauuuuauuuuauuuuuuugcccucuggguaaguuguuuuuuaaaaauaccugcauuugaauacaaguaaaacguaaaauguucuuagugaaaauguaaguaugguauauacaaaaauacuuuuuuccucuggcauuucuagggaaugugguuucuuaguaaauuuuccugguaauugaaacuucuaagcacaguuuaaaagcgucaacuacuuuugaggcacauauuuugaaaauguauuuaauacuuccuaauuuuccuagaguaguuugcuuauuauaguuugguuuuuccuauauuguauuuuaguacgucugucuauggcaugguaauuucuuuaggggcuuugacccauuguaaaaucguuuuccccuguacucaacggccccacauugcuuuguuguuuugaguuccugugccuaccauugacagauuuauuccuccucguucaccaaugauaacgucuuuuuaagcuugcccaagcagcuguaccucaccuccuccuaaguguuugcucuacuuguuuuugcugcagcuaauaauguguugagugauguaauacauuggucuggaaauguuaaguuuuguuuuugugugugacauauuagugguuuaguuaucuuaaaauagaaaaacuugaaguagauuuuuagaauuaucauuauauuguuaccuccuugcucuuguucuaacuccucaucuaguuuaaauugauuugguaguuuuaaaaauucguaguaagucauccauuuguugcuucagccauuggacaguuaagcccuugaaauaguugucuugaauuucauuuuaauuucccuuuacacaccaugaauuuaugaauuacaucgaguuuuuauuaagacuauuggacauuguauguagauaucacuauagcaaaagaauugaguggaagcacuauuuuggagucgcugaaagguccuuccaauuuguuguuuauagauguagcauuuaauaaaguuuuuuugcuguaaaaaugaaccauagaaguaggacacuacuuuuaaacauuacaaguuuuuuauugugccauucagagaugaguaauuuuuuuuuuuguuaacuugaaucuugaaccuguuacuuaccucauucuagcuggggagaacaguggaauauuuuacuuuaauaaaguuggcuuucauggggcuaauuggcugccuccuuguagcauuugguggccauggguccaacugugcuaggcccacuuuuacuucuuuuuacaguagagccagugucuucaucauucaguccuauugaguucuguaggaacuucauuguuuuacguuaacuucgacaaaauaccacacaugguauauuuuucuuagguaaaauaaguuacuaaauaaaucauuaaauauauauaaucaugcauuacuuauggacggagaugcauucugagaaauguguuguuaggugauuuuggcauuauguaaacacagaguguacuuacacaaaccuagaugguacagcgcaugacacaccuaggccacauaucccugcagcaugccacuguacuggauacuggaggcaguugugacacauuggcaaguauuuguauguuuaaaucauaauaaacauagaaaauauacaguaaaaauacaauauuaucuuaugguaccacuguuguauaugcgguccaucauugacucagaugguaugcagcacaugacuguuucuuuuuuguuguuguuguuguuuuuuuuuuuuuuugagacgaagucucguucuguugcucagucugaagugcaguggugugauuucagcucgcugcaaccuccgccugcuggauucaaaggauucuccugucucagccuccugaguagcugggauuacaggcgcccgccaccacguccagcuaauuuuuguauuuuuaguagagaugggguuucaccauguuggccaggcuggucuugaacuccugaccucaagugauccaccugcccuggccucccaaaguguugggacuacaggugugagcuaccacgccuggucgauuuuauguugaauauagcauuuugugcuuuaguuuucuggucucuuaucuuggggauacgguaguacuuccuuuacagagcuguugugaggauuagaugaauuaauguggggaagauacuuaaaaugguaccuggcucuuguuagcuauuguuguuuuuaaaauaggucaucauucacaugguuuacguuuccaaaaaguauuaauaugaagaugugcugggcgcgguggcucauccuuuuaaugccagugcuuugggaggcagaggugggaggacugcuugagcccaaaaguuugaggcugcagugagcuaugaucaugccacuguacuccagcugggugacagagugagaccccaucucuuaaaaaaaaaaaaaaaguaugaaaauguguacaauaaagucucccaaugacuuucuguuccccauccuucgaaauuuuaccucacucuuccacuuuuauuaguaguuaaccacuuuuauugguucucguauuuuuuuuacaguuucuuugacaaguauaaagauacccuuuuuucugaccgucuuauuuacaugguggcauagcauucaggcuuuucccuuuuuuuggaauaaggauaggauuuaauauuguagcuauuagcuuuaucuguauagcugcauagccugugcuguaggagguuccagaacuuacuggacuggucucuaauggugaccauuuggauuauuuugagccuuaugcuguaacgaugccacagcaaauaucuguacccauuucaugcaaguuuaaguuuaccugauaaacucuauuuagguauugccaaaugaccugccauauggggaugcagcacuuuaaagcccuaccagcaaagucagagagcccugcccauagaagguguuaccaaacuaauuuuuaaaauugauuuuauaagugaaaaauggcuuuuagcauuauuuuuaaauucuuguuuuucuuuguuuuuuaaucucugcuucccacaggugauaagcauuguuuuaauaucuggauuuaauuccuuugaaugaggguaggaucuuccuauauguugaagagugaacuauuuuuauucuuuguuuuuuugauuuugugagacgggucucgcucugucgcccaggcuggagugcaguggugcagucuuggcucacggcgaccucugccuccuggauucaagugauucuccugccucagccuucugaguagcugggauuacaggcgcgcaccaccucaccuggcucauauuuuuauuuuuaguagaaacaggguuucaccauguuggccaggcuggucucaaacuccugaccuuagguaauccacccaccucagccucucacagugcuaggauuacuggugugagccacugcgccuggccuauuuuuauucuuggucucauagaucuuuuugaugucuuaggagcuuuuuauauaaucaggaaauuagguuuuuugaaauaugaguugcaauuuuuuucaaguuuauuugguaaaagucccauaagcaaaguuuaaacuuuuuuuuuuuuuugagacagucuugcucugucgcucaggcuggagugcaauggugugaucuuggcucauugcagccuuugccuccuggguucaagggauucuugugccucagccucuggaguagcugggacuacaggcaugugcuaccacauccagcuaauuuuucuauuuuuaguagagaugugguuuugccauguuggccaggccggucucaaacuccugaccucaagugaucugcccgccucagccucugaaagugcugagauuacaggugugagccacugcaccuggucaguuuaaacauuuuuuaaaaaguaguugaauuuaucaguuagcuuucccauuccaagauuauaaagcguuucucacuuuuucuaguauguuuuaggcuucauuuuuaaaaacauaaaucuuugauccauuuggaauuuaauaugauguggauuauaaaucugauccuccuccucacuuccaaaguugccuaguuguuucauuuacugaaaaguucaucuuucacuaccuugagauauuuccuucauugccuguugccauauguauuuggguuucucaacauuguguuccuuuagucuauucaugaggcgguauucagagaucuccuggcaauucuuguuuuucuauauaaauuuauuuauuuagagagagagauauauauacauacacacauacauacauacacagggucuugcucugucacccaggccagaguggugcaguggcacaaucauggcucacugcaaccuugacuuccugagcucaagcucuucuccuaucucagcuuccugcguagcugggacuacaagcaugcaccaccauugcugguuaguuuucuuuuucuuuuuuugagauagggucucacuauguugcccaggcuggucuuaaacuccuggccucaagugaugcuccuacuuugggcucccaaagugcuggaauuacaggcgugagccacugcacccagccuauauacauuucaaaaucuguuugucuaguucuuuuuaaaaaaaauuagugguauguuuauuggaaucccauuaaauuuauaaauuaccuaauuucuuuuuaaaauauaaggguuaagucuaacuaaccauaccaucaccucucuuuuuguguccuuuaauuaucucccaaguuuucuuuaugugacucuuguacauuuuuuguugaguauuucuagguauuaaacuugcugcugcuguugggcuuuuuccacauuuugucuucuguuuuguacccugcuaccuuacugcauugucuucauguuuuaucaguuucucaguacauucuuaggaguuuuccagcuguguaauuauacugucuguaguuauuaaugguuuuaccuucuauccagucuuuauaacugaagcuucuuucucuuuucuaccuacuuuauuuauuuauuuuuugguugggcgggggaggggaguggggaggcuuucugauaaaaaccagaaagccugcuagacaaauucuaaaagagcuguaacugucuuuucuaccuacuuuagcuuguaguuucaguacaguuuaaaaauuaguagugcugguagauagagauaaauguucugucucuucuggaugaguuuuagaaaauuauucuuuacauccagguuuugagauuuauuuguaugaaguuuauguguucucuaauguucguuuuauuuuuguuaauauucuuguucucuauauauuucauugucacuuuuuuguuaagaagugguuuuuguauuuuaaauuauguauuuuuuucuucagagaaccagcuacaauguuaguuuaacucauaaacagaaaaacaguuguauuaggguuccuuaacaaacguaauccagcaccagauuaguauugguguuaggcugucuggagccuaauugcucacacgcuuccaacagaaucugagccuugaauuuuucuucuuuaaaaacacaacuuuguccuuuuuuuuuuuuuuccuuccuuuucucagucuuuaaauauggcuuuuuacaaauauuuaaaagaugauuuguuuuguggaaaugucacuuguuuuucuccaaauuaauuuucaucuuguauaauucugaauaguccauuuccagcauuucccuuuuguauaugaggaaguaaguuuuugcaagaaauucugugaaguuagcacugcugucaauguucacacucuuuucauguagcaguguacccgcauuugaaucuuucuguuacauuauuuuggaauuuuagguuucaaacaguguaucuuucuaaaauccguuuuuuugacauuguaauuuucuguggcaagacacuauaagcucucaccagguucuuggauuggguaugauucacaggaauugaauguuaguaaucuggggcuguccucuuuaucauuaaaaaugaguuuuuacaacuggugacaagcugauugcugaccuuucuuuagaaaucaagaaauuguaugucagaauuaaaaauaggaaaucugauuuaauuguagagggucuaucaacugcuuagacagagauaguaagauucaauuuaaguaaauguuuauaaccauaguuaugcgcaucaguuuuacuugcaaggagaaaaaugagaaaucacgacucauuccagaauuuacuguuuuuccuuccugcuuaaugguuggaggaggaggaauggagaauacguugugaucauucaguaagagccugaaggaaaguuguaugaaguaacguaaaccacauauuagcaagauuauaauccauuaauugacuuuuccaguggaacuggaagagugaaaaaguaaguauuuuauaguuauauuagauucuuuguuucauuuauuuugcagcuuuucaugcaacacccaacacuuauaagcggaagaacacagaaacagcucuagacaacaaaccuuguggaccacaguguuaccagcauuugguaagacuuagugccuaauuauugcagaggguacuugagaggacuuugcacuuugguggaggugaucaagucagcguuaauguugucugcacccaugcuguuaugggccauaugauagacagagcuuucucacccaugcuguuucuuccauagcucauguacugcacauuuuaguccuucauuaaugugguauuauucuuuuuaaaaucuguguuaucucuucagcaacauuucaaggucuuuaggaucaaggacuuuuaugccuuccacaaagucuaugagaguugcaaggcacagauaguccgcuuagaaagcaggcaugcaguaaucauacgcaguagaucccaagccccucucauagccauaucccucuacuugaguuuuagaugcacugucauuucagcuaugugauagguuccacagauuuuuuuuuuuuaaaugauggagaacagguaagggguuaggaaaauaugagguagaaaaguuguuuuuacggguacucucuuauuuuuaccauuuccccucuuugaaccaagccacuccuaccuaggaacuaaauggguauauauugccuguuggauuuuggacagaagauucauugaauggcaccugcagaagguauccuauuuuuaagcaauuugguuuuuguagaaugaaguauaaaacuguuggcugcugucaaacuucucccuucuauuuccacuaaaaaaauggaauucuugagcacuuguuuuauaauauucuuuacaaggcagaauuuuguuuggcucaucuaaaauguuucuguggucucuauaaaccaugcucuuaccauuguuuuauacuuugagacuggauuauuguacuucauaaugcaagauguaacccucacagucuuauuccugaaguuccuuucaugucuuccuguggcuguguauccuucacaggaaaaaaaaaaauguuggauguuuuaauaguaagacaggaagugacaaagucaagcauguuuguguuuuguguucuuguauaguugaaauauuaacacgaagagguaugcauuaucuuaaacucugcauagguagucugacuccgugcacauuagguauaugauucuuuuguaaagauucacuuuuaaauagacuguauguccauagagauaauuaccuuuauuacaugaaguauauuucauacuuuaucuucuuauauuuuaacuuaauuauaacuagcuaauauauuuuacaaauucacaauauagaacugucuugccugauuuuuguaccauucuaggaauauauagaacccauauuucucuuucugaaauuuucagacuaucaaaagcauaucaaaacaaguauauuagacaugcaaaugauuauuugugauaaauggauaaugugauacauuuuuugacuaaccuggcuuauauaguauuuuuuuuucucuuccaucaaaaugaguuuuagaacuuugcccugauguugacauuuuucauuucguaggagggagcaaaggaguuugcugcugcucucaccgcugagcggauaaagaccccaccaaaacguccaggaggccgcagaagaggacggcuucccaauaacaguagcaggcccagcacccccaccauuaaugugcuggaaucaaaggauacagacagugauagggaagcagggacugaaacggggggagagaacaaugauaaagaagaagaagagaagaaagaugaaacuucgagcuccucugguaagacacgucuaauaacuggguuuuacuguucugugaaaguucguguugugaggauuaaggauguauaaugcauugaauaauuuucuuaguugguuaguuucaguauaaagaccagaguuaucucaagaauguguagcuguguuguuucuguuuccugccugcacccguacccuagcuugugguguuugcccugcuugguuguuugaaagcugaugaugcacuuuauucucauucuuugugccauuuucuuuuuucgaucuuucucagguagggaauaaugaaauuuggaucauuugguuuaauauucuugacguucugugaguaguuuuguuggaaaaugugaacuacgauggguuaguguuuugccgauuggauuugaguuguccucaucuuuucgcuuuuuucuuaagcacacccugaauuguacuucuuaauauuauuuccaaucauuucuugaccagugcuuacauuugguuuuguagaagcaaauucucggugucaaacaccaauaaagaugaagccaaauauugaaccuccugagaauguggaguggaguggugcugaagccucaauguuuagaguccucauuggcacuuacuaugacaauuucugugccauugcuagguuaauugggaccaaaacauguagacagguaagauauccgauaaaaauguuguuaaaagagcuucaaacauagagauaaaacuguacucguuguccaaacaaagaaaauucuugguuauuacuaagcuccuauucaucuccuaaaaauaauuuuuuuuucuucccaagagggaauugaaugaaaauuauucuccagguauguuacagaauuuccccaauguagacuuuuaagguuagauagcaguagcuuuuaaaagcuaguaagaauugaaauuuagcaucacaguucuugaccagaauauaauuacagcuaccccuaaugugaggguagggacagcgauguguguuauauccccagcaucuagcagugucacagaagagacaaagacauuuuucugguaugcaugaguauaagaaugguuugccuaaauaagacuguccucauggcucugugacugugccucuugucagguguaugaguuuagagucaaagaaucuagcaucauagcuccagcucccgcugaggauguggauacuccuccaaggaaaaagaagaggaaacaccggugagucugucaugaagcuccuuagagaagucaacauagauagacacugcaggcaaggcccuuccuaagggcuguuguugguuucuacuuagucuauuuuuaaaaaaccuuaaacugccaucaaaaacagaacuauggaaucuuauuuccacugggaauugcuaguauuuuucuauaagaauacagcagccuucaguauauuugguauguuaagagucauaaaaauuacgguuaccagacugcauuuggguuaagaaaaacauauuuaguagcuuuugcaguaaagguuacguaaacaauuacuuuaacaucaugaaauguucuguguuucugaugugagcucugggccaguuuuuagaaguaucuuuuauuccaggagcuugaauuucuaaguuguguggcauugcauuccgauacuccuaauggguacccuacuuuaagcuugugugaauguuauuuucaccuuagcgaauguuuucaggcugauuugauuuguaaauguagaaccagaaaaauugaugaguggacuaucugcucuaaucuccccauaccucuaccucacauuuuuaaaaaugagaaaccuaauuggguagguaagggugcaguuagauuaugcuucuuaaauuguguacaggcucauguuacauuuucuuacuuuaacaaaaauaaguguagggccaacccaauuuagaauuuuuuuaaagucaaguuuuuauuuuuauuuuuuaggcuuuaggagaugcuucugaaauuuugguugaauuauuucugaccacguaguucacuugcuugguuuaugaugccugaaauaagaggaagugaucagugucauccacaucagaauaaaucaacaggcagacacaccugcugcuuugugcagcauugggagcucaggaguucugaccaggagucauggaugaacacaggaaaugacgucuugccacaccuggggcagccugagccaucaagcuguuugaguugcuucaaacugauggcaaauauaaacugggcagggcaugacucuuggcuuuaacgcauuccuguauucauggcacagauagauccaguuaagcagcucucuguuggauuuguagcuucccgcagaaauuugguuuaauuuucuuuguguuuuugcagguugugggcugcacacugcagaaagauacagcugaaaaaggguuagcaucuuuccauuccucucauuauuagcuuaacaauaucugcuuuguuuucauuuguuuuagaauaguaacuggauuagagcuuggguuauucuaauauaauugccuucuguauguuaaaccaauuugaauggaggacgucuacugaugaauccccagucaauucucuucuguaaaguggaggcugacuggaaggugugaguccgagucaguugaaggagaagugcuuugggaugggacugagauguagccgugcuuuagauggaacucauaagcacuugggggugggagaguauuuuuugccaucguuguggaaaccggaauauguguaauguuaugcauucaguaaaggcaggccagcuacacuccacagguaguagggaagaauguacucguguuaauuguguaugaucguuuccaucucccuggauucauuggccugcaugauguuaucuuuacucagacggcuccucuaaccauguuuacaacuaucaacccugugaucauccacggcagccuugugacaguucgugcccuugugugauagcacaaaauuuuugugaaaaguuuugucaauguaguucagaguguaaguauuuguugcuuugaugcaauugcaugagaacuaaauaggucuuugguuagcaauuuaaaaaaucaaaaauaagaacaugggagcacucccuuguuuacuugacgaaacucaucaauuugacaaguauuuauugagccccauaccuggcccugugccaguggccagucagucgccuggguguugugugucugugugugugaggcaggcaaaguuguauuaaaggaaccugaauuuuauuuuuuucuucuuugaucauuuaaauuaaguuguauuaaaguuggcacagauuguaagaggaaucuagaaggagcuacccaaauaauuuuugggcaccagaaaucgucagaguuaggaggguuuuagucuucagauuaaaggaauguagcauaaacauaguagauuuuuauaauuguuuaaugagacugcacaugaagcuuggguauuaagggaguguuuagaacuaggggcuauuggaauggucaaggaccauggauauuguuccauccagacccuuuauucacaccgacuuuaaauauauacacuauuuaacaaaugaaaaauggaaaaacaacucagugguggucuuuuucagugcaaacagcuauaacuucgcuguuaauacuuccauuuccuugucuauauaguaggguaauaaggugguugugaggguugagagucagugagaugcccaguacagcccuugccacguaucuuucugcaaguuuuugcauacggugaugagugaagaaccuccaaaccucucucugaaggucaaaaccgcuuuccgggaugccgcugcaaagcacagugcaacaccaagcagugcccgugcuaccuggcuguccgagagugugacccugaccucugucuuacuuguggagccgcugaccauugggacaguaaaaauguguccugcaagaacugcaguauucagcggggcuccaaaaaggugagcaacaagucacuucuggaagauuguuuguaguuagcuauuuagugaugcaaaugucaggauugccuuagaugauuuagcuggggcaaaaaguaaaagugauccuugaaaggugcaacugaugagaaaguguucauaauuuucucuggguaaugcacccuugggcagucucuucaguuuuauauagagcaccauacucugauaguaggagaaaccagcaaauucugagaaguagccauucaugguaucagauuuaggaauaagagguauuuuuucuaccuguuuaauagauuauuugaauuugucuuuuaguuaauaguuuaucuaguauccuuaaugcaaauaaauggugauuucuaucaaaauauagacucauucucaucaaagaguauuuauagauuccuugcuauguagaguaaaagaugaaauuucccauggcagguuuuuauagacuuacuuccuguuuguuuaauaaccuugaaaaaaacccagcuaggaacuauauauuuuuagucuggggaauuguauguaggugaguuaacucuaucagccaggaaguaaugauugagcaaaagacacuucagcagcauguauuugggaaauuucguaucuuuuuuuuuuuuuuagggcagaugauaaguucuuucuucagucaguucuuuuuauaauaauagcugacauuuauuaagcauguaaaaauaggcacuguugugagugcuuuaguggauuuguucauugauucuccuaacccugugagugaggaguaaguguuaacccccauuuuacggguaaggaaacccaaagucacaagacuuguaaaggagcaggagaucaaauccuccaggcucccauuaaccugcucuuaugcucuguguguguguguguguguguguguguguguguaugugggguguagaguagacauaucuuuguuguuggaccauuuauuuauaauugagaacacacuucuuaccagcaaguccccuucuaccagaaauucugcuccaggcaaaacauugaaguucucuugguuuuguuugugucuuugaaccaaagucuguguuuauggcagagaguugugcaggguggugggcuuuuuguuuuuagcuuugacuuuuuucuuuucuguuagacauuuagaugauuuuacucuaggcaguuauauguccauuuaggucauuggaucacagugacucugguuccguuuccgauggcauaccugcucagaccuaaaaaucucaauuucccccccaaacaacuuaccauuguacuccuuccucacuuuguucagaaagugggcaauucuauucauacugacauguccucuuuguaagacauuuuuuaacucuuaaaaauguuaaacuauguagauaccuuuuaccaguuggguuucauuugcauagcaguauuuagcuaauuuaguuucugaucagaaggcuauuugggaaguucacaugacaggugagugguaagaugguccagaauaggaauagauaggaagccuuuguaaaggucacaagaaaauuuuggaugaaagcauaauacugagccgugaugaaaaauuggcauauguuggggaacacaucccuaaauacauaauuuauagcaaugaucaucuuggcauuucugcugaaaauagacuacuggacugacaagaucaugauaacaccucccgguaguuucuuguguuauccugaggaggugggguggaagaacaaauccaaagccaagcugcuaugggcuucagagggaaccaacgccagugaagaaucaggggguguccuggggcugaaaauggaauaacuauuaauagaaucacuuggggaaaguagagggaaagguauggagaggaagagugauuuggugguguccuuauauuaaauucagguugaaagugaauuacucgaggaaaucaagggcugaagauacagggaagccaaaagugcagcaggccuagagcaccuugcugaacgauggucauugcagaggaccaacaccaccaaaagguuuucuguaagacagagauucuuaucugcuguauaaggaaaacauaauguucauagccauucucagcagcuuucacguugacugaagcugugugcccaauuacugccuuagaacaaacaggucugaggauuuacagugauagcuuuuguuuucauucuguagucuacuuuguccccaguccauuuucacccuccuuuuuugaugaugugauuguguuuuauucucuagcaucuauugcuggcaccaucugacguggcaggcugggggauuuuuaucaaagauccugugcagaaaaaugaauucaucucagaauacuguggagagguaaggcacugauaaccuguauucagguggcauuguauauacuaacuuuacuuuauuuuagauugauuuuauuagguaagucuguggguuugauuggaaaugaauugccauaaacugccuuuucagccuggacuucugcauguuuguggauuugcaugcuuaguaacuggauugugcugggcgcgguggccgacuccugcaaucccagcacuuugggaggccgaggcagguggauugcuugagcucaggaguuggagaccagcaugggcaacauggcaagaccccauugcuacaaaaaaugcaaaaauuagccgggcgugguggugcauacuuguagucccagcuacuugggagcugaggcaggaagaucgcuugagccuggaagagccugggagguugaggcugcagugagccauguuugugccacugcacuccggccugggcgacaaagugagacccugucucagaggggaaaaaaagcaaaacaaaacaggauugcuugguucuagccacauuuaguuuuucucgucuagggacaacagggagaacaagagcuuuaccauagaguggccugcuuaauccacaaccuaguugauaaggaccuagaaacaacaacgucauuaguuauucaccuuuuaaauugucgacaguguuaccgaaaaaucauaggccuagcuucaguuuggaaccagcucacccaaauuuuuuuuuuuuuuuuuuuuuuuuuugagacagaguuucgcucuuguugcccaggccggagugcaauggcgugauuuuggcucaccgcaaccucagccucccggguucaagcgauucuccugccucagugucccgaguagcugggauuacaggcaugcgccaccgcgcccaggugaucugcccgccucggccucccaaagugcugggauuacaggcgugagccacugcagccggcuuuuuuaaaaaacucagcaaaaagacuuugguuccucacuuucuccaaggauaauuacuucaggauguggaaauauuucugaguugggguccuuaguauacaguuauucuuuauuacugcgcagaccgaaugggaaagagaacuuggcuguagugacccuuuuuguugcguuuucuccagaagguccaguauucacucugugcgcuuuuguguguucugucaggcuugaucaccuuuauccaaaagaauuuucuccugugucuuucuuuuuagauuauuucucaagaugaagcugacagaagagggaaaguguaugauaaauacaugugcagcuuucuguucaacuugaacaaugguauguuucagagcugggaggcagugaguuccugaguugcauguggcagccuucugccggccgaguguucagaaacgaggguagaggucagugaggugaccagaaggaggaucuccuuagaggcauggggggcugcuugcuugaaaggaacuggagcaaggaauuccucagggagcagauagacuagaugugcaggaaaccgccucucuggagucccggcugucuguggguggcacuaucccagcaucuggcugugaaggggacguugugcucuugcugcucaccucaccucuuguguucaggcagcucagcacaccuccuccagucagugccucugagcggggaaggaggggaggagcacugcauuugcaaccaucuuccagacuccccuggauauucucaaaggacugagaggaaaggcagcugcuuucauagcugauguucugggguagaauguaaggcuguguagggauguuucuggugggauuaugugaaaauggagguaggcuuaacauguaagauauucagagaaacucuuaguuggaacaaguagaauagguuuuuuucuaugaaugcuuuauagacauuauaaugaaaaaaacuaauuuuaaaugugaaaaugccuauucgugauguuuggaagaauuuugucagauuuuuuuuuuuuuuugcuauguuuugcucaguaauguauguuuauaguugauaauuaauagcuuuugagucagauaaccaucuugaauuauaggugauuaauuuuaaccuggaacaauaguguguucuuccaaaugucauuucuuacugaaugaagcugcuugauuuauuugcuuuugcaggcaaacccugaagaacuguaaccaguugcauuuacaaaaucauaauaacuugguuuacuuauaacugaaauuauucacugggcugugcuuacuuuuuucuuuuuagauuuugugguggaugcaacccgcaaggguaacaaaauucguuuugcaaaucauucgguaaauccaaacugcuaugcaaaagguagguaccuuugacgugagaauuggaacucccuuuucaguccugugaugauggacuugaauacuucugggauaguuguuuguuaugugaacaagucaguuaaccccccguggcccgucuucaugcucacugacaccagugugucucuuugcaguuaugaugguuaacggugaucacaggauagguauuuuugccaagagagccauccagacuggcgaagagcuguuuuuugauuacagguugguaaaguacauuucuagcaugaucucuaagggcuuuuucuacuggauugugaacucuggacaaaggaggguuuuuaguucuuugcuucuuuugaugggucacuuugccaugagcauuaguggggaauuagguuacacuuuccuguuauguauuuauuauccauuuauauauuauacaaggcaugcuuauuuuuaaaauagaguaaaauccaugcagaaagccccauuucucacccugcuguugacagcugggugaguccuagaccuucucauaucaugccgcaugcugcaugcucacucguggagcguuuuccagauaagugcgaucacacuguccuauagauuuuucugcaacaugguuuuacuugacaauauacuaugcauaucuuuauggauuagaucuacuuaauuuauuguuugcuauaauacuuauuacacauaucauuaccauuuuaaaaggggcuguuggcaaaucgcugucugaucacccuguggggaugccugggacacgugggccaccaaugguaucugugugguuaggcauuaggcugccaguugacacugucaagcucugugggauacauuuaagucagccauugaauacagauuuaagugcagucagaugacugucuaguuaaugaacuccuguagccccguguacaucccauccagaagcugucuuugaguacuguguucuugcauauucaggcuggccuuuaauggcuguugcacagcagcgagcucucagugaggcagacagggucugagugaagggcccacuuuagcaaaggccgcugccuucacuccaggcuggcucugaaugaagagugugggguggagcuuccuugggaugacccgguggccucaccccccauggugggcuucuugugcuccucucuggguguccgcugcacuccaguucuugcuucaccugggggagcaacuggcgggcugcucuuuggcccucuuugcuauggucaucauuuuuuccagaccaugguucuauuuugccuucccagcgucaggccuaagcauccugauguggaccagccuuccugggaccacuugcuucagaggcauaggggaggcuggucaggcucugggaaugcuuguagacagguuuguucacuucagaacuuggcagcgucucaauuagauggccagcaacacagaccuaugcauugccuucuaugaaugugccguuaugcaggcagcuguguaauuggauggguuuuuuuuuuuuuuuuuuuuuuaaagacauuuuaaugcacccacuaucuucagcaggcuuuguuguguuaagucucagcacauguuggauggguggccauccagcggacaucuccuuccuguuguuucagauacagccaggcugaugcccugaaguaugucggcaucgaaagagaaauggaaaucccuugacaucugcuaccuccuccccccuccucugaaacagcugccuuagcuucaggaaccucgaguacugugggcaauuuagaaaaagaacaugcaguuugaaauucugaauuugcaaaguacuguaagaauaauuuauaguaaugaguuuaaaaaucaacuuuuuauugccuucucaccagcugcaaaguguuuuguaccagugaauuuuugcaauaaugcaguaugguacauuuuucaacuuugaauaaagaauacuugaacuuguccuuguugaauc

SEQ ID NO: 191606 - RNA, 25629 nt, Homo sapiens
uuaacguuuuuaaucguguuuuauuccauugccacagccuacucuaccuuuucuaccaccccgcaguaucugccucuggguccaggguccuuucugcuccggcacugggggcucucaagagguggggcugccacguggguggccucucccuggagcugagcccacccugggggacccuggaucaugccccuuugcccccagcccuugguuugcagggaggccgccuggcgaugcccagccugaaacagcaccccuggcagggcugcucaguggcagcucucacuuugugcucaacaggaagcaaucagaaacacauaccagaagccaaaucuacgccaacaauuucucagacaacgaaaaagcaaagagcaaaaucaacaugauuuggaaaaggaauuuuaaaccuuaaauuaaaaaaagaaaacauuuucacacagaagaauuaucugcuuugagaaauaaagaaauuagaagguguaaaaaaaaauuuuucaaaccccaaauaaugauaaaaauagauguauccucuguaaaaaucuggacuaaacuauucagucauucaugguuauucaguauucagagcaugaagugaaacaccaaaguauaaaaaauuaaaaaaaaaaaaaaaggaauccgagauacugucguuuguugccggccucggcguggacgccccgaccaugggccacgcagggcgucugccuccucccaccuuccgcagaccucaggccuucaaagcucuuccuugguccugcucaguuuuguggcauguucuucuauaaacuugcucaaaugcuccagaucucugucuccacccucaaauuuaacuggguucuuuuuguccccacugggggcgaaguagaugguggggaagcccuccaccuuauagcggucgcuggggacgucguuggcaguggcguccaucuuggcgaugaccaggcccuuuuggcccuuguacuucuuggccaggcuguuguacacgggcucuagcugcuugcagugcccgcaccauggcgcguagaacucgaugaggacguccuucuugggguccaucacaauggagucaaaggucuuucccaccacgaccuugacgggucccuuguuguucuugggcacuggcugggauuugaugacuggcuucaguuuuccugccaaggaaagcaaggcgggagggggcgucagugcugcaaaggccaaagauucugggggcucucucuggaccaggcagugagguugguguggccaccagacgggccagucacacaggaagagcccacuacuguagaaaguaguagcugcuacucucuacucucuguccuugcaaaggccagagagguugcagguggcuccagcccagaccuaaugggccaucggguccugucagagaggccaucacaagagucacugcccaggcagaggaguucccguaagcacuggcacugagggcccgggagccaugggggggaggugccaggacaacccacagacaucggaacagcauggccugcccacaaaauguggccagcgcugggggccuggggccaugugcucagccaagaucaacaggcucuguuuaaagcuguacagcaagguggccgagggugaagaggcucugagucaggcucugaagccacaagggguguucagcacacccagacuuugcccugucugggcuccaucuucagaugcccccucugcacaccccggcccuagucuggaauuuuagcacaucagcgcuggaaaugugcuaaggccgcugagugaugcuagguaagcccugagauggacuccgaaucuugcuuuugcuuucaaaguaaacacugggagaacugccaagaagaaaauaguaacacuugcaaauccuucuucuaagcuauucuggugccuuggaguuuggggucacacccgacauuucucuggacgagaagucagagucccucgggggugagagaggacugcuggcugacuuaagggggugucgugcccguggccagagcaccagacgccccuggccugucuggauuccgcacgaggagcacagcagcugaugggagaccccagccccagccacgggcucaccuuuuuugaaagcagugacaaacucgcggagggugucagagucaaacuccucuggcuccauggcgaacuucuucccacucucguccaggauggcggcauugacauccuccccacucucgcugagccccagguccuucaccuccccagcauaguccucuucguccgcaauggcaaagguguacucagggaaguccuuggccaccucuaggacuuugcuccgccaaaacugaguugcugaaagggaccaagggccauaagccaggcggccacacagagcaagucccagcucagacucugaggucaggcuucagguccugucgcuaauauucugacaaugcucaaacccuggauuuaccucaauuggagggaaacauguuucuggaaaagccccacuugucacgggggccacagcugcaagcccaacaggcccuuaagaccugugcccagguggcacggccacgccugccuggggccagggcuggucuagucccagcucugcagccucugaacuccuccaagucucagcuacgucaacucuaagaggguucugcaccugaaucuaagcucccauccugcuaaaaagggaagccaucaauuaaaaaauauaccugagccaccaacgugcaagggccccaggcugggauuucugagugagccauguacauacagccacaccuccccucaacacuccaccuugccugaaagaacgaguccccccaccccccacccccgcaggucuuggugggggucccucaccagcucuguaaucaaagcugaaguccacacuguaguagacgaccaccagggggcgccugguguagcgcuuagcaucguuugacaccuugcgguggccaaccaggggcagggcguacuucagcacgaaguccuugauggccgaguccuggguggagcccugcuucaaagagggaacaggugagggggcccaccaucuccccaccauuguucuugaguacaauguuugagggacuuugggggaguggcgacuuugaaggggaucagucuuaggaggcaaaacaccccagggcucgaccccacucaagcacagcccagucauucccuaccgucuuuuggggcuccuuucccuccagugaaccguagguggcuucuugggaaaaggcaaacaccuuggcccuuuccuuggggguguaggcucacuaaccccacaaagagaccacucaagguaggccuggcucuuggcagacaggaaggguuaucacgggcugggcuguguggaacuuuccaccuucagcuugugcggucuucacgcaggagguccugagggcucacacuucacaacgacuggagucccucacagacaucgcccuccaggggugggcagagcaaggucagccaccugcccaaggcugcgcagccagcaaguggugggugggccugugagcccaaggguuuccguggggaugggauacucagggagggguccuuguguggcacugaaggacaagagggccccgcuggugagaagggagcagaaggcacucagggaggcagcagagacugaggcagggcacgaggcacaaacaggaucuggcgugacagcacuggagggugggaugugcugaaaagguggguaaggagggccugggaggccaugcuaaggcacagauaauccaacuaucucccagguggcaggaggccguggagucuuuaaccaugacauggcgcugcgugcacuucacucagcagggaaacgccagaagaacugggagcagcagcaaugugcccaacagacaagacugcauagaucuugaagcgucuacugaaagcuacagaccccuuuccuggaauaugcacucacacacagagcuguguccgauucucgggaucaauggccccccaagcucaucaggaccccucuuugggcccaggaucuuaucucuggauggaaggaagugaagcuggggggaggggucgcagcagccacuaugaguccagggaagaggagaguugcccugagcuucaaguuggcagagaaacagaugggauggacacacagaccuugagaaagagggacaggacuaaaaacugaggaaggaaacagaggacauggggaccagaaagauucagggugguucucuccaagguacugccauguucuggugcaggcccccgggauuccuguccugucacacccccugcuccaggucccaugagagcccacagcccaaacagccaggguccugacacuaugggccaguaggaccuggaaaggccccuucaccccaaucucagcucugcuucccaccaggagcuguggggucuggggugggggguagagcucacuucucugcagcccaaucucuguuaaaccaaagcuucaaacucgacaucuaagauccuuccaaaucugagaucuacucaccgaagugcagggccccuucuaaagcacucagaaggcugaacuggccccagguuccccuugggcugggaacucccacugccccucuagggcugagugugucacacucuaggaggaugaagugcaggggugcaguaauggaaagaaaggcaaaauccacccaccaaggucaacagcucccucuggugaacagacagggaugcugucccucuguagcccccagcuggagcugcccgaacaaacacgacuuggccucaacggagcaccaugugcuggcccaggccaaacccacaguggaacaggcacuggagggagacuggugauugccugccaggagggacaaaggguggcagcaacuguucuggcaaaaccaaguggagcucugcccagccccaggaccugccaggugugcgggagccccagcccugucccuccggcaaagagagaccacaggccgccugcagaaaaccugugggguggggagaacgggcuggaaaaggaguuccagacccugcagacaagagcgaaaccuccacguuugaaaccucagagguggcucaaagcagaguccucaugccugcgggguguccagggcuggcauggcagaggggcccgcuuaccuggacguccaucauguggcuccggggcucauacuuggacuggaauuucucaggcugcauuacaaccaacugccccugggagacuuucaagaacuuugcuauuucugugcugaaaguguggugaaauuuguaaucuucucucagguuguuagcugaaacguuaacagaauaagauguaauuuugaaaauugccuaaaugucugagauuuaauucguuacccacaucagccaaagcaaauguucugaaaaugaccacuguaggcugggcgcgguggcucacgccuguaaucccagcacacuuugggaagcccaggcagguggaucacuugagguuaggaguuugagaccagccuggccaacauggugaaucccugucucuacuaaaaacacaaacauuagccggguguggugaugcaagccuguagucccaacuacuugggaggcugaggcgcaagaauugcuugaacuggggaggugagguggacguuguagugagccgagaucacgccacuguguacuuucagccugggcgacagagugagacugucuuuaaaaagaaaaaaaaaaaagaaaaagaaaagaaaaaaagucaccaccaaaaauuguguggacaauuccuauaacuuaaacacuugaaaggagguucguuuuuaaaaacuugguacaagguauaacgucuaaauccuggccggccacaguggcucacgccuguaaucucagcacuuugugaggcugaggcaggaggacugcuuaagcccaggaguuaguucauuuauuauuuauuugagacggggucuugcucugucccccaggcuggagugaaguggcgugauuucggcucacugcagucucuguuuuccaaguucaagccaauucuccuuccugccucagccucccaaguagcugggacuauaggcauaugccaucaugccuggcuauguuauguaauuuuaguagagacaggguuucaccauguuggccaggcuggucucgaacuccugacaucaagugacccgccugucuuggccuccccaagugcugggauuacaggcaugagccacugugcucagccaaccccaagaguuuaagaccagccugggcaacauggugagaccccauuucuauaaagauaaaauaaauaacaacaacaacaaaaaaaccccggaaaaguucacagaaaaacagcuaauuugccagaagcugcugucaacugaugucuauaagcagcacugauucuuuggcagggggaauguucuggagcccacaugagcagcacacaguccuauaucccuauguggaguuuucacacccagcacccuucguggagguuuaaaucucccuuccucaaguuggugggcugccuguuugugggcuggagcuccgaaugaaguucuuuggcuaaagauacuuuuacuuaaauccgugaaaaugcaugaugaaaccccacggucugagggcacccuaccacagggcugggcaaacuuucugagaaggacuagagagugaguaguuaaggcucuaaggaccauguggucugucccagcugcuuaacucugcugcugcagugugaaagcagcuggacaggguguggacaaagcuguguuccaaugagaugucacaugcaaagacaggcuauggccagaaugggugugugggccacagugucaaccccuacccuagauucuacagguaaaugcaccuucagucccucuccauucuccuccucaaggcauccaaacucauccugggcugauuuugagauuuaaacauugggugucacccuacccuugaagggcucuuggucuagagguuugugacucucagcuggguuauaggacacauguggcugagaugguaaaccauguuuuugggagggcaggggaugggggggcagccuggauaagccuguggcuuucagagucagauggacuuagauucauaugauagguuugugaccuacuaacugcguagcuuuagacuuguuaguuauuaaccuuccgagccacaggcccuucucuguaaaacagaggcauuaaaauccacuaaauaaggccacacgggcugggugcugugguucaugucuguaaucccagcacugugggaggccgaggcaggaggaucacuugagcccaggaguucaagaccagcugggcaacauggcaaaaucuugucuccacaaaaaaaauuagcuggaugugguggcgcucaccuguagucccagcuacuugggaggcugagguggaaaaaucaccugagccuggggaggucaaggcugcagugagucgagaucacaccacugcaguccagccugggcaaucagagugagauccggucucaaaauaaauaaauaaggcuacagcuaucuagauggcgccuguuuuaagccuccagguguccuggggauuuguagucaguuggcuucaggcagagacagacccgcaucaagaacuucaccuccugcccaccccaggaccacagacccuuucaucccccagccgcccucucugcuccggcccugccaaccuaucuguagaacaucuugugucccuggggcuaaccccucucucauaagcaggcccagugacucuugccccaucugcagcccuaacccugcccaagccaaaucacagacugacuccuaggaauguggugccaggccugccugggacccacagcacuggaaccugcauuuuaacaaauucccuggggauuugcaugcacaucaaugcacguaacuugcagucagacuuggggcuacggaauccccugcugcccauaacccuggguggguugggguuuccuucugcaaguuucuuccugacuaguuaggcgugaauaacaaggccaccuaauuaacagaugaagggaauuuagcucuacugguuuuauacauuaaucugcauuugacuuaugcacaauuguuauuguaaagcacagaauuagcacuaaguagcaagcugugcauuugaaaaauuauaaucaguuagcacuuagccaagcugguuuugguguagugggagaggguagcacucagaagacaucaaugaggauggccaggacccugaguacaccuguccccaggcaucaggagccagaccaaggcagacgauggauuucaggauggggcaacugcugccugccccuaccccaacagaacacuauugcugacagcuguucacagucauuucacuccucaggcuagcaagacuagcauuuauaauacacuuagcauuaucaaguacauugcuaagcucuucaucuacauuaucucaguguaauaaccucucagaaaagaccaccaccuugggcaagagaccacuaggcuaacugagucaccaccuguggucacagugauaauaacuggaagagccaggccuugaaagcugguuugauucagaggccggcaccuuauggccugaagaccugcccuccucgggcucuggaaggcagacauggagcugggaccggucugacugugccccuccccugcaccgaggccaggagggccacaggggacccaucuccagccccagccccaacuccaaccccagaauggaaagcuuauucccagagauggcucaucaaaccacccccuaauggaugucccaggagcuuucugaaaaaccaggcaaccgcagacggcccaaggcacgcacauuuuguucagcccagagggccacaacucaccggcauccugguauugcugguaggcugggucacucucccccuuaaagaccccgaugaugaugacaucgucuccauccuucaggaacuccuggaccugcuucagggucagaaucuccuuggagggaggcccggacugcucgaucauguaaucaacgauuccugggagcagggcacacgccugagcaggggcacuaagaacugcccacuucccauggcccaugccugccagcccccagcaccuucaauggcagcuuccuguuagggaguuucccuuccccacuguagugggagagaagggaguggccauaccauauuuuucucgugggccguuguagucauaaggccuuccuuugcggaaaauuuucagggugggauagccagagacaucaaaccucuuggccaggucuguuucugcgguggcgucgaccuuugccaggggaauuggaggagaacgcuugcugagcuccuuggcggccuucucauacucgggggcaaguuucuugcaguguccacaccugccaagaggaaacugguuugucaggggcucauucuaguguggacucacuuucuagcuaaaugagcugcagaaacccauccugugcucccuaguaaccuggccacacccaguaagccuccgaaugccuccuagacccucaggcccucaggugcuguugagggcgcuaccgcuggacagacacaaacuucaucccacagcauucacacacuggggguggagcaugcguacacacauguacaggacacagacaggacauuaguaacugcggcacaggggaaaacauggagaggccaagagagacacuguccugagcaagaggacuuucuugguuggagaguugggggccagcaaggauguaagucauagauggcuucagaggaggaguagcaguggagcuaggauccaagggacagcgaggaauuagccaggagcccacgggagguggggcgaagagagggucggcagguccagguaacaagaacagaggcauggagaacagaagagcgucacaaacccucacugacacagaccacccagggaggagaugagggagagucccuuggagucaguauugcgucacacagcccauugcccacaagaacuggccgggcgcaguggcucacuccuguaaucgcagcacuuugggaggccgaggcagguggaucaccugaggccaggaguuugagaccagccuggccaacauggcaauaccccgucucuacuaaaaauacagaaacuagcugggcaugguggugggcgccuguaaucccagcuacucgggaggcugagacaggaguaucgcuugaacccagggggcggagguugcagugagccaagaucgcaccacugcacuccagccugggcaacagagcaggacuccgucucaaaaaagaaccaacaucccacacccagcuggggccuggcacacaggaggcucucaguccugaguuaagauaaaacaccauccugucaaaguccuuaggacacccaaaugaauuaaagggugcaucuugcaacuucaaaaccauuuguuggcuggcacaguaguucauuccuguaauaucagugcuuccagaagcugaggcgggagggucgcuugaggccaggaguucaagaccaaccggggcaacauagcaagaccucaucucuaaaaauauuuuuuauauuagcugggcgugguggcacacaccuguggucccagcuacuagggaggcugaggcagcacaauugagcccaggaguucaaggcguagugaacuaugauggugccacuguacuccagcccaggugacaaagcaaggccuuaucucaaaagaaaccuaagaaaacaaaacaaaaaaaacaaacaaccucccaccacacacacaaaaacacaucaaaagaccaaaaaacuguuugugaauaaauggauaauuaucuucugaggcaucaucaaccacuucagggaaaucgcacuacacucgcugagcgugcacugugcagcagucggcucaaccuggcuccugagcgagccacaaagcaacccaccaguuagaugugcagcugccacucucccucucacaccucccacccaucaggccagggccccaugcauagcgaaacaagggucugugucucuccagcaucgcaaggggguuagaagggugccccacgugucccagacgcuuccuuccuucucucccagaucauuuccuucucuaaccacccaccugacuucacuuuucaucugcacauccagcaacucccagguuucugcugcagaaucuguggccucagguuugggcuuauccaggcauugccuggaacaaggguguccuggucccaaaccugaccccacagugcagaaggugccacccaccccccggccugugcaucagccauggccuccaccugcugguucuaggcccaaaagcuuccucugcuuacugacucucccagacucccuacagaacacacccaucugaggcgguucuugguggccugauggucagacauaccaggacugcucaagaaccagaaccacagcugacccaccacaaaaucaccaagacagaugguacccugggccgucuccugggaaggcagauggucucuccugaagccaggcuccccucucccuugagagccgucuucuuccgcucugcucucuacucugacugcugccagcuuauccacgcaacugguugugcgucccuccccuccccuccccaugaagcagccaccucaguuccccaagcugggcagcucagaccagccacuguacuugcucccacuccgaccaccucucuuucugccaucuucuuuccuuugggucccuucucccacccaagaauggacuacuuggcaguuccuuccacauucacucccccaacagcucucuuacauccacgcuucuuccagaagaccuggagccucaauccuggccuacaacucgugcccaccuugcuccucugcuguuccugccucacgggcaggggccugccaccccgcaccuagugcccaccaggguacugaauauggaaagggccugacaccaccuuaccauggggcauaaaacuccaccagaaugauaucugcaucauucacaacuucaucaaaguucucuuuggucaacacaagcgugacuucugguggaggcguccagucgggcugggagacuucucugaccuuggcaacaauuucugaaagaaaccaagcaagacugagcacacaaggcccaaacuggcaggcacuucaccucccuccagaagcagaugaggagggggaagaaagcaagugucggggcccacaagaacaggaggugucugauuuccugaaaccuggcugcaucucugcaguuuuggggacacagccaagagucagaagguucgcuauuucccaacaauuguccaucgcauuuccacagccugcagacuucuccagagggccuaagacuuacugaugguugagacuuccuuuaccaucaggcuaugguacuaacuccacgcaaacccucaccaacucccaaugguuuugauuacauaugccuauggauagcauuguggggcaucuccugaacacauacaaaauauauacauauuuagucauucacaucuaauguuacuauauuacauacgucauaagauguaugcaaaaaaaaaaaaaaaaaaaggaaaaauuuaaaagaggagcaguagcucccauugcucaaggugcaguggcauuaccugagaaggcuuuuaaaaaaugcccaucuguggccucauucuccagaaauggacuccagggcuggaguggaacaauaaauucguacaaaaaaugugccaagcaguucuuaggacgagugguugcaaacugucacucuuuuuccccacugcagaaucuaccaaggagccaaaucuacagccacuccugcaaagcugcagucuucaaacugaaacgugcacaagcaccuccucugcgcauucgcagcaugaagugucugugcccugccccccagaccacacccagggguccugaggcacuuaacacauaggaggccucuuuaucaaaacauagcauacacugcucuaaaguuugcaaaacagccaagucucuugcagucaaauguuggccacagaccuccaaacgcauaugccuguuuacuucacaacaauagaaguacucaacuuuuaggccaggggugguggcuugccuguaaucccagaacuuugggaggccgagguggguggaucauggguggucaggaguucaagaccagccuggccaacauggugaaacccugucucuacuaaaaauacaaaaauuagccgggcgugguggcacaugcuuguaaccccagcuacucgggaggcugaggcaggagaacccacuugaaccccggagguggaggcuguucggugagccaagauugcaccacugcacacuccagccugggagacagaggaagacuccaucuaaaauaaagaaguacucaacuuucaauuuguuuuagauuaaguucuuuauguauggauauggcuaagacauaucuguuaaauaaaaacaugaagguacaggauaguauuugacauauacuaauaacuguaaaaaugagaaaaucucucucagacagauacacacacacaccugcuuuuaugcauacaaaauaucuccaaacacagaagaaaccuguuacacuaguaccuuuuuuuuuuuugagacagagucucgcugucgcccaggcuggagugcaguggcgcgaucucggcucacugcaaccucugccucccggguucacgccauucuccugccucagccuccuccacacaccagccaccugccaccacauccagcuaauuuuuuauauuuuuaguagagaugggguuuaaccauguuagccaggauggucucgaucuccugaccucgugauccaccgaccuuggccucccaaagugcugggauuacaggcgugaaccaccgugcccagccuacuaguaccuucuuagaggggagcuggaucacccagguucagggaagaaagacuauucauuaaucuaccucucugaauuaccaaguuuauaaauguauuaccuagucaacaaacugugacacuaaauaucaacggaagcaaauccauucucuuuguauacgccacagugagugccauugcuuaaaggagcagaggagagccucucacaccaccucagagaugugaucucagauuacauccaacugacaccaugcuccacagaugagaugccaaggccuggcaagggcaaggcgcucguccagaacacaggccuaucuuaugucuaugaggaccggaagccuauucaacgcucuuuccucuacuccacacugggaauggaaaaugcagccgcaucuuuuuuuuuuuuucugccagugauucagagagauuugcccuugcuaaaggauaccauguucauucaauaaaauuaaauaauuuuauuaaaauaagaggccgggcacaguggcucacgccuauaauuccagcacuuugggaggccgaggugggcggaucaccugagguugggaguuugagaccagccugaccaacauggagaaaccccgucucuacugaaaauacaaaaauuagccgggcgugguggugugucccuguaaucacagcuacucuggaggcugaggcaggagaaucacuugaauccgggagguggagguugcggugagcugagauugcgccaucguacugcagccugggccacagaagcaaaacuccgucucaaaaauuaaauacauuuuaucaaaauaaaauuaaauauuuuaucaaaauaaaauuaaauacauuuuaucaaaauaaaauacauuuuaucaaaauaaaauacauuuuaucaaaauaaaauuaaauacauuuuaucgaaauaaaauuaaauaaaaaucaaauaauuuauuuguucauucauuuaauaaaaugcauguagugucuaaugugagccaggcagggauccaucaggccagauugcagacauccucagagaaucccuggauguggcucucugcaccugugguucucagcacauggcuuugagccagcagcaauuuugagcaugcagcagcccugcaugcuuguaagaaaugcaaauuauugggcgggcguggugguucacgccuguaaucccagcacuuuaggaggccaaagcgggcggaucacgaggucaggagaucgagaccauccuggcuaacauggugaaaccccgucucuacuaaaaauacaaaaaauuagccggacgugguggcaggcgccuguagucccagcuacucaggagccugaggcagaagaaucgcuugaacccaggaggcggagguugcagugagcugagaucaugccacugcacuccagccugggcaacagagugagacuaagucucaaaaaaaaaauaaaaaagaaaugcaaauuaucuggccugacuuguacuguaucuggccugaaaugugcugaaucagaaacucuggcgcuggggcccagcaagcugaacaagcccuccagaugacugacgcuugcuaaacauuaagaaccagugcucuagaccaccaccaagacccgugaccucugaugucauuuccuuacacuccuguuuauuuauuuuuugaaacagagucucauucugucacccaggcuggagugaaguggcacaaucucagcucaccgcaaccuccgcuucguagguucaagcgauuauccugccucagccucccaaguagcugggauuacacucaugagccacuacacccagcuaauuguuguauuuuuaguagagaugggguuucaccauguuggucaggcuggucuugaacuccugaccuaaagugauccagcugccuuggccucccaaagugcugggguuacaggugugagccaccaugucuggcccauuuccuaacacuccugcccauguuuugaguuucagagucugaaauguaaagaugccacgccccaacccacccugcccaccccacuacuccccccuccuacccccccacccccaccccaagagcaaauaaacauuccagagggcuaagguuccugagaaagucagucccugguacccucagcuuuucuuccucuauuagccaaauucccauucccugcgggaaggaguucuuccucuacgagcucagguaccagcucaccuuccuggguucuggagcccucguagucuacagccugccccuucuuaaggaucuugauggugggguagccacucacaucaaaccugcuggccagcacagacgcugagguugcaucgaucuuggcaacaggaaugggaggaucuuuauccuuuaauauguuggcaauuuuuucauauuccggagcaaacugcuugcaauguccacaccuaacaauuagauuaggaagggcaaaaaacguuaacuguaccuaugggauuuaaauccaacaauaauacauaccacuuugguuuggaugugguuuguccacaccaaaauguugaaaucugauccccaguguggcaguguugggagaugggaccuagugggaaggguuuaggucuuaaggguggaucccucaugaauaggcaaaugcacuuucacgaauguaguuuaaaagagcuugacauggccgggugcaguggcucacaccuguaaucccagcacuuuggcaggcugaggcagguguaucaccugaggucaggaguuugagaccagccugggcaguauggcgaaacuccaucuuuacaaaaaauacuuugggaggccaaggugggcggaucacuugagaucaggaguucaagaccagccuggccaacauagugaaacgcugucuguacugaaaaugcaaaaauuagcugggcuugguggcaggcgccuguaaucccagcuacucaggaggcugaggcacaagaauugcuugaacccagaagguggagguugcagugaucagagaucaugccauugcauuccaaccugggcaaaagagugaaaaucugucucaaaaaaauuuuuuuuuaauuucucaguuuuaacuucaaauaugguaaauauugauaaacaugacccauauaaaaagcccucugagguccucacuucuuaagaauguuaaggucucuuugaacuaaaaaguaugaaaucugauaauuuaugaaagaggaauaauauaaccucauagagucuugcucugucgcccaggcuggagugcaguggcacaauuucagcuaguugcagccucccccuccuagguugaagcaauucuccugccucagccucccgaauagccgggacuacaggugcgugccaaccaccaugccuaauuuuuguauuuuuaguagagauggggguucaccauguuggccaggcuggucucaaacuccuggucucaagugaucugcccgccuuggccucccaaagugcugggauuauaggugugagccaccaugcccggccuauuuccauguuuuaaauaaaacacuugugcuacgcuugacccucaggcacuggacaaaagugaguauauccuauuuggucucagaagugaaacagaaagggcaugagacagaagagcaaagcaggggucaugagauucaaaacaguagaggagaagggaugagagggacacaagagcucuaacggucugcacuaggaggaguaaagacaggaaaagaaguggggaugccugacugguccccccgcagggccuauguguguaguaaaaaauccaccacacaggccaacagccugcacuuggggcagcugccugagcaacagccuuugagggaagaggaaggcaggguggccugagacaggucggagcagaaucuauaacaaggacgugucuguuaccaacacagggcucugugucauugccgcuuguuaaaugcccgucccccagcugugaccaucagaggacguauucaucuuuaacccacuggacugagacaagaagacaucgccuuccaugagggcuggcucacuggccguucaacgcacagugguagaacgagugagcucccagcguucuuaaagcuagagugcaaguuccugcacccagacacuccuaccccaccccccaaggucuggaugaccgggugaagggcugagcgaauggagcacagcgcuuguccaccugcagaaauuagaacgcgguccuuaccauggagcauaaaacuccagcagcacugugucuuugucagccacaaaauuaucaaaguuugcaucauuuaggaccaagacuccauuuucuuccuuaacuuccaagucgucuucuuccucaucaucaucuuccuccuccuccuccucuucauccucaauggcauuuucucuguuagaagaaucugaguggaaaacacccagacugguuacaaagcugguggugacucuccuuaaaacuuuccuggccgggcgcgguggcucacacuuguaaucccagcacuuugggaggcugaggugggcggaucacgaggucaggaguucaagaccagccuggccaauauggugaaacccaaucucuacuaaaaauacaaaaauuagccgggcaugguggcacgcgccuguagucccagcuacucgggaggcugaggcagaagaaucgcuugaaccugggaggcggagguuacagugagccgagaucgcgccauugcauuccagccugggugacagagugacacuucaucucaaaaaaaaaaaaaaaaaaaaaaacuuuccuaaaauucauacacuucagaaugugucaagucccggguggucccugggggcccaccacgucauuggcuggugacaucaggccucccucaugccagcuguucuaaguuugcuacuuaaaauuucauucagagggaggucauggcuaaauaauauuugaaaaccacagcucuagaauauaaaguccaaaugucccaggggaaguuggagggcagcacagacuacccuacccuuccagagucgcggcccccugccuugcucugcaaacccugcccugagcccagacagccuccgcauuggccaccuccucccuacuuccuuguaccacccucugcggucuucccgggccucgcuccuguagcucgggcuccccuacccacaucccacacucugcauuucagggcaccgcauuucgugaucucgcccuagcuugucuguguucaacguuauugcucacugaugugccgccuccuccucacccuguaugcuuuccacaggcagggccuucaguaacaccucccaucaacaaauuaucugccuggccccaaaagaguaccaacaggaaacaaguacucaaucuuuucacugcagaggauggaauacuaauuccauuucugaaaggggguggcauuuuaccucauacccauaaaaaauagcccuucagguuuuauaauccuugaggaaaaggcucaagugugaaggggaagagggcgggaaaucucauuuuacuuauaaaggcaccccugaguaauuuccaggauaacaaauauagaaauugauggggucaacauguaucaaaaaucacaccuuugcuuggaagcuaaguuuucuuccuagaaugugagaaauuguguauauuuuauuuucaagguucaacuuauuuuauuuuauuuuuuuugccaaaccacagauacaaagaacauggaauugccauuuuuauuaaccagguucucuggcuacugucacaccaguaaacugaacugggcacagcaagcacggcaauuucauuaacgcugaagccagaauguuuccggggccaauuauucuuuucuggagauguguuuuccaggagguaaaugaacgcugcuaguuacuguuuugggcuguggaugaggucagggucugaaaaccugccccugggaucccagaacuccuggggcucaccaacccugaugaaggaaccccgcguggacucuguggcugccuagccacggaggcagccugcacccaccccacauggcugugccugcccucugcuccuccagccuacuccuugggucugugccgggcagggagaagggggcagcuuuguucaucacugucaacauguaccaaucugcaaacuuuacaaaaaagccaacaagaaagcccacuggcacacacuagucacccgcacucaguccucuuccuuuuaaacaucccacagcuuuuccugacuugcacauuccuguuucaacuuaaggcuuaggauccucuuuugucggaggagggagaaagagcucuaaaaugccaaaagcaaacccacccaucugagaugagccuccugccugccaccccucccuccacaccaggaacucccuaggcacugucagaaguucauggagggcagaacacagagaaagacagccugggcgcaggcccaccuccccuggggucucgggacugcgugugucugacaguacaggcaggggccaggcugacaucucccuguggagcagagggaaacccaguguucccaagguuuucuggucucccuuuucagaucauucuagacccccaagagggagaaaaaagaaaagauccucugcucugugcuauuuagaaaaucuugcccacuguauuuaccugugucuuugaaugaaucgugugaggcugaaauacacaucuugugcugaugucauuaagacuaagcccaaguauuaggguuggugcaaaaguaaucgagauuuuugacauuuuuuuuuaaauccuggguggucccugagggagaccaccaggggccccggcuggcaguuaaguagugcuuugggaccauccauauccacucucacuaccuagcugcucugcccaguaggagucaaaguuacuugcaagcagauggaugggaagauuggaggaaggucggaaauaaugcacuggggaacuuaaucaacucuuccagguaggaaucacagcuaggagaggaagggaaacuaauuggcucggugcacagcauaagacugacguuugcagcgaagaggccuaaaacaugaccacauagacaacuccuuuacagggugaauuuuacaaaaaacaaagacgucuucuuaccuauggucggccucaagugggcucucaacauuacaaugugacagagcucucaugauuaagugggagcugacuagucaccaugggacacagcauuccuaagaggcaacuucuuucuugacccuuuuaaaaaaaugaauuuuggcgagacaugguggaucacgccuauaaucccagcacuuugggaggccaaagaggguggaucaucugaggucaggaguuugagaccagccuggccaacauggcaaaaccccgucuuuacuaaaaguacaaaaauuagcugggcauguuggugcaugccuguaaucuuagcuacuugggaggcugaggcaggagaauugcuugaacccaggaagcagaggaugcagugagccgagaucacaccauugcaccccagccugcgugacaaagcgagacuaacaacaacaaaaaagaaucccauuaucuuuuuaaagaauaaacaaaaugauaggacauucccuauguaauuaaggacucucaaggccccuaccuuuccauuuccuccccagcucacagacaagccaggauugauuccucugcaauuugggaaggugcuagcucuagccuucuaucuaccagaaacccacacaucccugcaagcaaaacaguccacauuuuagugggggaacacuuuucacugggcuucauuuuuaaagguggacauucuaggauagaaaauacauccagggccgggcaugguggcucaugccuguaauccacgugcuccucugggaggcugagacgggcagaucacgaggucaggagauuaagacccuccuggccaacaucgugaaacccugucucuacuaaaauacagaaaaaaguuagccaggcaugguggcacacaccuguaaucccagccacucgggaggcugaggcaggggaauugcuugaacccaggagguggagguugcagugagcugagaucgcaccacugcacuccagccuggcgaccgagcaagacugucauuuaaaaaaaaaaaaaaaaaaaaaaaaaaaaggccaggugugauggcucacgccuguaaccccaacacucugggaggccgaggcaagcggaucuccugaggucgggaguucgagaccagccugaccaacauggagaaaccccaucucuacuaaaaauacaaaauuagcugggcguggugacacaugccuguaaucccagcuacucgagagaugacgccauugcacuccagccuggacaacaagagugaaacuccaucucaaaaaaaaaaaaaaaauauauauauauauauauauauguauguccagagccuuucagcacccucugaaaagaugcaaccuuccucagcaugagacaaaugaauucccaaguucaucuccacauugcucagcccacaugcuaaggccucuccugaagugggggacccucaccugagcagguugccucaaucccuguccacucccacggggcacaccugaugacaacacuggguccugcucagacacaggcagcuccuuuuaggauguccucacucuccguccucagcugaucacucucaucucccccagagaagugccugaaacagcugcauaaacucuaccauucagccaauacugaagaguuuguauuaaacacagaaacaagaacuguuaucagcuacgguaaccaugauagcugguauuuauuguauguaccaggcacugugcugggcucuuaaacacaccacuucaccccuuaagggagacuguauuacacguuauauuguaucuuacagaugaagaaacugagaugcaggaacuugagucaccuguccaaagaucacaaagcuacuuagcggaggguccugaccacuuaacugcuaugcuguauugucacauuagauuuucuucccaauacgcccaaaguuuuugguggaaucauuuagaguuuccacauuuuuauggcuccgaaaauaauuaugucucaggaaugaaaagaggaggagaguuuaacaguuccuuagcacgaaaaauaggugaauuucuacuuacuuuuaaaucuaaacaaaccaauaccacauaaaagcaggcaacaaacaggaucagaauauuuuccuuuccuguuuuagcaugaaggauguguagagugcaggcaccuucugagacacggaaagcccugcaaccggaggcuuaaaccaucagagcuuaggguguauuuaguaaccauguugggggaaggagggcauuuaaguaccuagacaccacugugcugucuaaaucuaaaauguaacagaagcaaaaagaaaaaaaaaagccucgagacuugaaacacuugaggggugagguagugcagacuugaaauaaaucuguuggacaaguuaucagugaaucuaugacagguuuugacagugaauggccgagggaugcccucagggaugagaaagggucaagguaagcccacaccguggcucacgccaguaaucccaaacacugggaguuuaaggauggaggauugcuugaggccagccugggcaacauagugagaccccaucucuaccaaaaaaagaaaaaaaauagccaggcugggcacgguggcucacuccuguaaucucagcacuuugggaggccaagucaggcggaucacggggucaggagaucgagaccaucccgguuaacacggugaaaccccgucucuacugaaaaauacaaaaaauuagcugggugugguggcacgugccuguggucccagcuacuagggagguggagaaaggagaaucacuugaacucgggaagcagagguuguggugagcugagaucgcgucacugcacuccagccugggcgacagagccagaaaaaaaaaacagccaggcguguuggcaagcaccuacagucccagcuccucgggaggcugaggcaggaggaucccaugagcccaggaguuugaggcuuaaguaagccaugaucaggacagugcacucaagccugggcaacaaugcguaaccuuaucuaggaaaaaaaaaaaaaaaaacggagcuagaagucccaggaggccugcccuuggccaugaugaccccugggauuccuaggcucacccuaggagcaacugcuucccagggacucuucuguguuaaagaccucugaccggaaggauaaacuugcugguccuaacagcuccuaaagccacucucccaggccucucaagaauccccccaaaaacagaaucacuggaucaaaaccaagacagugcuauaugcuuuuccgcuauguuccaaaaagcaucuuccacccacacugguccucaacuuucacugugccucccgaaguuaauucuaugucucaagggaaaacugacuuaaaacgcagauuccggggcccaccccugcauucugcuucaguguauuuuggguaucuguauuuaaauaaacacuauuuaaacaaacaugauuuggguaaaggucucaagacacaauuuguaagcagucccgcuaucggauuccuuucggcagguguuuuucucgccgaguguggguuuuuacuuccuuuucuauuugggcaaagacucuuuuugaaucagugacccacgcagaaguuacucaaucuguuugaaagaguauaaaguucacgauuucccuacacacuaacauuaucaaagaguguauauuuauauuagaacaaacucagaagguuaaaaagcuagugauuaaaaguaagggcagagaggaagaagguaaagaccaguaccuggaugccuuauucucuaggaauaacaacuuuuccuuaauuagcacuuccuaaucuucagaguucuuaugucugcagcuagcucacuucgaagaaaaaugcagggaccaugaaguaguuguuacuauuccuacuggaguacgcgcuucaugggcagggaccacacucacaaucuuuuccucccagaacccaguacagggacuggcacacaguaaaugcuaaaugcagaaggaaugguaucucuaguuucucaaaggugcaaaccaagccaucccuuucuccagaaucuauggauuaaucauuuccaaaucuacagaccacauuuugaaaaggaaugcuugcuguuccaaagaacucgcacuuguuucuucacgcccucgccccuucucuccaguggcucucccucucccuucccacugccugggcgcguucgccuggaguuagccuggaccugacgaaaaucuguaaauuaaggcgaaggacccagcugcaaaaaaggcgcucugcagcccucucccagccucgggugacaggggucuuccagggcgucggagcccaagagaccccggccaccuuccucucccgggaaccccaaaucgauccugccacugccacagccaccgcccccgccccuucaacuccgccaaguuuaccccgggcucggcgcccaucacuaguucuggagcugaccgcgcggaagcccgcccgccggggucgcagggcccaggcccccgcacagcucugcagcccccgcaagcacagcccgacccgcggcgcgcuugccgcucacccucguccgggcccucggcacccgccacggccagcagcugcaccagccccaagagcagcaggagcaggaaggcuuuccggggccucaugguagcgggggcggagcgcggccuccuagcgucggcggccgcugagcgcaccgagaacucggggucuggccgacagcccgucgcuccuuagcgacgcgggggagccggaaaaacccacggaagucguccccggcgauuggcagggggcggaggaagucgcgggccggccaaucccagacugacgccggcacggaccgcgcgcgccucggccgcgacgagucggcuccgccgcccuaggcccucccuacuccugcgcgcggcccucggcugcgcguuuaaaac

SEQ ID NO: 191607 - RNA, 25629 nt, Homo sapiens
guuuuaaacgcgcagccgagggccgcgcgcaggaguagggagggccuagggcggcggagccgacucgucgcggccgaggcgcgcgcgguccgugccggcgucagucugggauuggccggcccgcgacuuccuccgcccccugccaaucgccggggacgacuuccguggguuuuuccggcucccccgcgucgcuaaggagcgacgggcugucggccagaccccgaguucucggugcgcucagcggccgccgacgcuaggaggccgcgcuccgcccccgcuaccaugaggccccggaaagccuuccugcuccugcugcucuuggggcuggugcagcugcuggccguggcgggugccgagggcccggacgagggugagcggcaagcgcgccgcgggucgggcugugcuugcgggggcugcagagcugugcgggggccugggcccugcgaccccggcgggcgggcuuccgcgcggucagcuccagaacuagugaugggcgccgagcccgggguaaacuuggcggaguugaaggggcgggggcgguggcuguggcaguggcaggaucgauuugggguucccgggagaggaagguggccggggucucuugggcuccgacgcccuggaagaccccugucacccgaggcugggagagggcugcagagcgccuuuuuugcagcuggguccuucgccuuaauuuacagauuuucgucagguccaggcuaacuccaggcgaacgcgcccaggcagugggaagggagagggagagccacuggagagaaggggcgagggcgugaagaaacaagugcgaguucuuuggaacagcaagcauuccuuuucaaaauguggucuguagauuuggaaaugauuaauccauagauucuggagaaagggauggcuugguuugcaccuuugagaaacuagagauaccauuccuucugcauuuagcauuuacugugugccagucccuguacuggguucugggaggaaaagauugugaguguggucccugcccaugaagcgcguacuccaguaggaauaguaacaacuacuucauggucccugcauuuuucuucgaagugagcuagcugcagacauaagaacucugaagauuaggaagugcuaauuaaggaaaaguuguuauuccuagagaauaaggcauccagguacuggucuuuaccuucuuccucucugcccuuacuuuuaaucacuagcuuuuuaaccuucugaguuuguucuaauauaaauauacacucuuugauaauguuaguguguagggaaaucgugaacuuuauacucuuucaaacagauugaguaacuucugcgugggucacugauucaaaaagagucuuugcccaaauagaaaaggaaguaaaaacccacacucggcgagaaaaacaccugccgaaaggaauccgauagcgggacugcuuacaaauugugucuugagaccuuuacccaaaucauguuuguuuaaauaguguuuauuuaaauacagauacccaaaauacacugaagcagaaugcaggggugggccccggaaucugcguuuuaagucaguuuucccuugagacauagaauuaacuucgggaggcacagugaaaguugaggaccaguguggguggaagaugcuuuuuggaacauagcggaaaagcauauagcacugucuugguuuugauccagugauucuguuuuuggggggauucuugagaggccugggagaguggcuuuaggagcuguuaggaccagcaaguuuauccuuccggucagaggucuuuaacacagaagagucccugggaagcaguugcuccuagggugagccuaggaaucccaggggucaucauggccaagggcaggccuccugggacuucuagcuccguuuuuuuuuuuuuuuuuccuagauaagguuacgcauuguugcccaggcuugagugcacuguccugaucauggcuuacuuaagccucaaacuccugggcucaugggauccuccugccucagccucccgaggagcugggacuguaggugcuugccaacacgccuggcuguuuuuuuuuucuggcucugucgcccaggcuggagugcagugacgcgaucucagcucaccacaaccucugcuucccgaguucaagugauucuccuuucuccaccucccuaguagcugggaccacaggcacgugccaccacacccagcuaauuuuuuguauuuuucaguagagacgggguuucaccguguuaaccgggauggucucgaucuccugaccccgugauccgccugacuuggccucccaaagugcugagauuacaggagugagccaccgugcccagccuggcuauuuuuuuucuuuuuuugguagagauggggucucacuauguugcccaggcuggccucaagcaauccuccauccuuaaacucccaguguuugggauuacuggcgugagccacggugugggcuuaccuugacccuuucucaucccugagggcaucccucggccauucacugucaaaaccugucauagauucacugauaacuuguccaacagauuuauuucaagucugcacuaccucaccccucaaguguuucaagucucgaggcuuuuuuuuuucuuuuugcuucuguuacauuuuagauuuagacagcacaguggugucuagguacuuaaaugcccuccuucccccaacaugguuacuaaauacacccuaagcucugaugguuuaagccuccgguugcagggcuuuccgugucucagaaggugccugcacucuacacauccuucaugcuaaaacaggaaaggaaaauauucugauccuguuuguugccugcuuuuaugugguauugguuuguuuagauuuaaaaguaaguagaaauucaccuauuuuucgugcuaaggaacuguuaaacucuccuccucuuuucauuccugagacauaauuauuuucggagccauaaaaauguggaaacucuaaaugauuccaccaaaaacuuugggcguauugggaagaaaaucuaaugugacaauacagcauagcaguuaaguggucaggacccuccgcuaaguagcuuugugaucuuuggacaggugacucaaguuccugcaucucaguuucuucaucuguaagauacaauauaacguguaauacagucucccuuaaggggugaagugguguguuuaagagcccagcacagugccugguacauacaauaaauaccagcuaucaugguuaccguagcugauaacaguucuuguuucuguguuuaauacaaacucuucaguauuggcugaaugguagaguuuaugcagcuguuucaggcacuucucugggggagaugagagugaucagcugaggacggagagugaggacauccuaaaaggagcugccugugucugagcaggacccaguguugucaucaggugugccccgugggaguggacagggauugaggcaaccugcucaggugagggucccccacuucaggagaggccuuagcaugugggcugagcaauguggagaugaacuugggaauucauuugucucaugcugaggaagguugcaucuuuucagagggugcugaaaggcucuggacauacauauauauauauauauauauauuuuuuuuuuuuuuuugagauggaguuucacucuuguuguccaggcuggagugcaauggcgucaucucucgaguagcugggauuacaggcaugugucaccacgcccagcuaauuuuguauuuuuaguagagaugggguuucuccauguuggucaggcuggucucgaacucccgaccucaggagauccgcuugccucggccucccagaguguugggguuacaggcgugagccaucacaccuggccuuuuuuuuuuuuuuuuuuuuuuuuuuuuaaaugacagucuugcucggucgccaggcuggagugcaguggugcgaucucagcucacugcaaccuccaccuccuggguucaagcaauuccccugccucagccucccgaguggcugggauuacaggugugugccaccaugccuggcuaacuuuuuucuguauuuuaguagagacaggguuucacgauguuggccaggagggucuuaaucuccugaccucgugaucugcccgucucagccucccagaggagcacguggauuacaggcaugagccaccaugcccggcccuggauguauuuucuauccuagaauguccaccuuuaaaaaugaagcccagugaaaaguguucccccacuaaaauguggacuguuuugcuugcagggauguguggguuucugguagauagaaggcuagagcuagcaccuucccaaauugcagaggaaucaauccuggcuugucugugagcuggggaggaaauggaaagguaggggccuugagaguccuuaauuacauagggaauguccuaucauuuuguuuauucuuuaaaaagauaaugggauucuuuuuuguuguuguuagucucgcuuugucacgcaggcuggggugcaauggugugaucucggcucacugcauccucugcuuccuggguucaagcaauucuccugccucagccucccaaguagcuaagauuacaggcaugcaccaacaugcccagcuaauuuuuguacuuuuaguaaagacgggguuuugccauguuggccaggcuggucucaaacuccugaccucagaugauccacccucuuuggccucccaaagugcugggauuauaggcgugauccaccaugucucgccaaaauucauuuuuuuaaaagggucaagaaagaaguugccucuuaggaaugcugugucccauggugacuagucagcucccacuuaaucaugagagcucugucacauuguaauguugagagcccacuugaggccgaccauagguaagaagacgucuuuguuuuuuguaaaauucacccuguaaaggaguugucuauguggucauguuuuaggccucuucgcugcaaacgucagucuuaugcugugcaccgagccaauuaguuucccuuccucuccuagcugugauuccuaccuggaagaguugauuaaguuccccagugcauuauuuccgaccuuccuccaaucuucccauccaucugcuugcaaguaacuuugacuccuacugggcagagcagcuagguagugagaguggauauggauggucccaaagcacuacuuaacugccagccggggccccugguggucucccucagggaccacccaggauuuaaaaaaaaaugucaaaaaucucgauuacuuuugcaccaacccuaauacuugggcuuagucuuaaugacaucagcacaagauguguauuucagccucacacgauucauucaaagacacagguaaauacagugggcaagauuuucuaaauagcacagagcagaggaucuuuucuuuuuucucccucuugggggucuagaaugaucugaaaagggagaccagaaaaccuugggaacacuggguuucccucugcuccacagggagaugucagccuggccccugccuguacugucagacacacgcagucccgagaccccaggggaggugggccugcgcccaggcugucuuucucuguguucugcccuccaugaacuucugacagugccuagggaguuccugguguggagggagggguggcaggcaggaggcucaucucagauggguggguuugcuuuuggcauuuuagagcucuuucucccuccuccgacaaaagaggauccuaagccuuaaguugaaacaggaaugugcaagucaggaaaagcugugggauguuuaaaaggaagaggacugagugcgggugacuagugugugccagugggcuuucuuguuggcuuuuuuguaaaguuugcagauugguacauguugacagugaugaacaaagcugcccccuucucccugcccggcacagacccaaggaguaggcuggaggagcagagggcaggcacagccauguggggugggugcaggcugccuccguggcuaggcagccacagaguccacgcgggguuccuucaucaggguuggugagccccaggaguucugggaucccaggggcagguuuucagacccugaccucauccacagcccaaaacaguaacuagcagcguucauuuaccuccuggaaaacacaucuccagaaaagaauaauuggccccggaaacauucuggcuucagcguuaaugaaauugccgugcuugcugugcccaguucaguuuacuggugugacaguagccagagaaccugguuaauaaaaauggcaauuccauguucuuuguaucugugguuuggcaaaaaaaauaaaauaaaauaaguugaaccuugaaaauaaaauauacacaauuucucacauucuaggaagaaaacuuagcuuccaagcaaaggugugauuuuugauacauguugaccccaucaauuucuauauuuguuauccuggaaauuacucaggggugccuuuauaaguaaaaugagauuucccgcccucuuccccuucacacuugagccuuuuccucaaggauuauaaaaccugaagggcuauuuuuuauggguaugagguaaaaugccacccccuuucagaaauggaauuaguauuccauccucugcagugaaaagauugaguacuuguuuccuguugguacucuuuuggggccaggcagauaauuuguugaugggagguguuacugaaggcccugccuguggaaagcauacagggugaggaggaggcggcacaucagugagcaauaacguugaacacagacaagcuagggcgagaucacgaaaugcggugcccugaaaugcagagugugggauguggguaggggagcccgagcuacaggagcgaggcccgggaagaccgcagagggugguacaaggaaguagggaggagguggccaaugcggaggcugucugggcucagggcaggguuugcagagcaaggcagggggccgcgacucuggaaggguaggguagucugugcugcccuccaacuuccccugggacauuuggacuuuauauucuagagcugugguuuucaaauauuauuuagccaugaccucccucugaaugaaauuuuaaguagcaaacuuagaacagcuggcaugagggaggccugaugucaccagccaaugacguggugggcccccagggaccacccgggacuugacacauucugaaguguaugaauuuuaggaaaguuuuuuuuuuuuuuuuuuuuuuugagaugaagugucacucugucacccaggcuggaaugcaauggcgcgaucucggcucacuguaaccuccgccucccagguucaagcgauucuucugccucagccucccgaguagcugggacuacaggcgcgugccaccaugcccggcuaauuuuuguauuuuuaguagagauuggguuucaccauauuggccaggcuggucuugaacuccugaccucgugauccgcccaccucagccucccaaagugcugggauuacaagugugagccaccgcgcccggccaggaaaguuuuaaggagagucaccaccagcuuuguaaccagucuggguguuuuccacucagauucuucuaacagagaaaaugccauugaggaugaagaggaggaggaggaggaagaugaugaugaggaagaagacgacuuggaaguuaaggaagaaaauggagucuugguccuaaaugaugcaaacuuugauaauuuuguggcugacaaagacacagugcugcuggaguuuuaugcuccaugguaaggaccgcguucuaauuucugcagguggacaagcgcugugcuccauucgcucagcccuucacccggucauccagaccuuggggggugggguaggagugucugggugcaggaacuugcacucuagcuuuaagaacgcugggagcucacucguucuaccacugugcguugaacggccagugagccagcccucauggaaggcgaugucuucuugucucaguccaguggguuaaagaugaauacguccucugauggucacagcugggggacgggcauuuaacaagcggcaaugacacagagcccuguguugguaacagacacguccuuguuauagauucugcuccgaccugucucaggccacccugccuuccucuucccucaaaggcuguugcucaggcagcugccccaagugcaggcuguuggccugugugguggauuuuuuacuacacacauaggcccugcggggggaccagucaggcauccccacuucuuuuccugucuuuacuccuccuagugcagaccguuagagcucuugugucccucucaucccuucuccucuacuguuuugaaucucaugaccccugcuuugcucuucugucucaugcccuuucuguuucacuucugagaccaaauaggauauacucacuuuuguccagugccugagggucaagcguagcacaaguguuuuauuuaaaacauggaaauaggccgggcaugguggcucacaccuauaaucccagcacuuugggaggccaaggcgggcagaucacuugagaccaggaguuugagaccagccuggccaacauggugaacccccaucucuacuaaaaauacaaaaauuaggcauggugguuggcacgcaccuguagucccggcuauucgggaggcugaggcaggagaauugcuucaaccuaggagggggaggcugcaacuagcugaaauugugccacugcacuccagccugggcgacagagcaagacucuaugagguuauauuauuccucuuucauaaauuaucagauuucauacuuuuuaguucaaagagaccuuaacauucuuaagaagugaggaccucagagggcuuuuuauaugggucauguuuaucaauauuuaccauauuugaaguuaaaacugagaaauuaaaaaaaaauuuuuuugagacagauuuucacucuuuugcccagguuggaaugcaauggcaugaucucugaucacugcaaccuccaccuucuggguucaagcaauucuugugccucagccuccugaguagcugggauuacaggcgccugccaccaagcccagcuaauuuuugcauuuucaguacagacagcguuucacuauguuggccaggcuggucuugaacuccugaucucaagugauccgcccaccuuggccucccaaaguauuuuuuguaaagauggaguuucgccauacugcccaggcuggucucaaacuccugaccucaggugauacaccugccucagccugccaaagugcugggauuacaggugugagccacugcacccggccaugucaagcucuuuuaaacuacauucgugaaagugcauuugccuauucaugagggauccacccuuaagaccuaaacccuucccacuaggucccaucucccaacacugccacacuggggaucagauuucaacauuuugguguggacaaaccacauccaaaccaaagugguauguauuauuguuggauuuaaaucccauagguacaguuaacguuuuuugcccuuccuaaucuaauuguuagguguggacauugcaagcaguuugcuccggaauaugaaaaaauugccaacauauuaaaggauaaagauccucccauuccuguugccaagaucgaugcaaccucagcgucugugcuggccagcagguuugaugugaguggcuaccccaccaucaagauccuuaagaaggggcaggcuguagacuacgagggcuccagaacccaggaaggugagcugguaccugagcucguagaggaagaacuccuucccgcagggaaugggaauuuggcuaauagaggaagaaaagcugaggguaccagggacugacuuucucaggaaccuuagcccucuggaauguuuauuugcucuugggguggggguggggggguaggaggggggaguaguggggugggcaggguggguuggggcguggcaucuuuacauuucagacucugaaacucaaaacaugggcaggaguguuaggaaaugggccagacaugguggcucacaccuguaaccccagcacuuugggaggccaaggcagcuggaucacuuuaggucaggaguucaagaccagccugaccaacauggugaaaccccaucucuacuaaaaauacaacaauuagcuggguguaguggcucaugaguguaaucccagcuacuugggaggcugaggcaggauaaucgcuugaaccuacgaagcggagguugcggugagcugagauugugccacuucacuccagccugggugacagaaugagacucuguuucaaaaaauaaauaaacaggaguguaaggaaaugacaucagaggucacgggucuuggugguggucuagagcacugguucuuaauguuuagcaagcgucagucaucuggagggcuuguucagcuugcugggccccagcgccagaguuucugauucagcacauuucaggccagauacaguacaagucaggccagauaauuugcauuucuuuuuuauuuuuuuuuugagacuuagucucacucuguugcccaggcuggagugcaguggcaugaucucagcucacugcaaccuccgccuccuggguucaagcgauucuucugccucaggcuccugaguagcugggacuacaggcgccugccaccacguccggcuaauuuuuuguauuuuuaguagagacgggguuucaccauguuagccaggauggucucgaucuccugaccucgugauccgcccgcuuuggccuccuaaagugcugggauuacaggcgugaaccaccacgcccgcccaauaauuugcauuucuuacaagcaugcagggcugcugcaugcucaaaauugcugcuggcucaaagccaugugcugagaaccacaggugcagagagccacauccagggauucucugaggaugucugcaaucuggccugauggaucccugccuggcucacauuagacacuacaugcauuuuauuaaaugaaugaacaaauaaauuauuugauuuuuauuuaauuuuauuucgauaaaauguauuuaauuuuauuuugauaaaauguauuuuauuuugauaaaauguauuuuauuuugauaaaauguauuuaauuuuauuuugauaaaauauuuaauuuuauuuugauaaaauguauuuaauuuuugagacggaguuuugcuucuguggcccaggcugcaguacgauggcgcaaucucagcucaccgcaaccuccaccucccggauucaagugauucuccugccucagccuccagaguagcugugauuacagggacacaccaccacgcccggcuaauuuuuguauuuucaguagagacgggguuucuccauguuggucaggcuggucucaaacucccaaccucaggugauccgcccaccucggccucccaaagugcuggaauuauaggcgugagccacugugcccggccucuuauuuuaauaaaauuauuuaauuuuauugaaugaacaugguauccuuuagcaagggcaaaucucucugaaucacuggcagaaaaaaaaaaaaagaugcggcugcauuuuccauucccaguguggaguagaggaaagagcguugaauaggcuuccgguccucauagacauaagauaggccuguguucuggacgagcgccuugcccuugccaggccuuggcaucucaucuguggagcauggugucaguuggauguaaucugagaucacaucucugagguggugugagaggcucuccucugcuccuuuaagcaauggcacucacuguggcguauacaaagagaauggauuugcuuccguugauauuuagugucacaguuuguugacuagguaauacauuuauaaacuugguaauucagagagguagauuaaugaauagucuuucuucccugaaccugggugauccagcuccccucuaagaagguacuaguaggcugggcacggugguucacgccuguaaucccagcacuuugggaggccaaggucgguggaucacgaggucaggagaucgagaccauccuggcuaacaugguuaaaccccaucucuacuaaaaauauaaaaaauuagcuggaugugguggcagguggcugguguguggaggaggcugaggcaggagaauggcgugaacccgggaggcagagguugcagugagccgagaucgcgccacugcacuccagccugggcgacagcgagacucugucucaaaaaaaaaaaagguacuaguguaacagguuucuucuguguuuggagauauuuuguaugcauaaaagcagguguguguguguaucugucugagagagauuuucucauuuuuacaguuauuaguauaugucaaauacuauccuguaccuucauguuuuuauuuaacagauaugucuuagccauauccauacauaaagaacuuaaucuaaaacaaauugaaaguugaguacuucuuuauuuuagauggagucuuccucugucucccaggcuggagugugcaguggugcaaucuuggcucaccgaacagccuccaccuccgggguucaaguggguucuccugccucagccucccgaguagcugggguuacaagcaugugccaccacgcccggcuaauuuuuguauuuuuaguagagacaggguuucaccauguuggccaggcuggucuugaacuccugaccacccaugauccacccaccucggccucccaaaguucugggauuacaggcaagccaccaccccuggccuaaaaguugaguacuucuauuguugugaaguaaacaggcauaugcguuuggaggucuguggccaacauuugacugcaagagacuuggcuguuuugcaaacuuuagagcaguguaugcuauguuuugauaaagaggccuccuauguguuaagugccucaggaccccuggguguggucuggggggcagggcacagacacuucaugcugcgaaugcgcagaggaggugcuugugcacguuucaguuugaagacugcagcuuugcaggaguggcuguagauuuggcuccuugguagauucugcaguggggaaaaagagugacaguuugcaaccacucguccuaagaacugcuuggcacauuuuuuguacgaauuuauuguuccacuccagcccuggaguccauuucuggagaaugaggccacagaugggcauuuuuuaaaagccuucucagguaaugccacugcaccuugagcaaugggagcuacugcuccucuuuuaaauuuuuccuuuuuuuuuuuuuuuuuuugcauacaucuuaugacguauguaauauaguaacauuagaugugaaugacuaaauauguauauauuuuguauguguucaggagaugccccacaaugcuauccauaggcauauguaaucaaaaccauugggaguuggugaggguuugcguggaguuaguaccauagccugaugguaaaggaagucucaaccaucaguaagucuuaggcccucuggagaagucugcaggcuguggaaaugcgauggacaauuguugggaaauagcgaaccuucugacucuuggcuguguccccaaaacugcagagaugcagccagguuucaggaaaucagacaccuccuguucuugugggccccgacacuugcuuucuucccccuccucaucugcuucuggagggaggugaagugccugccaguuugggccuugugugcucagucuugcuugguuucuuucagaaauuguugccaaggucagagaagucucccagcccgacuggacgccuccaccagaagucacgcuuguguugaccaaagagaacuuugaugaaguugugaaugaugcagauaucauucugguggaguuuuaugccccaugguaagguggugucaggcccuuuccauauucaguacccuggugggcacuaggugcgggguggcaggccccugcccgugaggcaggaacagcagaggagcaaggugggcacgaguuguaggccaggauugaggcuccaggucuucuggaagaagcguggauguaagagagcuguugggggagugaauguggaaggaacugccaaguaguccauucuugggugggagaagggacccaaaggaaagaagauggcagaaagagagguggucggagugggagcaaguacaguggcuggucugagcugcccagcuuggggaacugagguggcugcuucauggggaggggaggggagggacgcacaaccaguugcguggauaagcuggcagcagucagaguagagagcagagcggaagaagacggcucucaagggagaggggagccuggcuucaggagagaccaucugccuucccaggagacggcccaggguaccaucugucuuggugauuuuguggugggucagcugugguucugguucuugagcaguccugguaugucugaccaucaggccaccaagaaccgccucagauggguguguucuguagggagucugggagagucaguaagcagaggaagcuuuugggccuagaaccagcagguggaggccauggcugaugcacaggccgggggguggguggcaccuucugcacuguggggucagguuugggaccaggacacccuuguuccaggcaaugccuggauaagcccaaaccugaggccacagauucugcagcagaaaccugggaguugcuggaugugcagaugaaaagugaagucaggugggugguuagagaaggaaaugaucugggagagaaggaaggaagcgucugggacacguggggcacccuucuaacccccuugcgaugcuggagagacacagacccuuguuucgcuaugcauggggcccuggccugaugggugggaggugugagagggagaguggcagcugcacaucuaacugguggguugcuuuguggcucgcucaggagccagguugagccgacugcugcacagugcacgcucagcgaguguagugcgauuucccugaagugguugaugaugccucagaagauaauuauccauuuauucacaaacaguuuuuuggucuuuugauguguuuuuguguguguggugggagguuguuuguuuuuuuuguuuuguuuucuuagguuucuuuugagauaaggccuugcuuugucaccugggcuggaguacaguggcaccaucauaguucacuacgccuugaacuccugggcucaauugugcugccucagccucccuaguagcugggaccacaggugugugccaccacgcccagcuaauauaaaaaauauuuuuagagaugaggucuugcuauguugccccgguuggucuugaacuccuggccucaagcgacccucccgccucagcuucuggaagcacugauauuacaggaaugaacuacugugccagccaacaaaugguuuugaaguugcaagaugcacccuuuaauucauuuggguguccuaaggacuuugacaggaugguguuuuaucuuaacucaggacugagagccuccugugugccaggccccagcugggugugggauguugguucuuuuuugagacggaguccugcucuguugcccaggcuggagugcaguggugcgaucuuggcucacugcaaccuccgcccccuggguucaagcgauacuccugucucagccucccgaguagcugggauuacaggcgcccaccaccaugcccagcuaguuucuguauuuuuaguagagacgggguauugccauguuggccaggcuggucucaaacuccuggccucaggugauccaccugccucggccucccaaagugcugcgauuacaggagugagccacugcgcccggccaguucuugugggcaaugggcugugugacgcaauacugacuccaagggacucucccucaucuccucccuggguggucugugucagugaggguuugugacgcucuucuguucuccaugccucuguucuuguuaccuggaccugccgacccucucuucgccccaccucccgugggcuccuggcuaauuccucgcugucccuuggauccuagcuccacugcuacuccuccucugaagccaucuaugacuuacauccuugcuggcccccaacucuccaaccaagaaaguccucuugcucaggacagugucucucuuggccucuccauguuuuccccugugccgcaguuacuaauguccugucuguguccuguacauguguguacgcaugcuccacccccagugugugaaugcugugggaugaaguuugugucuguccagcgguagcgcccucaacagcaccugagggccugagggucuaggaggcauucggaggcuuacuggguguggccagguuacuagggagcacaggauggguuucugcagcucauuuagcuagaaagugaguccacacuagaaugagccccugacaaaccaguuuccucuuggcagguguggacacugcaagaaacuugcccccgaguaugagaaggccgccaaggagcucagcaagcguucuccuccaauuccccuggcaaaggucgacgccaccgcagaaacagaccuggccaagagguuugaugucucuggcuaucccacccugaaaauuuuccgcaaaggaaggccuuaugacuacaacggcccacgagaaaaauaugguauggccacucccuucucucccacuacaguggggaagggaaacucccuaacaggaagcugccauugaaggugcugggggcuggcaggcaugggccaugggaagugggcaguucuuagugccccugcucaggcgugugcccugcucccaggaaucguugauuacaugaucgagcaguccgggccucccuccaaggagauucugacccugaagcagguccaggaguuccugaaggauggagacgaugucaucaucaucggggucuuuaagggggagagugacccagccuaccagcaauaccaggaugccggugaguuguggcccucugggcugaacaaaaugugcgugccuugggccgucugcgguugccugguuuuucagaaagcuccugggacauccauuagggggugguuugaugagccaucucugggaauaagcuuuccauucugggguuggaguuggggcuggggcuggagauggguccccuguggcccuccuggccucggugcaggggaggggcacagucagaccggucccagcuccaugucugccuuccagagcccgaggagggcaggucuucaggccauaaggugccggccucugaaucaaaccagcuuucaaggccuggcucuuccaguuauuaucacugugaccacagguggugacucaguuagccuaguggucucuugcccaaggugguggucuuuucugagagguuauuacacugagauaauguagaugaagagcuuagcaauguacuugauaaugcuaaguguauuauaaaugcuagucuugcuagccugaggagugaaaugacugugaacagcugucagcaauaguguucuguugggguaggggcaggcagcaguugccccauccugaaauccaucgucugccuuggucuggcuccugaugccuggggacagguguacucaggguccuggccauccucauugaugucuucugagugcuacccucucccacuacaccaaaaccagcuuggcuaagugcuaacugauuauaauuuuucaaaugcacagcuugcuacuuagugcuaauucugugcuuuacaauaacaauugugcauaagucaaaugcagauuaauguauaaaaccaguagagcuaaauucccuucaucuguuaauuagguggccuuguuauucacgccuaacuagucaggaagaaacuugcagaaggaaaccccaacccacccaggguuaugggcagcaggggauuccguagccccaagucugacugcaaguuacgugcauugaugugcaugcaaauccccagggaauuuguuaaaaugcagguuccagugcugugggucccaggcaggccuggcaccacauuccuaggagucagucugugauuuggcuugggcaggguuagggcugcagauggggcaagagucacugggccugcuuaugagagagggguuagccccagggacacaagauguucuacagauagguuggcagggccggagcagagagggcggcugggggaugaaagggucugugguccuggggugggcaggaggugaaguucuugaugcgggucugucucugccugaagccaacugacuacaaauccccaggacaccuggaggcuuaaaacaggcgccaucuagauagcuguagccuuauuuauuuauuuugagaccggaucucacucugauugcccaggcuggacugcaguggugugaucucgacucacugcagccuugaccuccccaggcucaggugauuuuuccaccucagccucccaaguagcugggacuacaggugagcgccaccacauccagcuaauuuuuuuuguggagacaagauuuugccauguugcccagcuggucuugaacuccugggcucaagugauccuccugccucggccucccacagugcugggauuacagacaugaaccacagcacccagcccguguggccuuauuuaguggauuuuaaugccucuguuuuacagagaagggccuguggcucggaagguuaauaacuaacaagucuaaagcuacgcaguuaguaggucacaaaccuaucauaugaaucuaaguccaucugacucugaaagccacaggcuuauccaggcugcccccccauccccugcccucccaaaaacaugguuuaccaucucagccacauguguccuauaacccagcugagagucacaaaccucuagaccaagagcccuucaaggguagggugacacccaauguuuaaaucucaaaaucagcccaggaugaguuuggaugccuugaggaggagaauggagagggacugaaggugcauuuaccuguagaaucuaggguagggguugacacuguggcccacacacccauucuggccauagccugucuuugcaugugacaucucauuggaacacagcuuuguccacacccuguccagcugcuuucacacugcagcagcagaguuaagcagcugggacagaccacaugguccuuagagccuuaacuacucacucucuaguccuucucagaaaguuugcccagcccugugguagggugcccucagaccgugggguuucaucaugcauuuucacggauuuaaguaaaaguaucuuuagccaaagaacuucauucggagcuccagcccacaaacaggcagcccaccaacuugaggaagggagauuuaaaccuccacgaagggugcugggugugaaaacuccacauagggauauaggacugugugcugcucaugugggcuccagaacauucccccugccaaagaaucagugcugcuuauagacaucaguugacagcagcuucuggcaaauuagcuguuuuucugugaacuuuuccgggguuuuuuuguuguuguuguuauuuauuuuaucuuuauagaaauggggucucaccauguugcccaggcuggucuuaaacucuugggguuggcugagcacaguggcucaugccuguaaucccagcacuuggggaggccaagacaggcgggucacuugaugucaggaguucgagaccagccuggccaacauggugaaacccugucucuacuaaaauuacauaacauagccaggcaugauggcauaugccuauagucccagcuacuugggaggcugaggcaggaaggagaauuggcuugaacuuggaaaacagagacugcagugagccgaaaucacgccacuucacuccagccugggggacagagcaagaccccgucucaaauaaauaauaaaugaacuaacuccugggcuuaagcaguccuccugccucagccucacaaagugcugagauuacaggcgugagccacuguggccggccaggauuuagacguuauaccuuguaccaaguuuuuaaaaacgaaccuccuuucaaguguuuaaguuauaggaauuguccacacaauuuuugguggugacuuuuuuucuuuucuuuuucuuuuuuuuuuuucuuuuuaaagacagucucacucugucgcccaggcugaaaguacacaguggcgugaucucggcucacuacaacguccaccucaccuccccaguucaagcaauucuugcgccucagccucccaaguaguugggacuacaggcuugcaucaccacacccggcuaauguuuguguuuuuaguagagacagggauucaccauguuggccaggcuggucucaaacuccuaaccucaagugauccaccugccugggcuucccaaagugugcugggauuacaggcgugagccaccgcgcccagccuacaguggucauuuucagaacauuugcuuuggcugauguggguaacgaauuaaaucucagacauuuaggcaauuuucaaaauuacaucuuauucuguuaacguuucagcuaacaaccugagagaagauuacaaauuucaccacacuuucagcacagaaauagcaaaguucuugaaagucucccaggggcaguugguuguaaugcagccugagaaauuccaguccaaguaugagccccggagccacaugauggacguccagguaagcgggccccucugccaugccagcccuggacaccccgcaggcaugaggacucugcuuugagccaccucugagguuucaaacguggagguuucgcucuugucugcagggucuggaacuccuuuuccagcccguucuccccaccccacagguuuucugcaggcggccuguggucucucuuugccggagggacagggcuggggcucccgcacaccuggcagguccuggggcugggcagagcuccacuugguuuugccagaacaguugcugccacccuuugucccuccuggcaggcaaucaccagucucccuccagugccuguuccacuguggguuuggccugggccagcacauggugcuccguugaggccaagucguguuuguucgggcagcuccagcugggggcuacagagggacagcaucccugucuguucaccagagggagcuguugaccuugguggguggauuuugccuuucuuuccauuacugcaccccugcacuucauccuccuagagugugacacacucagcccuagaggggcagugggaguucccagcccaaggggaaccuggggccaguucagccuucugagugcuuuagaaggggcccugcacuucggugaguagaucucagauuuggaaggaucuuagaugucgaguuugaagcuuugguuuaacagagauugggcugcagagaagugagcucuaccccccaccccagaccccacagcuccuggugggaagcagagcugagauuggggugaaggggccuuuccagguccuacuggcccauagugucaggacccuggcuguuugggcugugggcucucaugggaccuggagcagggggugugacaggacaggaaucccgggggccugcaccagaacauggcaguaccuuggagagaaccacccugaaucuuucugguccccauguccucuguuuccuuccucaguuuuuaguccugucccucuuucucaaggucuguguguccaucccaucuguuucucugccaacuugaagcucagggcaacucuccucuucccuggacucauaguggcugcugcgaccccuccccccagcuucacuuccuuccauccagagauaagauccugggcccaaagagggguccugaugagcuuggggggccauugaucccgagaaucggacacagcucugugugugagugcauauuccaggaaaggggucuguagcuuucaguagacgcuucaagaucuaugcagucuugucuguugggcacauugcugcugcucccaguucuucuggcguuucccugcugagugaagugcacgcagcgccaugucaugguuaaagacuccacggccuccugccaccugggagauaguuggauuaucugugccuuagcauggccucccaggcccuccuuacccaccuuuucagcacaucccacccuccagugcugucacgccagauccuguuugugccucgugcccugccucagucucugcugccucccugagugccuucugcucccuucucaccagcggggcccucuuguccuucagugccacacaaggaccccucccugaguaucccauccccacggaaacccuugggcucacaggcccacccaccacuugcuggcugcgcagccuugggcagguggcugaccuugcucugcccaccccuggagggcgaugucugugagggacuccagucguugugaagugugagcccucaggaccuccugcgugaagaccgcacaagcugaagguggaaaguuccacacagcccagcccgugauaacccuuccugucugccaagagccaggccuaccuugaguggucucuuugugggguuagugagccuacacccccaaggaaagggccaagguguuugccuuuucccaagaagccaccuacgguucacuggagggaaaggagccccaaaagacgguagggaaugacugggcugugcuugaguggggucgagcccugggguguuuugccuccuaagacugauccccuucaaagucgccacucccccaaagucccucaaacauuguacucaagaacaaugguggggagauggugggcccccucaccuguucccucuuugaagcagggcuccacccaggacucggccaucaaggacuucgugcugaaguacgcccugccccugguuggccaccgcaaggugucaaacgaugcuaagcgcuacaccaggcgcccccugguggucgucuacuacaguguggacuucagcuuugauuacagagcuggugagggacccccaccaagaccugcgggggugggggguggggggacucguucuuucaggcaagguggaguguugaggggagguguggcuguauguacauggcucacucagaaaucccagccuggggcccuugcacguugguggcucagguauauuuuuuaauugauggcuucccuuuuuagcaggaugggagcuuagauucaggugcagaacccucuuagaguugacguagcugagacuuggaggaguucagaggcugcagagcugggacuagaccagcccuggccccaggcaggcguggccgugccaccugggcacaggucuuaagggccuguugggcuugcagcuguggcccccgugacaaguggggcuuuuccagaaacauguuucccuccaauugagguaaauccaggguuugagcauugucagaauauuagcgacaggaccugaagccugaccucagagucugagcugggacuugcucuguguggccgccuggcuuauggcccuuggucccuuucagcaacucaguuuuggcggagcaaaguccuagagguggccaaggacuucccugaguacaccuuugccauugcggacgaagaggacuaugcuggggaggugaaggaccuggggcucagcgagaguggggaggaugucaaugccgccauccuggacgagagugggaagaaguucgccauggagccagaggaguuugacucugacacccuccgcgaguuugucacugcuuucaaaaaaggugagcccguggcuggggcuggggucucccaucagcugcugugcuccucgugcggaauccagacaggccaggggcgucuggugcucuggccacgggcacgacacccccuuaagucagccagcaguccucucucacccccgagggacucugacuucucguccagagaaaugucgggugugaccccaaacuccaaggcaccagaauagcuuagaagaaggauuugcaaguguuacuauuuucuucuuggcaguucucccaguguuuacuuugaaagcaaaagcaagauucggaguccaucucagggcuuaccuagcaucacucagcggccuuagcacauuuccagcgcugaugugcuaaaauuccagacuagggccggggugugcagagggggcaucugaagauggagcccagacagggcaaagucugggugugcugaacaccccuuguggcuucagagccugacucagagccucuucacccucggccaccuugcuguacagcuuuaaacagagccuguugaucuuggcugagcacauggccccaggcccccagcgcuggccacauuuugugggcaggccaugcuguuccgaugucuguggguuguccuggcaccucccccccauggcucccgggcccucagugccagugcuuacgggaacuccucugccugggcagugacucuugugauggccucucugacaggacccgauggcccauuaggucugggcuggagccaccugcaaccucucuggccuuugcaaggacagagaguagagaguagcagcuacuacuuucuacaguagugggcucuuccugugugacuggcccgucugguggccacaccaaccucacugccugguccagagagagcccccagaaucuuuggccuuugcagcacugacgcccccucccgccuugcuuuccuuggcaggaaaacugaagccagucaucaaaucccagccagugcccaagaacaacaagggacccgucaaggucguggugggaaagaccuuugacuccauugugauggaccccaagaaggacguccucaucgaguucuacgcgccauggugcgggcacugcaagcagcuagagcccguguacaacagccuggccaagaaguacaagggccaaaagggccuggucaucgccaagauggacgccacugccaacgacguccccagcgaccgcuauaagguggagggcuuccccaccaucuacuucgcccccaguggggacaaaaagaacccaguuaaauuugaggguggagacagagaucuggagcauuugagcaaguuuauagaagaacaugccacaaaacugagcaggaccaaggaagagcuuugaaggccugaggucugcggaaggugggaggaggcagacgcccugcguggcccauggucggggcguccacgccgaggccggcaacaaacgacaguaucucggauuccuuuuuuuuuuuuuuuaauuuuuuauacuuugguguuucacuucaugcucugaauacugaauaaccaugaaugacugaauaguuuaguccagauuuuuacagaggauacaucuauuuuuaucauuauuugggguuugaaaaauuuuuuuuuacaccuucuaauuucuuuauuucucaaagcagauaauucuucugugugaaaauguuuucuuuuuuuaauuuaagguuuaaaauuccuuuuccaaaucauguugauuuugcucuuugcuuuuucguugucugagaaauuguuggcguagauuuggcuucugguauguguuucugauugcuuccuguugagcacaaagugagagcugccacugagcagcccugccaggggugcuguuucaggcugggcaucgccaggcggccucccugcaaaccaagggcugggggcaaaggggcaugauccagggucccccagggugggcucagcuccagggagaggccacccacguggcagccccaccucuugagagcccccagugccggagcagaaaggacccuggacccagaggcagauacugcggggugguagaaaagguagaguaggcuguggcaauggaauaaaacacgauuaaaaacguuaa

SEQ ID NO: 191608 - RNA, 56611 nt, Homo sapiens
ucgguccucagaggaggggcccgggcacccuccgugcgggccgcagcacgccggucuuugagggacccuuggacucccggaucugcaugcgagggaugcggucgaagacgagaugagggagcugacgggaggggaaacggaggggcaggugaacauggagagagcaggaacagggagagaguagggacagcgacugggagacgcgcuccacagaaacccggacugagaggcagcgagagggugagaguccggugcuguuccuuccaaagcugcccccaagucagggaugagcucgaggguuucguuugugagggggucccgggaauccagcgaggccggguaggugguggggggcgcgcgguggcccgggguguccgucccgccgggggcgcggaggccgugugggccccgggcaugucccgucggggacgcggaggagggguccgcccaccacguccgguccccgugggugcagcgcccuucugggcuccccgagcguccacacucccuccuuggcagagaaaggccucgggcagagaccccaugcggaagccaccccggccucggggccgccugcggggacucagggucgcccagggaugcgggccgggcaccccuagcccccggcgggagacugugacagagcgggagaagacggaggaggccaugacacagggcgugagaaacacgaagacgcaaaaacgggagaggugggaagacgcagaaggggaaaccagggagagacagaaaggagagagagggcaaggaaggggguggcgacuguccccagaaaaucaaccucgcauucuguccuagucauguuuuaggugucaggcuaaaguaacaaaugaaaaguguguaguuagaaaggauguccaugagaaaguagucccugcauaggcugaggagcgugugcacaucuguauuugucccggaaucgugaaauguagaugcaccuuacugauuaaaggguuaaaaaaaaaaaaccuuacauuaaaacuaacguuucggaugggcgcggugccucacgccuguaaucccagcacuuugggaggcggaggcgggcggaucacgaggucaggagagcgagaccauccuggcuaacggcgaaaccccgucucuacuaaaaauacaaaaaaaaaaaaaaaaaaaauagccgagcguuguggcgggcgccuguagucccagcuccuagggaggcugagucgggagaguggcgugaacccgggaggcggagcuugcagugagccgagaucgcgccacugcacuccagccugggcgacagagggagacuccaucucaaaaaaaccaaaaacaaacaaacaaaaaaacuaacguuucuuuggguguaaaguucuaugaauuuucacauauguauguauacguguaguaaccacuguaaccaggauacggaagagcccugucccacccugaaacuccuugugcugccauucucuucugugcuucauuugcuuuauggucacucccuccgacaccuggauccuuggcaaggacugaucugcucuugaaaccuaguuuucucuuuuuagaaaugguauauaaauggaaucauacaguaugauauaaccuuuugugacuggcuccucaaaagcguaaugcuuuugugauucauccauguuuacgaagagucaaacuguaaaauauuuagaaguuuauucugagccaaauaugagugaggaaggccaagguacugucugaagagguccuaagaacauguauccaaggugguuggguuacagcuugauuuuacacguuuugggaagacuuaagacaucagucaauacauguaaaguguacacugguucugucaggaaaggcgggacaacuccaagcggugcuuacaggucacaggcggauucagcgauuuucugauuggcaauuggcuaucugaagaccagguucauagaaaggagugucuggguuaagauaagggguuguggagaccaagauucuuaggaugucucauagugacugucuuuagauggcaaaaauuuccuauuuaaaccuuuaaaaggugcuagauucucuggccgggcgcaguagcucacgucuguaaucccagcacuuugggaggcugaggcaguaggauugccugagcacaggaguugaagaccagccugggcaacauggcgaaaccccaucucuacagaaaauacaagauuuugucagcacaguggcaaagacguuaaucucagcuauuugggaggcagaggugggaggauuacuugagccugggaggcgaagguugcagugagcacagauugugcugacacuacagccugggugagagaggaagacagagggagacucugucucaaaaaaauaaaauaaaauaaaauaaaauuauauauauauauauauuguuuguuuguuggguuuuuuccagacguagucuugcucuguugccuaggcuggaguagaguggugugaucuuggcucacugcaaccuccgccucccagguucaagcgauucuccugccucagccucccaaguaguugggauuacagguaugugccaccacauugggcuaauuuuuguauucuuaguagagaugggguuucaccauguuggccaggcuagucuucaacucuugaccucgugauccaccuaccucggccucccaaagugcugggauuacaggcaugagccacugugccuggcccuauauuuucauauaaauauauaauauauacugcaaagaagcauauuuggggauaaaauauuuugauuuccuucuuugucaugcaauguuaugccagagucagguuggaaacuaagcgguuauauaggguuaaauaaaacccuucuggugagauuuuuauaguuuguagggcaugauuuccuaugucccuuaguuagaaauuuggacaagaaaggaaaaaaggucacaauuuaguugguauccauaucauugugugugaaaacaguuuauuuuauuuauuuuuuauuguuauuuuuuugagacggagucuugcucuguugcccaggcuagagugcaguggcucgaucuuggcucacugcaaccuccaccucccagguucaaaugauucuccuguuucagccucccgaguagcugggacuacaggugcaucccaccacacccagguaauuuuuauauuucuaguagacacaggguuucaccauauuggucaggcuguucuccaacuccugaccucaggugauccacccaccucggccucccaaagcgcugggauuacaggcaugagccacugcgccuggccuacaacaguuuuauuuuaauugcugauaguauuccauguuaugauauacugaagaguauuuauccauugaaggauauuuguauuuuuuccguuuuauuauuuuuuauacuuauuuguuuauuuauuuauuuauuuuuugagauggaguuuugcucuuguugcccagucuggagugcaauggaguaaucucagcucaccgcaaccuccgccucccagguucaagcgauucuccugccucagccucccuaguaacugggauuacaggcaugugccaccacgccuggcuauuuuguauuuuugguagagacgggguuucuccauguuggucaggcuggucucgaacucccaaccucaggugaucugccugccucagccucccaaaguacugagauuacaggcaugagccacugcacccggccuauuuauuuauuuuugagauggagucucacucuguugcccaggcuggagugcaguggcaugaucucggcucacugcaaccuccaccucugggguucaagcgacucccccaccucagccuccugaguaggugggauuacaggugcacaccaccccaccuggcuaauuuuuguauuuuuaguagagaagggguuucaccauguuggccaggcugguuucaaacuccuaaccucaagugauccgccugccuuggccucccaaagugcugggaugacaggaaugagcaacugugcccagccuuuuccaaguuuuggaauucugaauagagcugcuauaaacauuugcauacagguuuuugugugaaaauaaauuuuuauuucuuuaagguagauacccaggagugggacugcugagucacgguaaauauguauauuuaauuuuacaaggaacuagcaaaccauuuuuaagagugacuguacuauuauguguuccccuugugaacgcaugagaguucaguuggcccacguucuuuauuugguauuuuuagcauuuaaaaaaaccguuagacauucuaaucaauggugguguugcugaaacaccagggguuuggucuaggugcugcuguuuguggcucagaaagccaaucaugacaacaacaaguguugccaacgaagaaggcuuuaauuggguguuacugcugaggagaugggagaugggagaugggagaucagucucaaauccaucucccugacaggcuaaaaugagcggcuucuauugcugggaggaaauguaaccauauguggaaaaacaugaauugguuagggguaaggaagaggguuuggucaacaggaagcaggugguggguuaggcaaucaugaugggugaggggucugacuuucauuguccaaauucagugauccugugaguuucaacugguuaauacuaucugggaggccugaugguugcuuuccugagaaaggaacucagauaagacaaauguaacugucucaaguuuuaagacuaaaaggaucaguuacuguguuuauucaaagaaaccauaaacaucaguucuauagggcaauugggucuguuucaguguagggguaucucaauguaguuuuuauuuggauuucccuaguugcuaaugauacaaaaaauucuuauuacgugcuaaauugccaacuucuaguuaaguuuuuguucuugcuccuuguccauuuuucaauugcauuuuucucagguugauaaauauggacuuuuuauuaaggaaagauuuuacuaugggcaauucuuuuaacauauuagaacaggcugggugugguggcucacaccuguaaucccagcaauuugggaggcagaggcugauggaucacgagaucaggagauugagacaauccuggccaauacggugaaaccccaucucuacuacaaauacagaaauuagcugggugugguggcggacgccuguagucccagcuacucgggaggcugaggcaggagaauugcuuaaaccuuggaggcguugguugcagugagccaagaucgggccacugcacuccagccugggcaacaagagugagacucugccucaaaaacaaaacaaaacaaacaaacaaaaaacauaugcagaacaauguaauaagccccagccauaauccagcuuuggaaacauuuaaaaauauauauuuuacuuagcauuucuauugaauuugaaguagcggggaggguuuccuguuuuagcuuagucuauuauccuaguggaaaauucuuugcuuuugacacuuuuaaacaguuuuagacauuuuaaauauguucacaccuucuuugauagcuacgcagcauaccaauuuaccacaauuuauucauccaguccucuacuagacguuuuguuuauagucaaauuuuaguuuauagucaaaaagcaucaaguauugcuuuugaugaaucuuacauuugcaaauauauuuauagaauacguuccuagaaaaauauugcuugaucaaaaggucuacuuauuuauaaucgauacacuacuaaguugcucagaagagguuauaucaauuuauuacuccaccgacuuccuuauauucucucucucuuuuuuuuuuuuuuuuuugagacagagucuugcucugucccccaggcuguagugcaaugcugugaucuuggcucacugcaaccuccaccucccagguucaacugauucuccugccucagccucccgaguagcugagauuacaggcaugugccaccacgcccugcuaauuuuguauuuuuaguagauaugggguuucuccauguuugucaggcuggucucgaacuccugaccucaugugaucugcccacuucagccucccaaagcgcugggaauacaggcauuagccaccccgcccggccuagagaacagcuuucucucuuucgagagagagaggcacccguaugggaccucuagaccucaguggagugcaccggauuuuauaggcaggcuugaggaggcggugucugauuuaccaggggcccagagauggguuggaccaggugggacgucuacauagcaugagaggaagcuggccacccacccuaaucuacuuaaugcaaaugagcuuuccacugggccagugccauguugugugcucccuacugcacaagugguuggaaagaaaaacagaagauggaaagaaaaacagaagauggagccgccauuuuaaacacaccuagucucugguagccuuuucugauugacacaacugccagcauucaccugugcaagcuuccgcuugcuuguguaugucugcagcucauuuuuacaggcuccuuguuagaaaguaaaaugauuuuggggcugcuuuuuauuaaaaggaaagcuuuaccgaugacuuccuuacccucacuaucugccuaaauaauuucuuuuuaacuccuauaucagcggugaggacaaccagaggucacucugauugccaucuugguuuugguagguuuuaggcuggcuucuuuagugcaaccuguuuuaucaguaaggcuuuuuuuuuuuuucuugauagaguuucacccuguagcccaggguggagugcaguggcacaaucuuggaucacugcaacuuccgccucauugguucaggcgauucuccugccuuagccuuccaaguagcugggauuauaggcuugccaccacacccagauaacuuuuguauuuuuaguagagauaggguuucaccauguuggcuaggcuggucuggaacuccagggcucaagugaucugcccaccccagccucccaaagugcugggauuauaggcaugagccacugugccaggccaucagcauggucuuuaugaccuguauguugugcugacuuccuaucucuuccugugauuuagaaugccuuaaccaucugggaaugcagcccagccucauuuuacccagccccuauucaagaugaaguugcuacaguucaaaggcuuuugacaaagugaucugccugccccagcuucccaaaguucugggauuacaggggugagccacugcaccuggcuuuugguuauuuuuguguuuuuuaaauauauauauauauauauauauauacauauauauguguguauauauauauacacacauauauauguauauauauauuuguuuuuugugaccuucagauuuuuuuuuuuuguuuuuuugagacggaguuuugcccuugugcaagcuggaguacaaugguaugaucucggcucaccgcaaccucugccuccugcguucaagcgauucuccugccucagccucccgaguagcugggauuacaggcaugcgccacugugcccggcuaauuuuguauuuuuaguagagacggaguuucuccauguuggucaggcugaucucgaacuccugaccucaggugaucugcccgccuuggcuucccaaagugcugggauuacaggcaugagccaccgugcuuggccaugcuguuuuugucuuuuuuuuuuuuuuuuugagacggaguuucgcucuuguugcccaggguggagugcaauggugugaucucggcucacugcaaccucugccucccagguucaagcaauucuccugccucagccucccaaguagcugggauuacaggcacccgccaccacgcccagcuaauuuuuuuguuuuuuuguuuuuuuuggauuuuuaguagagacgggguuucaccauguuggccaggcuggucuugaacuccugaugucagguaauccaaccccccuccccaccggccucccaaagugcuaggauuacaggugugagccaccacgcucagcccguuuuugucuuuuugauaugagaucucauucuguugcccaggcuggagugcaguggugugauaauagcucacugcagccuccacccucugggcucaagaugcucccaccucagccuuucaaaguuuggggacuacagaugugagccacagcaucccauccauuauauucuuaaugaucucucuguacaacuuaaaguuuauuuuuucaacucugaguacuuuuaaagauauauuaacuagacauuagauaauagguaaaagaguaacaccuaaucauuuauuauuuguuuagagauggagucucacucuguugcccaggcuguuuuuuuuccuucagcacuuuuauuuuuauguuuuuggacagagucuggcucugucgcccaggcgggaaugcaguggcgcaaucuuggcucaccgcaaccucugccucccugguucaagcaauucucaugccucagccucccaagcagcugggacuacaggcacacaccaccacgcccagcuaauuuuuguauuuuuaguagagaagggguuucaucauguuggccaggcuggucuggaaucccugggcucaggugaccugcccagcucggccucccaaaaugcugggauuaccaccugaccucauuuauuauguuaaagacuguuagagauaaugcugauugcaauaaccacauuaacaaagccuaguugaagaaggcaggcauuugaaagugguuuauuuucuuauucaguuuugacaguucuuaauuuauucugaauguaaguccuuuguuggauauaugauuaguaaauauuuuauccuggccaacacggugaaaccccgucucuacuaaaaauaccaaaaaaauagccgggcgucguggcaggugcccguagucccagcuacuuaguaggcugaggcaggagaauggcaugaaccugggagguggagcuugcagugugccgagaucgcgccacugcacuccagccugggugacagagcaagacucugucucaaaaaaaaaaaaaaaaaaaaaagaaagaaagaaaaaaagaaagcuuuaauuuuaagugggagcuaagcuaugaggacgcaaagucauaagaaugauauaguggacuauggggacuugggaagacugggagcaggggugagggauagaagacuacacacuggaugcugcugcguacacugcuugagugauggaugcaccaaaucccagauaucacaccuggagaacuuauccaugucgcuaaacacuaccuguuccccaaaaacuauuagaauaauaauaauaguccgggugcgguagcucacaccuguaaucccagcacuuugggaggcugaagcagacagaucacuugagguaagcaauaguugaagaucagccuggccaacauggugaaucccagucuccacuaaaaauucaaaaauuagcugggcaugguggugcgcgccuguagucccagcuacucaagaggcugagcaugagaaucacuugaccccaggaggcggacguugcagugagccaagaucaugccauugcacuccagccugggagacggagacuacgucuccaaaaacuaauaacaauaauaauaauaauaaagcuuuaauuuugauuaaguccaauuuguacuuuguugcuuuuuguggauugggguuuugguaucauguguaagaacucugccuaauucaaggucauaaauauuugguuuuguucuagaaauuuccuaguuuuauguuuuaaauuuauuuauuuauuuauuuauauguuuauuuauauuccccuauuuaaagcuuuuaauuuaaaaguaaaauuuaaugucaaaaaugcaaacuuggggagggcguaaaaaucacacucaaggcugccaccucacacuuagaggguugcagagcggccaggcagaggcgcuccucacuucccagacuguggggcggccgagcagaggcacuccucacuuuuuagacagugcagcugccaggcagaggugcgccucacuucccagacggguuggcggccgggcagaggugcuccucacuucccaguuuaaauuuauaucuguuaucuguuuuuauuuacuuuguguaaaaaguguaagaguuggguucagguucauuuuuuugcauaugaaaguccaauaguugagacacaauuuguugaaaaacuuuuucuaucuucauuuaagugcuuuuuuuuucuuuuuugagauggagucuuacacugucacccagguuggagugcaguggcaugaucuaggcuuacugcaaccucugccuccuggguucaagggauucuccugucucagccucccauguagcugggauuacaggcgcccgccaccacacccagcuaauuuuuuaauauuuuuaguagagacaggauuucacuguguuggccaggcuggucucgaucuccugaccucgugauccaccugccuuggccucccaaaaugcugcgauuacaggcgugagccaccgcgcugggccuuuuuuuuuuuuuuuugagaccgaguuuugcucuuguggcccaggauggagugcaauggcauggucugggcucaccacaaccuucacuuucuggguucaagugauucucuugccucagccucccaaguagcugggauuacaggcacccaccagcaugccuggcuaauuuuuguauuuuuagcagagacgggguuucaccauguuagccaagcuggucuugaacuccugaccucaggugauccucccaccucagccucccaaagugcugggauuacaggugugagccaccaugcccggcccauugaauugcucuuacaccucuguaaaaagucagucguccaaauuuguguggguuuauuuuuagauucuuguuuuauugauccaugugucuaucccuuccccaauaugacaugcucaugauuacuguagcuuuggaggaguguugagaguagacauccuugccuuucucaaucugaggggaagccauuuagucucacuguugaguaugacguuaacugcauacuuuucuuuuaacacagagucuugcucuuuccugcaggcuggagugcaguggcgugaucucggcucacugcaaccucugccucccugguucaagcaauucucccgccucagccuccugaguagcugggauaacaugcgugcaccaccauguccggcuaauuuuuguauuuuuaguagagacggguuuucaccauauuggucaggcuggucuugaacuccugaccucgugauccaccugccuuggccucccaaacuguugggauuacaggcgugagccacugugccuggcauguagauacuuuuuaucauguugugcuaauucccuuucaucccuaguuuugugagaguuuuuauugugaguaaaugugaauauuuguuuugucaaaucauuuuucugcauuuaugggcaagcacaaucacuuacauguauuuaguugugaaaaacuggaaccuaaacguauaaauaagucggaagcauccauaagaugaaauauguagacauuaaauuuauguuuucgaaaaauauuuggcugggcgcaguggcucacgccugcaaucccagcacuuuggaaggccgaggcgggcggaucaccugaggucgggaguucaagaccacccugaccaauauagagaaaccccaucucuacuaaaaauacaaaaaauuaguugcgcaugguggcgcacgccugugaucccagcuacucgggaggcugaggcaggagaauagcuugaacccgggaggcagagguugugaugagcugagaucaggccauugcacuccagccuaggcaauaagagcgaaacucugucucaaaaaaaaaaagaaaaaaaaaaagaaaaaaauuuaaugcuaugcaagauauucaaguauauuaaauaacaaaggcagguuucaaaacaguauuuauggcugggugcaguggcucacgccuguaauuccagcacuuugggaggccgagguggguggaucaccugagaucaggaguucgagaccagccuggacaacauggcgaaauaccaucucuacuaaaaauacaaaaauuaucugggcgugguggugcacgccuguauccagcuacucucaggaagcuaaggcaggagaaucgcuacaauccaggaggcagagguugcaaugagccgagaucgugccacugcacuccagccugggugacacagugaaacuccaucucaaaaacaaaacaaaacaaaucaaaaaacaguauuuacaguuucaacuguauuaagaaaauaaauaaauauuguguguguguauacauauauauauuuauauaaaagaagcucacaaagauaagaaccaaaaugcuucgagugauugucucuggauuguaugauuauauguggccuuugucuuuauacaacccuguauauuucaaauauucugcaaagcacagaaaaguaauaauaaaugugcucacugcagccucaaccucugggguucaauugauccucucaucucagccuccugaguagcugggacuacaggugcaugccacuaugcccagcuaauuuuuuuuuuuuuugagacggagucuuguucugucaccaggcuggaguacagugacgcaucuugacucacugcaaccucugccucccagguuccagcaauucuccugccucagccuccagaguagcugggacuacaggagcacgccaccacgcccagcuaauuuuggauuuuuaguagagacggggcuucaccauguugaccagauggucuugauuucuugaccuccucgugauccgcccaccucggccuccuaaagugcugggauuauaggcacaagccacugcgcccagccaauuuuuuuuuuuuaaguuuuaauuuuuuuuguaaagauggggucucacaauguugcuaagcuggucuuagacuccuaggcucaagugauucucucaucugggccuccuaaagugcugggauuauaggcauaaaccaguguaccuggucuauuguuacugugugaauaccuacuuuuaaauuuagguauucuaaauuccaaauguaacuuaaaguauuaaaucuaaugaugugccgggcgcgguggcucacaccuguaaucccagcacuuugggaggcugaggcgggcacaucaugacgucaggaguucgagaccauccuggccaacauggugaaacuccgucuccacuaaaaauacaaagauuagcugggcguaguggcacaugccuguaguccuagcuacuugggaggcuguggcaggaaaaucacuugaacccgggaggcggagguugcagugagcgagaucagccacugcacuccagccuggcaacagauaaauaaauaaauaaaaauuuggccgggcgugguggcucacgccuguaaucccagcacuuugggaggcugagauggagggaucacgaggucaggagaucgagaccauccuggcuaacacggugaaacccugucucuacuaaaaauacaaaaaauuagccgggcgugguggcgggcaccuguggucccagcucuacucaggaggcugagacaggagaauggcgugaacccaggaggcagugagccgagauugcgccacugcacuccagccugggcaacagagcgaaauccaucucaaagaaaaaaauaauaaaauaaaauaaaaauuuaaaaauaauaaaaguaaaaucugaugaugugcuuuaauguucaaauccuagcagucaguugaaguauauaugaauauauauuuaauacugcaaaaguaaaaugcuauaauaauuauugaggauuacgaaagauguuauuuuauguaauaaacaggaacuuucaaauaguuacauacauugacaguauauuuagagcguguuaucuagauaacuuuagaaagaacauuauguucuuuuugagccuacagauguuuauaaaaauauaauucuaccauagggaaagagaauuaacauuagacauaauaauucuaguuacuauggaauuauuuugcacaguugcauucauaacaguacauaaaauacuuuuuuuuuugagacagagucucgcucuguuccucaggcuggugugcaauggcaccaucucagcucacuguaaucucugccuuccagguucaagcgauccuccugccucagcccccuaguagcugggauuacaggcaagugccacuaugcccggcuaacuuuuguauuuuuaguagagacgggguuucaucauguuggccaggcuggucucaaacuccugaccucgggugauccacccgacucggccucccaaaguguugggauuacaggcgugagccaccacgccaggcccauaaaacacccuuuagaaacgaauguuuaacaauuuuguuccauucuguccuuucaaaaaaaaaaagaucccuggcugugcgugguagcucacaccaggaaucccagcacuuugggaagucaaggcaggagcaucccuugagcccaagaguuggagaccagcuugggcaacauagcaagaccuucucucuaccaaaaauuuaaaaguuagccagguguagcagggugggccuguagucucagcuacuugggaggcugagacgggagaauugcuuaagccaaggaggucaaggcugcagugagucaugcuugugccacugcacuccagccugcgcgacagaggcacagccugucucaaaaaaaaaaaaaaaaaaaaaaaaucccuauuugguaauuuuucacacauuagggagaaaaaagcagugucaacuuggucaccucaaaauuucacaaggagggagaaucucaucuacaacacauauaugauaaaucaucuuuaaaucaucuuugagucaugauuaaaaauuuuuuuaaaagagaguaugaagaaaaagagaaaguuuagauuaaaauggggcacuccaaauacaacuguucucucuaauccacagacuuuuuuuuuuuuuuuugagacagaguuucgcucuuguggcccaggcuggaaugcaauggcacaaucuuggcucacugcaaccucugccuccuggguucaagcgauucuuccaucucagccucccgaguagcuaggauuacagcuacuuuucuuuuuuuucuuuuuuuuuuuuuuuugagacggagucucacucuguagcccaggcuggagugcaguggcaugaacuuggcucacugcaagcuccgccucccgaguuaaugccauucuccugccucagccuccugaguagcugggacuacaggcgcccgccaccacgccuggcuaauuuuuuguauuuuuaguagagacgggguuucaccguguuagccaggauggucuggaucucuugaccucgugauccaccugccucggccucccaaagugcugggauuacaggcaugagccacugugcccggccuaauuuuuguauuuuuguagagaugggguuucaccauguuggccaggcuggucuugaacuccugacaucaggugauccacccaccucagccucucaaaaugcugggauuacaggcgugagccacugcgcccggcccuaauccacagacuuuagagcaugcuuuuaguaagacaaguuaucauagguuggcauccaugaaggcuguuuuuguuuaagacagggucucgcuuugccacucaggcuggaaugcaguggcacagucauggcuuacuacagcuccaaacuccuggguucaagcaauccucccaccucgaccucccaaaguguugagauuacagaggugagucaccgugccuggacuaauguuuuuagagcuuguagagauaauugcuauagacugguaaccauuuucgguugagauuuccccaagaucuuauucuaaauauugauuuauuuuaggaaacauuccuaaaauauuuuuccugauucauuuucugcugugcaccaaaagguuaaugaaauauuaaaaaugcugcaauaaaauauugaaaaugucuuauauaccagauauauacuguauauaucuguauauguaccagauacuguauauaucugguauauaagauauuuggggcugggagugguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguggcaggcaccuguagucccagcuacucgggaggcugaggcaggagaauggcgugaagccuggaggcggagcuugcagugagccaagaucgcgccacugcacuccagccugggcaacagagcgagacuccgucuaaaaacaaacaaacaaacaaaaaaccagauauuuggauaugaagaaucacgcuuaacuuuuuauguuugaccauacagaggagcaauuauuaauucaacuggguuuccauuuucccuacuuaaugaaaaauuccuaggucucagugaaucugacuuugagaaaaauuuguggaauguaaaaucaguaaacggaaacgcacgaacgucgaauuucccauggaaaaauacaguaaaggcuaugagcacaagcacacuauaguuuguucccaucuucaguuuuacauucagaaaacagguauagcuucauguauguuauuuuauugaucgaugauugauuaguauaguggcaugaucucggcucccugcaaacucaaccucccaggcucaggugauucucccacaucuagcuuaauguauuaaugauguaauagacaauuacuggccaggcgcgguggccagagcgagacuccaucucaaaaaagaaaagaaaagaaaauuacuggcggcaagcaggaacauuguagauuuugaaacugucuuguuuuacaagauacugaagcaagguggugcaauuauuacguccuucuaaagcugaucggauaaaggcuuuaauuuuguaauuuucagagaauauuaccaauguagcaagauuuaccaauaaccaaugguugcuugaagacaaaagaguuuguuggaacuugcugaauaaauugaugugccaucaguguauuuuuuacaucauacaugcugaaaaaaaucuguccuugauucugugcaaaggaagaugcugaaauuggugugcauaugcagggaaagucaagaugcagauggaaacugggauuauuuuguuaacucaaaaaccaauuggcagggugcgguggcucacgccuguaaucccagcacucugggaggccgaggugggcagaucaccugaggucaguaguucgagaccagccuggccaacauggugauaccucgucucuacuuaaaauacaaaauuagcccccaugguggcgcaugccuguaaucccagcuacuugggaggcugaggcaggagaaucacuugaacccgggaggcagagguuccagugagcagagauugcgccauuccacucuagucugggcaacaagaguaaaaacuccaucucaaaaaacaaacaaacaaccccccaaaaaagccaauuaaauuguuucauagucacauuucuagauccaaacuuuuaggacaauuuuuuucucuagugauuauguauagcagcaagagcagacaaaaauauuauaaauuaaaaauaaguuaguacaacaaccuuacaucugcuucugaaaauauugugcaucuucuuuaaacaguacacaaaaagcuucagucagugaaauugcuuaaugaaaugccaguaccauccaaagaauuuuuaaggccaagaauuaaauaggaagaauuucuugucuuaauauauuccuauucaaggaaggaacauuuaauaaguuggugguaauauuaccauauuaaagcagagagguagccuugcuuucuauggagcucaguuggaagucuuauuuaguaauacaaaugucccuguuaaauggccauaggagcaucugacagaaauuguuguucuugccuuauaacaucaaacuugaaaacuuuacuacuuuuuuuuuggagaugggaugucagucugucgcccaggcuggagugcagugguauuauuacagcucacugcagcuucaaccucccuggcucaagugaucuuaccucagccucccgaguaacugggucgacaggugugcauuaccauuucaggcuaauuuuuguauuuuuuuauggagacagggucccaccagguugcccugacuggccuugaauucuugggcuccaacaaucuacccaccucggccucccacugugcucggcuacuacauuuuuuuuuuucuuuuuugagauggaguuucacucuuguuucccaggcuggagugcaauggugcaaucuccgcucacugcaaccuccuccuccuagguucaagugauucuccuaccucagccuccugaguagcuaggauuauaggcacccacgaccacgcccggcuaguuuuucuauuuuuaguagagaugggguuucaccguguuguucaggcuggucuccaacuccugaccuuaggcgauccacccaccucggccucccaaagugcugggauuauaggcgugagucaccgugcccggcuucucggcuacuacauuuuaaauaauaaaauuauacaacagaauuuucuuuccaagaaaauucagauuauuauuuuuuuguaaucuacucauauugugagucagagaauggcaauuuucauuauuaagcauucaccaucugacaaauauguauauucagguaaaucccaaauuacggacugcauauguagccacaggcgaaaaguaacuuagucugcucaagagcaguugccccaacaggauaguucucauacuuuugugauuuacagauaguuauacuguuaugggcauugacuugauucauguguugaaauacagguuuagcaggguuugauucauacauguuugaaaugaagacuuccuggaaaaccagggucaugugcuuauccuaucaccacacacaugaaaccgccccaacaggguucacaaaaauugcaugcagguucuggacagaaauauaguuauaauuaagcauuaaucaggcugcacuucggccuacuuccuuguugcuaauagucacaaggcacuagauacugacauuugcaucucuauuguuccuauagauaggauuucagacaucagacuaagaauugauuugcaucccuguuguuccuguagacaggaucucugacauuagaaucauaaggcuuuuguuuaaggaucgcuuaagauguuuuucagaccacgaguuccggugaaacaguugaguucaaccaguuugaagaccccccacagaggaaugggaugagcaugagaauguaguuucuucaucuccuuguaccacgauuucaccagcacucucccaccaaucagucaacuccauuacccuuacaaacucuaaccccaaauucccaaauuccuagcagagauggaugugaggcuucuuccugucuccuccuuagguggcccuaugauuagaccucuuucucugcugcaaccuggugucucugcauauagacuugcuaugugcauugggcaaggaaccuacugcuguuacacacacucuguugacuuaaaacacaaccucaccagaaaacacuuuguucucgcagguccuuuuuuuuuuuuuuuuuuuuuaagauggagucuagcucugucgcccaggguggagugcagugcugccaucucugcucacugcaaccuccgccuccuggguuccagcgauucucuugccucagccuccggagcagcuggaauaucaggugcacgacaccacgcccggcuaauuuuuguauuuuuuaguagagacgggguuucaccauguuggccaggcuggucuggaacucaggugaucugcccgccucggccucccaaagugcuggaauuacaggcgugagccacugcgcucggccuguucucgcagguccuuuugcucagacgcagcaaaccguaaccccaagcucgaucucugcugcucucaggaauuccacuuccuccagcuugggcaacauagcgagacccugucucuacagaaaaauaaauaaguaaauaaauaaauacaaauaaauaaaacauuagccgggcuugguagcugcgccuguaguccaagaugcucgggcaggcugaggggaaggaucguuugagcccagcaguuuaaggcugcagugagccuuguuugugccacuugcacuccagccuggacgacagagggagacugucucuaaauaaaucaauaaauaaggccgggcgcaauggcucacgcuuguaauccuagcacuuugggaggccaaggcggguggaucauuugaggucaggaguuucagaccagccuggccaacauggugaaaccccgucuccacuuaaaaaaaaaaaaauuagcugggcauggugguacaugccuguaaucccagcuacuugggaggcaaaggcaggagaaucgguugaacccggaaggcgguugcagugagccgagaucccgccacugcacuccagccugggcgacggagugagacuccgucucuaaauaaauaaauaaacaaaaauuaagaauccuauuuccagaccaggccccggagagucaauaauccgagaugugaaggagaccuuaaaauauuauugaucccaacacaggccgcgugggaccugaaccgccucaccuuggcaaccacauuuguaauuuccgcaaaugaucuauaucuucuucauuccaaaauugugccucuccgucacucauuccacccauaggcucccuucagccgugucccccuuacucucacccugcacauuuccgcuguucuaaauacggcugcccuucagcagaagcuguugccugcagacggcgccugcguaucgagccuccgugaagaaaaucacuccccagaaugagcccggcuuugcggcuggguccuaaacugcggugagcugaaccuucucgugggaaugugagaaagcggaacacacgugggccccaaauaacaacccuccccacaccgaagcccaagagcugggggggaggggcggaggcgacgcggggggcgcuggccgcaggggccggcagggggcgcgcuggccgcgguggcugggcagcgcgagccugcggcgcgucuaggcccgcgcgguucccggugcacucgcugcccacaaagcgccagcugaggggccgcugcggguggagugcggcggagucggccucgcgaccccagcuugauccgccgccugcugcaccgcgccuccgccgcguuccugcgcgucccgagccccgacggccgcgugagucccguccgugcggggaaggcagggccgggucggcgccgccuguggagaggacccggcggccgggccugcuuggagccgggcgcgguggcagcggcggcagcggcggcgacuuccgaggcccgggcuagacagcgcagggccauggcugaggcggccccggccccgguaagggcggccgcgcgcgaguguugugagcccccgagacccagaccccgagggaggaaggcgggcgggcagggagcugccaggcauaggcgccguucucgggucccgccggccacgucgccugucgcccgugcuuggcggcugcagccucgcgugaggggacuuagcgggugggugugaaaccgcccacccggggacaccaggcugggccgcaggucugaggggcacucgcaggcagcuaugagacccggggcccugcaguuggguugaagucgagggggugccugcugcgugucagccccacgccugcccgccagacgcgcagcgggguugggcuggggagccgucagccauucucgcggccgcgggagcguucgucaccagcaaucugagcgguggcgcgggcggcauuuaagugugcggaggcgcauucccgccgcgcugcgugacgccugggcucccggcaccggacucgggacacgcgggaggcccucccgaaauagcugccgaaugaauggugcggacccggaggcuggaguggccucgcgugcguggcgguucauucgcggguguuugccaaggccugcgggggccggcagcggccaguugccagggcgaccgaggcgaccgggccgcgccugcacgcagccccguagaaugagaaggggacggucaggccgcggggaaagcacugaucgcauuugccacccaagaggucuuuggucaccucuaggagagcaauuguacugggucaggagccacccuggcacaugaggggugacugggaaaaggaggaagagcagcgauggguaggggguagagcagagggaagugccaccuccacucuuggaccuguuuuucuuuuuuccaaccuuuuuuuuuguguauaggugggaugguagcgaugauccuguguugugccaguccuggcuaauagaaauauaagggaagccgcauacaaaacucuaaaucaagcuuguccaacccgcggcccccaggccgcaugcggacuaggacugcuuuaaaugcggcccaacacaaauucguaaacuuuccuagaacaucaugagauuuaugcacggaccuuuuucuuugucuuuuuuuuuuuuuuuuuuuuuuuuuuuuagcucaucagcuaucaugaucaguauuuuaugugugacccaagacaguucuuccaguguggcccagggaagccaaaagauuggacaccccugcuuaaauucucuaggcgucacguuuaaaaaguaaaaagccaggcgcuguguugugcacgccuguagucccagcuaggccgggggcugaggcggaagaaucacuugaguccaggaguucgaggcaguccacaccgcgucucuaaaauaaaaaaaauuuuugagaaguuaaaaaauaaauagaugaaauuaauuuuaauuauauaucuaacucaauauaugcaaaauauuauuucaacaugucaucaauuuauuuauuuauuuauuuuuugagguggagucucacucugucccucaggcuggagugcaguggcgccaucugggcucacugcaacuucugccuugccgguucaagcgauucuccugccucagccucccgaguagcugggacuacaggcgcgugccacuacgcccggguccuuuuguauuuuuaguagagagggggguuucaccguguuugccgggauggucucaaucuccugaccucgugauccgcccgcugggauccaaagugcugggauuacaggcgugagccaccgcgcccggccucauguaaucgauuuaaaacauuaauggccgggugugguggcucaagccuguuaucccaagcacuucaggaggcugccgugggaagacagcuuuagcccaggaguugaagaccagccugggcaacauaggaagaccccaucucuacaaaaaaaauuuuuuuuuuuaaauuagccaggcgugguggcaugcacuuguacucccagcuacucaggaggugggagguguuugagccagggagguggaggcugcagugagcugugauccugccacugcccuccaaccugggcaacaaagugaaacccugucucaagcaaacaaacaaauauuuuuuucauacuaagucuucaaagucucguguauuuuauacucauagcacaucucaauuuaaccacauuucaggugcucaguggccacauguagguaguggcuacuguauugaacagugccaguccacccuauggagaagaaucaggagacagauugacacuaagaaaggaacaaccuacccaaaaagguggaagggguuggcauaagugaagcaaauguggagaguuaagauuuaaauaggaugcaacuuccuuaggaaguaaagaagaaaacuuagauucgguuacugauaaguuugaagcaaggaguaugaagagaaaguugaaugaauuuaggucugauuaauuuccaucucaaagcaagaggacaugucaucuucugagagugggggcugcagcagacaagucuuacuacucagugucagcaucaccugggaauuuguuaaaaauacaaaaucucaggcuguguaccauggcucacaccuguaaucccagcacuuugggaggcugaggcagguggaucacuugagcugaguaguuugagaccagccuaggcaauauggugaaacccugucucuaccaaaaauacaaaaauuagcagggcaugguggugugugccuguggucccggcuacucgggaggcugagaugggagaaucgcuugagcccaugagauggagguugcgguaagcugagauuacaccacugcacuccagccugggugacagugagaccucaucccaaaaaaacaaaaacaaaacccaacagaaucucaguuuuccuuacagaccuacugaauaaaaaucuguacuuugacaagaucuccaggugauucuuccccgccucccgcgcccccccgccuccccuccugcccuagacagagucuugcucugucaccaugcuggagugcaguggcacgauuucagcucacugcaacuuccgccuccuggguucaagugauucucuagccucagucucccgaguagcugggauuacauggcuugccaccacacccagcuaauuuuuguauuuuuuaguagagauaggguuucaccaugcuggucaggcuggucucaaacuccugaccucaggugauccaccugucucagccuugcaaagugcugggauuacaggcaugagccacugugccuggccccuccagcugauucuuauucauguuaguuugaggacaaacuguacuaaaagcugaaggacugugcugaggcuuuguaguagccacuuuauggaaugggacaagcggcauggagggcacaagucaguguugagauccccacuaagcuuagaaaccauugguauguggugacagcaguuuaccuggugauuuccucuaggcacgcuuacuaaucugcuuacaggaauggagaaagaaugauuggacugauucaaggccggagguuagcugagcaggugaggcagaaagacaugagagaaggggaguuggaagugacugaugugaucaauuagagaaaaaaagccaggaacgggcagauaccaggagcaaauggaauggucaaaggacuaggugaaaugagaauaaaguagugggugaguuggaaagaugggagguugucgucagagaguggcuuaucagguucauagaguuagaaggcuuuguauacaucauccuaguccaacuuauuuguugugggaauuuuuuccuuuuauacuacucuuuguuucaaaguaaauuauuuuggagcagccuuuuauuuucuuggaaagaucaauaacccaggaguuauagguuacaaggagcuauggucaugucagugcacuccagccucggugacccugucucuaaaaauaaaaaaauaaaaaaaaaauuaagcuauagaagacauccugagguggcugguuugcaugcaagccuauuuauuuauucauucauucaacaaaaauuucuuucuuuuuuuuucuuuuuuuuuuuuugagacugaaucucguucugucgcguaggcuggaguacaguagcagaaucuuggcucacuguaaccucugccuccuggguucaagcaauaaguggauaacauuuaaacuauccaucuuagacuuuaaaaucauauauaaaauaauguggccgggcacgguggcucacgcccguaaugccaacacuuugggaggccgaggagggcggaucacgaggucaggcuaacauggugaaaccccaucucuacuaaaaauacaaaaaauuagcugagcaugguggcacgcuccuguagucccagcuacucgggagacugaggcaggagaaucgcuugaacccaggcagcggagguugcaguaagcugagauggcaccacuguacuccagccugggcgacagagcgagacucugucucaagaaauaaauaauuaauuaauuaauaaugugauuucccuuaaagauuucuuuuuuuuuuuuuuugagacggaguuucacucugucacccaggcuggagugcaguggcgcgaaguuggguugcuguaagcuccgccuccuggguucacgccauucugcugccucagccuccgaaguagcugagacuacaggcgcccgccaccacgccuggcuaauuuuuucuauuuuuaguagagacaggguuucaccguguuagccaggauggucucgaucuccugaccucgugauccacccccucggccucccaaaguguuaggauugcaggcgugagccaccgcgccuggccuagauuucuuuuuuuuuuuuuuucugagacggaguuuugcucuuauugcccaggcuggaaugcaaugaugcgaucucggcucacugaaaccucggucuccuggguucaagcgauuguccugccucagccucugaguagcugagauuacaggcaucugccacgauggccggcuaauuuuguaucuuuaguagagaugggauuucuccacguuggucaggcaggucucgaacucccgaccucaggugaucggccucucaaaguacugggauuacaggugugagccacccaccgugcccagccucuuuuuuuuuuuuuuuuugagacacagucucccucuguugcccaugcugcagugcaguggcauaaucuuggcucacuguaaccuccacuucucagguucaagcugauucuccugucucagccucccgaguagcugguguuacagaugugcaccaucacccggcuaauuuuuguacuuuuaguagagacgggauuucaccauguuggccaggcuggacucgcacucccaagcucaggugaucugcccaccucggccucccaaagugcugggauuacaggcaugagccaccgcaccggcaagaauuucuuuuuuugaauaguucaacaauuauuuauuagugggucacaauggcacacaccuguagccccagcuacuuaggagguugaggcaggaggauugcuugagugagccagccuaggcaacauaaugagacaccaagaccccgucucuaaaaagaaaaaaauguauuuauuguaggccaaaguuugccugucugaaaauuucguuauguugguucuaguucugcccucuggaguaacauaguguaagaugaaacaaggcuguucugccuucuguuuuguaacccucauuaucugaaaacagcucucauguuuucuucagauucaagauucuuagcuuauucagccauuacugaauggugugguuguaguuuguaaacagggugauugacaggucuagagcauaagucuauaauggauuuaucagagggcacuagguucagugaggccuggaaaggauccuugugcacauuugccuuuuccagagauagaggaugcugcagcaaccuaagcugggccuuauagcggaggaaauauaccagacuaguucaagagccaauuucauuaauucacugucuuacccaaucuaucccagaaccaccaaaucaggucucuuggcuguugaugccagugagcuccagaaagaugaggcauacgcaggcaguacuagaacuauauucaaauuaaucucugcuggacaguuaagcaguccuuaucugauuuuaguuuggaguuaggguuccuucuaacacucaaugucuuguuccaucuuuccacugcaugcagacaucugaaugggacuccgagugccuuacaucccugcagccccuuccucuuccuacacccccagcagcaaaugaggcacaccugcagacagcagcuaucucucuguggacagugguggccgccgugcaggcuauagagaggaagguggagauccacagccggcgacuccuacaccuggaaggucggacagggacagcagagaagaaacuagccagcugugaaaagacaguuaccgagcuugggaaccagcuggagggcaagugggccgugcugggaacccugcugcaggaguacgggcugcugcagaggcggcuggagaacuuggagaaccugcugcgcaacaggaacuucuggauccugcggcucccuccagguauuaagggagauaucccaaagguaauaccuucauuucuagauguaaagugguaccacuagaacuuacauuaguaguagucuuggucauucaguuacuuagauuuuuuauuuccuuuuaaaguuucuuaaaauaucucagucugaaagaaucaugaagguguuuuauguuugucuauuugggaaacauuuuauguucaauuuaguacccauuuagagugccaagauucagauuggaaaccucuugcuggaccaaaguuggcuaucugguagauggauuuuuuuucucuuuugguuucuccuacccauuacccaugagccgcuucuuucuucguuaacuugugugccagauucuuggggaggagacuacauaaauauucuuuuaaaucagucaauuugaggcugggcgcgguggcucaucccagcacuuugggaggcugagaugggcagauaccugaggucaggaguuugagaccauccuggccaacgugaggaaacccugucucuacuaaaaauacaaaaauuagccgggugugguagcacaugccuauaauccuagccacucgggaggcugaggcuggagaauagcuugaacccaggaguuggagguugcagugagucgagaucaugccacugcaugccaggcugggcaacaagagcaaaacuccuucuaaaaaaaaaaaaaaaaggccuggcgagaugacucacaccuguaaucccagcauuuugggaggcugaggcagguggaucuccugaggucaggaguucaagaccagccuggccaacauggugaaaccccgucucuacuuaaaauacaaaaauuggccaggugugguggcucacaccuguaaacccagcacuuugggaggccgagaaaggcagaucacaaguucaggaguucaagacuggccuggccaacaaggcgaaaccccaucucuauuaaacauacaaaaauuagcugggcuugguggugggcgccuuuaaucccagcuacuugggaagcugaggcaggagaaucgcuugaacccgggagacagagguugcagugagcugagauugcgccacugcacuccagccugggcaacagagugagacuccgucuccaacaacgacaaaaaagaagaaucaccugguaggcuuuuaaaauuuuggugagcaucacauccagauucugaccuaauagguccaggauggagcuuaagcaugaauaauuuuuuaaaaaccuccauagaugauucuaauauaugacuaggguugugaaucacugauguguagggcauuuaagaccaaggaaaggaauuuggauuuuuaacuaagguguaaugaggagaaauuggaggguuugaagcagaggaauuauauuugguuauauauauauauauauauauauauuuuuuuuuuuuuuuuuuuuuuaauuuuuuuuuuuuugagauggagucucacucuguugcccaggcuggagugcaguggcgccaucucggcucacugcaagcucugccucccggguucacgccauucuccugccucagccuccugaguagcugggacuacaggcguccgucaccaugcccagcuaauuuuuuguauuuuuaguagagacgggguuucaccauguuagccaggauggucuugaucuccugaccucgugauccgcucgccuuggccucccaaagugcugggauuauaggcaugagccaccgcgcccggccaguuuuauauauugaaagaaucccuuuggcugcuuuguggaggauggaucguaggggaagaacugaagaagggaggaaauacuaaggcagggagggaugcaaguggcuuggaugaggguagcaguuguagagauggagagaaguggacagaugcaggauguuuggugguagaacugacaauaagaguuacugaugggaaggcagggugcauuggcucacgccuguaaucccaccacuuugggagguugaggcgggcggaucaugaggucaggaguuugagaccagccuggccaacaugaugaaaccccgucucuacuaaaaauacaaaaaaauuagcugagcgugguggugggcaccuguaaucccagcuacuugggaggcugaggcaggagaaucgcuugaaguugagggggagguugcagugagccgagaucacgccacugcacuccagaccaggcaacagggcgagacuccaucucaaaaaaaaaaaaaaaaaaaaaaagaguuacugaugggaauuaggaaauaaggcauuaagaacaguaauuguaggccaggcgcaguggcucacgccuguaaucccagcacuuugggaggccaaggcagguggaucaccugaggugaggaguuugagaccagccugaccaacauggagaaaccccaucucuacuaaauauacaaaaaaauuagcugggccugguggcgcauacccguaaucccagcuacuugggaggcugaggcaggagaaucgcuugaacccagaaggcggagauugcggugaggggagauuguaccacugaacuccagccugggcaacaagagcgaaacuccauuucaaaaaaaaaaaaaagaauaauuauaaauuuacugugugguaauuuaguuagaacuuacuauucuaaguguucuacuuauuuuaaggcauaugagucucagaagaacccaacuugcccgaggucacauaguuaauauaaauaacaaaguuguguuuuaacuagguuggcuccagagcagaugcucuuaaccacguuagguuuacugucucaggcuuucggcuugaagaacuggguagaugguguuggaguuuccuugaggggaauaccuugggaaaguguggccuugggggugggaggaaauuaggaguuccccuuugacaauguuagguuugaaaugccugugauacuuucaggagagacguuaaaaguggacuaagaaaguccaggacagggcggggcacgguggcuaaugccuguaaucccagcacuuugggaggccgaggcgggcggaucacgaggucaggagaucgcgaccauccuagcuaacacggcgaaaccccgucucuacuaaaaaauauauaaaauuagccgggcgugguggcgagcgucuguagucccagcuacucgggaggcugaggcaggagaauggcaugaacccgggaggcggagcuugcagugagccaagauggcgccacugcacuccagccugggcgacagagacuccgucucaaaaaaaaaaaaagaaaauccaggaccagcagggcgcgguggcucacgccuguaaucccagcacuuugggaggccaaggcaggcguaucacgaggucaagagaucgagaccauuguggccaacauggugaaaucccgucucuacuaaaaguacaaaaauuagcugggcgugguggcgcucgccuguagucccagcuacuugggaggcugagacaggagaauugcuugaacucgggaggcggaggucgcagugagccgagaucgugccacugcacuccagccuggcgacagaguaagacucugucucaaaaaaaaaaaaaaaaaaaagaguccaggaccaaguccggugguaggaggagccggcagaggagauuaagaaggaaaggcugggccagcgccguggcucaugguggcaggcgccuguagucccugccuguagcuacucgggaggcuguggcaggagaaucgcuugaacccaggagguggagguugcaguaagccgagaucgugccauugcacuccagucugggcaacagagcaagacuccgucuccaaaaaacgaauaaaaauaaaaaucaaaaagaaggaaaggcugaugagguagaggaaaaaacaaacaggaaaguauguggugucacagggccaaggagaaaaaaaaagcaucccaaguagagaguugucauuuauguugaauauguuacugggagguuuagaaagaugaggacauugaguaugauuugucugcauagaugucacugguggcuuuuacaauaauugcuuguguggacuggugggauagaagacugaauggagcagauuuugaagagugaaugcgaagagaaaaaauggaaagaugaucaacaacuuuuucagauuuuucugugaagugggguggagaugaggaaguaccugggaaggauauuggagccguuucucauagagaaccuucuccauaguacauuuuguuugugcaucuggagcuccuccagaaguuccuugggauaauuuaaauuuaguauucauggccuggcgugguaucucacaccuguaaucccagcacuuugggaggccuaggcaggcagaucaucugaggucaggaguuggagaccagccugaccaacauggugaaacccugucucuacugaaaauacaaaauuagcugggcaugguggcgcauuccucuaaucccagcuacucgggaggcugaggcaggagaauugcuugaacccaggaggcagagguugcagugagccgagaucaugccauugcacuccagccugggugacagagcgaaacaccguuucaaaaaaaaaaaaaaagaaaauuaguauuuauuuuaagaauaauaguaaagguaaguuaaaauuauugucuuaucuggaauaagugguuaacaguuaaacuguccaucuuagacucuaaaaucaucuauaaaguaaugugauuucccuuaaagauuuuuuuuuuuugagauggagucucccucuugcucaggcugcagugcaguggcgugaucucggcucacugcaacuuccacuucccggggucaaacgauucuccugccucagccucccaaguagcugagauuacagguguguaccaccacgccugguuaauuuuugaauuuuuagaggaacucugaccucaagugaugcaccugcccuggucucccaaagugcugggauuacaggugugagccaccgcgccuggccaucucuuaaauauuucuuaaugaaauuaaaaugcauuugauucuagucaaaauguauuaaagauuuacuaaauugaaauaugagaaacuuuuguguccuugcuuuguugaaaaugcucuuuuucggcugggcgcgguggcucacgccuguaaucccaguacuuugggaggcugaggcagguggaucaugaggucaagagaucgagaccaucuggcuaacauggugaaaccccgucucuacuaaaaauacaaaaaaaauuagccgggcaugguggcgggugccuguagucccagcuacccgggaggcugaggcaggagaauggcgugaacccgggagguggagguugcagugagcugagaucgcaccacugcacuccagccugggcuacaaagugagacuccgucucaaaaaaaaugcucuuuuucugcucuuaaauuugaaugccaaguuccagguccaaaauaacuuuuccucaaaaaaaaaaaaaauuuuuuuuuuugagauggagucucacucugucucuguuagaaagauggagugcaguggcacagucuccacucacuucagccuccaccucccaggcucaagcgauucucgugucucagucccgaguagcugggacuaaaagcaugcaccaccaugccuggcuaauuuuuguauuuuuaguagagaugggguuuccccauguuggccaggcuugucucgaacuccugaccucaagugauccuucuuccucagccucccaaaguucugggacuacaggugugagucaccgggcccagccagugugaaacuuugauacauuuguauaaaguguaaugauaaaaggaggauaauuagcugauuagcauaucuaucaccugaagcauuuaucauuucuuuguguugggaacaccaaaaaaauccucuuuucuaggccaggcgcggugacucacgccuguaaucccagcacuuugggaggccaaggcgggcggaucacaaggucaggagaucgagaccauccuggcugacacgggggucucaacuaaaaauacaaaaaaguagccagaugugguggugggggccuguagucccagcuacuugggaggcugaggcaggagaauggugugaaccugggaagcggagcuugcagugagcugagaguauagaccaguuuauacuaggaagugggauucucuucugcauauggccauucccuacaugcagucuuaaccccagugaggcagaauucacaguccuccucugaaugcacucuucaguuuccuucacuugaauguuuucuccauucccauuaggacuagccaaagucacaucucuuuuugagucaugccagccccaugucuuguccaugucauucauuugcagauagucauauuccccuuuggggcagaaaccauauuuuaguuaucucaaugcuuagggaaaaccuuguauguaguggauacucagaauauuuucuugugugaauuaaguaugcuuugcauuuguaucuaacucugaguaacucugaguccuccacccuccagaagcucacagcuuuagauuaucaccuuucuucuugaaaucauugugaacuccuagagauuggucugugccuuauuuuuccuguauccuuucaguaccccauauaguuuucucagucaggaggcacuuaguaaacaguaaagauuuuuagacugagggggcuagagugggggcgggcugcuggcugagguggugucucugcucugcaccccaaggaggccugucaggaggaggugggcuuuccccaacgcugcccucuugacccuuggagcucucccaggauuccucagauuuccccagcgccccuuuggcacugugucuccuccucuuugcccugccuucucccugucccaccaccaccuccucacccugucuaucccuccuccucuuugcucuggcuccuugccaccaggaucuuuuccuaacuuuuuucuuuccuaguagagacaaugggcugacaaccugacuuccaaaaaauauugaggaaaggcaaaaacuaguuuuuaggccagguguggugacucaagccuguaauuccagggcuuugggaggcugagguuggaggauugcuugaggccagguguaggacaccagccugggcaacauagccagacccaucccuacaaaaauuauguuucuaaagauugacucgccauaguggcaugucacuuccugacucgucccagcuacucaggaagcugaaaucggaggaugaccugagcucaggaggucgaggcuauagugagcaaugaucacaucacugcaccccaguuuggaugacagagugagacccugucuuaaaaacaagcaaaacaaaacaaaaccaaaaccaaaaacaacuaguuaccagauucugaaugccuaacauacaagcauacaagguggcaggaugaguacauaaagucgcaaaaaguacucaagugccuauuaaaugaaaagcaaacauaccaggaaaaacuucagcuccugcuugaagaacuaagaggggaauuaguagaaaagcuaaggacuuagaagaaaugaagcugcagguaauuaacuccaaaaaaaaaaaaaaaggggaauuguuaaaagcccaaauacagcaagaauuagaaacuccaguguuuuugcaauugggaugaagaaguggaaaaguauagagcugcaagcuuugcuauaaacauacauuucuuaaauagaaucugaaacacuaggaagaagaauuuacauguaguuuagaaaaaaacucuaaaauuugaauuagagauuuauuuuuauuuuuacuuauuuauauauuuuucaagacagggucuugcucucgccugggcuggagugcaguggugcuaucuuggcucacugcagccuuaaggcucaagugagacucuugacucagccucccgaguggcugggacuacaggugugcauuaccacagcugguuaauuuuuuuuuuugagucggagucucgcucugucgcccaggcuggagugcaguggcgcagucucggcucacuguaaccuucgccuccuggguucacgccauucuccugccgcagccucccgaguagcugggacuacaggcgccugccaccacgccuggcuaauuuuuuuauauuuuuaguagagacaggguuucaccauguuagccaggauggucucgaucuccugaccucgugauccgcccgccucggccucucaaagugcugggauuacaggugugagacacugugccuggccccacagcuggcuaauuuuuaaauuucuuuauacagacaggaucucacuauguuguccaggcugguuucgaacuccuaaccucaagugaugcuccugccuuggccucccaaagugcugagauuacaggcaugagccagugcaccuggccugaauuauagauugcaagacuggggaaagauguagaacuauauaaccagcugcuuaguguugaucccacaagaggcaacaaaugaguagaggaacuuguuugagaaaaaguccauuuguuucagaaauuaaaauaauucauaggcuggcugggcacagugguucacgccuguacucccagcacuuugggaggccgaggugggcagaucgccugaggucaggaguuugagacuagccuggccaacauggcaaaccccuggguggggggaggggggcggcggagguugcagugagcugagaucgugccauugcacuccagccugggcaacagagcgagagucugucucaaaaaauauauauauauucauucagaggcugaaguagcagauuuaacggcugaaaaagagaauucuggugcucaguuagaaaacguccuaagaauacaggugugacaguuggcugagaugcaguuacagucaggucccaguaggccaaaaaugucacguaaacuguagguuaaaugcucggaaaaagagccacaaucaaacaaugaacaaaauaccuguuuuguuuguuuguuuguuuguuuuuuucagacagaguuucacuccugucgcccaggcuggagugcaguggcgugaucucagcucacuggaaccuccgccucccagguucaagcgauucuccugccucagccucuugaguagcugggauuacaggcaugcgccaucaugcccagcuaauuuuuuuuuuuuuuuuuugagauggaguuuugcccuugucgugcaggcugaaguacaauggugugaucucggcucaccgcaaccuccgccucccgaguucaagcgauucuccugccucagccucccagguaguugggacuacaggccugugccaccacgccccuggcuaauuuuguauuuuuaguagagacgggguuucuccauauuggucaggcuggucuugaacucccgaccucaggugagccaccgcgcccggccaagcccagcuaauuuuuguguuuuuaguagagacaggguuucgccauguuggucaggcuggccucaaacugcugaccuugggugauccacccgccuuggccuuccaaaguucuaggagccacugcgccuggccaaaguaccuuuuuaaucauuaaagauuacauaaaacugaacaagaaagaaauacccugaccaggcugggagugguggcgguggcucacgccuguaaucccagcacuuugggaggcugagguaggugaaucauuugaggucaggagucgagccccaccugaccaauauggugaaaccccgugucuacuaaaaauacaaaaaugagccaggcgugauggugugcaccuguaaucccagcuacuugggaggcugaggcaggaggauugcuugaacccaggagacagagguugcagugagccgagauagcgucacugcacuccagccugggugauggagcaagacuccaucuuaaaaaaagaaagagggccgggcgcaguggcuugagccuguaaucccagcacuuugggaggccgaggcgggcagaucacaaggucaggagaucgagaccauccuggcuaacacggugaaaccccaucucuacuaaaaauacaaaaaauuagccgggcgugguggugggcgccuguagucccagcuacuugggaggcugaggcaggagaagggcgugaacccgggaggcagagcuuucagugagccaagaucgcaccacugcacuccagccugggugacagagcaagacuccgucucaaaaaaauaaaaauaaaaauaaaaaaagagaaagaaagaaauacacugagcacuaaagucaaagaacgaaacuuucaagcauacuagaaauaacagccaugaaacuagaggcagcaagagugagcuagaaagggaaaggaaaaagauucaaagugaacuggaugguuuacugucagacaaugaaauucugagaccagcuauugaacaccacaaagugcccuuaguaaaaaaagaucauauauuaauauguaaggcaccagaugccaaggaagaagguuguaaaagacuucuggcauuacaggaugaaaagcuagaauuugaaaacaaguuagcagauagaaaaugaaaguggaucaugaugucugcaagcaaugugaaaagcaucagugugaaaagaaauugugggaggccgggcacgguggcucacaccuguaaucccagcacuuugggaggcugaggcagguggaucacgaggucaggaacucgagaccagccugaccaacguggugaaaccccauuucuacuaaaaauacaagaauuagcggugugugguggcgggugcccguaauccuggcuacuugggaggcugaggcaggagaauugcuugaacucgggaggcagagguugcagugagacgagaucgcgccacugcacuccagccuggguguacagcgagacucugucucuaaaaaaaaaaaagaaaagaaagaaagaaaaugcagaggaagaaaaaaacgaaaauuuugaccuggaauaguaaaucaguaguuuucagauccaaguuaccucacuugcagaguucgaaccgaaugcugaaagaaacgauggagacauuaaaacaggaaugcugaaauauaagaaaucaagcugagaaagucuaacuagaagucaaaaagacauuggaaaaagaacagacacagcaguuagaagaaaagcauaugcuucaugaauguaucucagggaaauguacagucaagcuaaagagaaauugcagugagcugcaguugcccagaaaaacaggaaaucuugccgugaaaacaauugaagagauggcaggacaagguguaaaucuuggaggcagguagagaagaaauggaaacagaaaauuggguuuuaaauagacaaaauguuccauuugaagaauguacaaagcuucagaaaagacuaaaggauacacacagaagacauaaugaauuuugaaguuuaauuuugguuccuaacaugccuccaaaaucaauccuguuugcucucagucaucagccaugguauuauccuuuccuccucaugugcacgaugaacagcaucaaagggaacucuguacuuggcaaaagacuagaggaacuagaaacaacacaaagaaaacaaauagaggaauuuggaucuccuggagagugauguucuuagagaaaaggcauuuuaaaagaggugaaaucaaagacucaauaaagcuugaaguuuuaacauacaugguauuuagauauuuuauuacugcuuaccaaaauacucgaaugugccucaagaaaagguaccagcuuuauuuaagggacucgugcuguauugcaugaguacuaggauuuuaggauuuucuaaugacaagugaagcauuaaaagaaaccauuucagagauauuuagaauauuuauugaccacccuuugaaaauguaaaaaaaauaaaaggaacuaauuggaaagagauuuauugaaugacugaauuauaauggaagggacuaacccaugugauuguaauuuuaggugccuguggcauuugaugaugucuccaucuacuuuuccacuccagagugggaaaaauuagaagaauggcaaaaggaacuuuacaagaauaucaugaagggcaacuacgagucucucaucuccaugggugaggcugaguugacaccuuuugaaugaagugacagcagcuccaagagggcucagaacagucccuuuuccuccagugaccucauucucacucugucuucacacacuucaaauucugguuucaagccaaaauaugaccaauuaaugcuugcuaacuaggaaucauaaucucucuuuuuaccaaauuguaggacagagaaugaaguucaggguuaugggugugacagcuggugguuuccauggguauccuucacuuggaaaggagcuugacuucucccccuugaggcacacugucacucugaaagcagugcuaaccuagcacaugugcuuuccccacacauuacaucuccacugccugcuuuccugaauagauauccacagcugaagauggauagaugggaagaagugauaugaaaucuaaaagaaauucccuggcacugugaccacaaagcuucagcucagccuugauggcaauuaguugucauccucauuuaucucuuuguaauacucucucuuccuuuuuccucuccuagauuaugcuauaaaucaaccugaugucuuaucucagauucaaccagaaggggaacauaauacagaggaccaggcagggccagaggaaagugagauucccacagaccccagugaagguaagugggagaagagauuccuacuucuugucucccuuuccuggucagacaugguggcucagagcuaagcagggcuuaggggcuucuagagccauucauugcuaaagcaacuagauuuugaaugugucaucaggcauuuaaauauaaaagggagcuuagaggucaccuuguccagugucuucaccuaucaguacuacacaccuaacaguuacaaguugcauuuccugacagaaguacugacaccuagcuguuuaauaaaauaaacauguccuuacaugaugaaggaggcagucaugcucaucuggacuaaauuggcuugagcaaauauaagcauggcccuucauaagugcugaagggacuaggagucugcauggucccucuaagaugcauggaaccaguagacacugaugacauccaccugggcaacauggauuuucucaggucugggaagcuggcuaucaugaacucuuccuaacuuuuugguuggcagcugcuuaacauugugugggaaagacugccaaccaaaguccaguuuuauuguuucucucaugccucaccuugcugucagaaaauucucauacacuuuuuuguucuuugauggauagaagcacacagaaaguugauccuccgggcaucucuauuauaugaacuucucuuacaacccacccgcuaucccauauaguuauuuuuuucuuuuucuuuucuuuuuuuuuuuuuuuuuugagacggagucuugcucaugcgaucucgacucacugcaagcuccgucuccuggguucacgccacucuccugccucagguucccaaguagcugggacuacaggcgcccgccaccacguccggauaauuuuuucuauuuuuuaguagagaugggguuucaccauguuagcaaggauggucuugaucuccugaccucgugauccacccgccucggccucccaaagugcugggauuacaggccugagccaccgccacauuuauuuuuuucuaacauuuuauuaugaaaauuuucaaucagaaaaguuaaaauauuuuuauagugaacaccuggauauccagcgccuaaauucugccacuaacauuauaccauccuuccuuaucaugcauauaucuaucacugcaucacuccauccagccauccgucuauuauuuauuuauuuauuuuggagauggagucucacucugucgcccaggcuggaaugcaguggugcgaucuuggcucacugcaaccuccaccuccuggauuaaagugauucucuggcucagccuccugaguagcugggauuacaggugcccaccaccacgccuggcuaauuuuuguauuuuuaguagagacaggguuucagcauguuggccagacuggucucgaacuccugaccucaagugaucugccugccuuggccuaccaaagugcugggauuacaggcaugagccaccgcacccagccaucuauccuauuuuugauguauuucaaaaucagugaagacaucaaugcauuuuccuguaaauaguucagcaugaauauuauuaaccuagaguucaauauuuguuuuuuucuuuucagguaaauuuuacauauaaugaaauuucaagucuuaauugaguuuuaagcaauguacacaucugccucacauuuauuauuauuauuauuauuuugagauggagucucacucugucgcccaggcuagagugcaguggcgugauccuggcucacugcaaccuccgccuuccaggcucaagugauucuccagccucagccuccugaguagcugggauuccacgcccggcuaauuuuuguguuuuuaguagagaugggguuucaccauguuggccaggcuggucuuaaacuccugacuucaagugauccacccgccuuggcuucccaaagugcugggauuacaggagugagccaccacgcccggccauauuauuuuuuaagaauguguaggugauugcauuuagucaguguaacacguugcauuuuacuaaucuuuauaucacagauauaaguaaugaggcuaaaauaauaccaccaauaaagaugagugacuugacuacagaaagauuucuuauuggguauauuucuuuggucuacauuauuaguuaucugucauagaccucagcaaguacaaaugaauauaucauuguauuuuaugggaugggugaaaaagauaacaaguaauuagguuuugugauaacguaucaaaguuucauuuugcuguuaucuugucaguuuguuuuuaccauggguuuucaagaugcucaugccucaacccccugaguagcugggacuauaggcaugugccaccaugcccagcuaauuuuuguauuuuuaguaacgaugggguuuugccauguuggccaggccggucuugaacuccugaccucaggugacccacccaccucggccuccuaaauugcugggauuacaggcaugagccaccgugccuggccuguuauuuucuguugguugaucaaauugucagcuucacaauuucuuucguuuguuuguuuguuuuuaagacaaggucuggcucuauugcccaggcuagagugcagugccaugaucagagugcagugccaugaucugagaucagugcagccugugccuccugggcccaagccauccucccaucgcagccucccaaguagcugggacuacaggcacacaccaccaugccuggcuaauuuuuguauuuucuguggagauggggguuugccauguugcccgggcugguuuugaacucgugaacucaagugauucaccugcuucggccuuccaaggugcuaggguuacaggccugagccaccacacccaaccucaguacuuguuuucuuaaaaaaaaauaugcuccuggcucuguuggagggcccaaagaccacucccagauuucgugaucugcuaggaggacucacaggauucccauaugguuguacucacagcaagauuuguuagaaugauacaaaguaauaucagcaaagggaaaagguaccugggacaaagucugcaggaaaccagggacaggcuucccagaguccucucccaguggagucuuauaggauaugcuuaauuguuccaguaaugaguuguaacaaccagaaaagcucauuagagacucagugcccaagguuuuuauugggggcuaaucacaugcauacccucugucuagcacuuacccaaauuccagacucauagaaggaaagcacguguucugcauauaccacacuguuugacaaacacaaucaugcgcugcugaacaauggggauaucuucugagaaaugcaucauuaguugauuuugucauugugcagacaucacagcgugaacucacacaaacuagaugauguagcuuucuauguaccuaggcuauauaguauagccuauugcuucuaggcuacaaacuuguacagcauauuauuguccugaauacuguaggccauuguaacacaaugguaauuguguuuguaaacacauguaaagauaggaaagguacagcaaaaaucugguguaaaagauacaaaaugagcugggcacaguggcucaugccuauaaucccagcacuuugaggccaaggcggguggaucaugaggucaggagauagagaccauucuggcugacacggugaaacccugucucuacuaaaaauccaaaaaauuagccagccaugguggugggcgccuguagucccagcuacucgggaggccaaggcaggagaauugcuugaacccaggaugcggagguugcagugagccgagauuacaccacugcacuccagccugggcaacagagcgagacuccaucucaaaaaaaaaaauacaaaaugguacaucucuauagggcacuugccaugaauggagcuugcaggacuggaaguuguucucacugagucagugagugaaugugaaggccuaggacauuacuaggcuguagacuuuauaaacacuguauacuuaggccacacuaaauuuauagaaacauuuuuucuuuuuuuuuuuugagccuccuggguucaagugauucuccugccucagccuccugaguagcugggacugcaggcacgugccaccacgcccggcuaauuuuuuuuuuuuuuuuuuuagaagagaugggguuucaccauguuaaccaggauggucucgaucugcugaccucaugauccaccuaccuuggccucccgaagugcugggauuauaggcaugagccaccgcgccuggccaagaaauuuuuucuuuaaccauaaauuaaccuuagcuuacuguauuacuuuauaauacaguaauauacuuauaauacuacuuuauaauauaguaauauacuuuuauuauuuuauaacuuucugacuuuuguaauaacacuuaguguaaaacauauuguacauauauacaaaaauauuuuuucuuuauacccuuuuucuauaacuuuuuccuauuuuuaaauuuuuuuacuuauuuuuuugaaaugaagucuugcccugucgcccaggcuggauugcaguggcgcagucuccgcucacugcaacuucugccuccuggguucaagugauucuccugccucagccuccccaguagcugggaucacaggcaugcugcgcccccacgcccggcuaauuuuugcauuuuuauuagagacgagguuucaccauguuggccaggcuggucucaaauuccugaccucaugauccacccgccucugaccucaugauccaccugccucggccucccaaagugcugggauuuacuuuuuauuauuuauuuauuuugagauggaaucuugcucuguagcccaggcuggagugcaguggugugaucuuggcucacugcaaccuccgccucccagguucaagugauucuccugccucagccucccaaauagccuguaggcucaaaccaccacaccuggcuaauuuuuuuauuuuuuuauagagaugggguauagccauguugcccaguguggucucaaacaccuggacuuaagugaucugccugccuuggccuuccaaagugcuaggauuacagaugugagccaccaugcucgacaguggccuguuuuugaccaaaacaccauuaugcagugcaugacuccaugugucuugcucaaaacuguccuuauauucagcacaaauauaaaccuuuguacuacuauacaaauguuacaugguacgugacugcaguuagguacagccaaccacucaucauuuaggggaaguuuuguaucagcauagagacuacauacaguagucccccuuuauugaugguaucguuuuccacaguuuguuaccugccgucaacugugaucugaaaauauuaaauggaaaauuccagaaauaauuuauaaguuuuaaguuugccauucugaguaguaugaugaaaucuugcacuauccugcccugucucaucuggggcgugaaucaucccuuuguccagugcauccacacuguauacgcuaccuggccauuagucacuuagaagcuaugucaacuguggcaguauugcagugcuuauguuaaguaccccgcgcucccccccuuuuuaaaaauaaauaauugccccaaacugcaaaaguaguaaugguggcaauucagauguaucagagaagccgucaagugcuuccuuuaugugaaaaggugaaauuucuugacuuaauaaggaaggaaggaaguuacaugcugagguugccaagaucucugguaagaacaaaucuucuaucugugaaacugugaagaaaguaaaagaaauuuguacuagugcuacuguugcaccucaaacugcaaaaguuacggccacagugugugauaaauacuuaguuaauauggaaacagcauuaaaggcaaguacaggcaucuccaggauauuguggguucaguuccagacuacugcaauaaagugaauaucacaguacaaguaacaauaacuuuuguuuucccagugcaugugaaaguuaaguuuacacuaugcuauacagucuauuaaguuggcaauaaauuaugucuaaaaaaacaauguacauaccuuaauuuaaaaauauugcuaagaauccuaacaaucaucugaaccuucagagucauaaucuuuuugcuaguggcgggucuugccucaguauugauggcugcugacuaauccggguggugguugcuaaagguugggguggcuguggcaauuucuauuuuuuuuuuuuuuuuuuuuuuuuuuuuugagacagaguccugcucugucgcccagacuggggugcaguggcacgaucucggcucacugcaaccuccgacuccuagguucaagcaauucucuugccccggccuccugaguagcugggauuacaggcgccuaccaccaugccuggcucauuuuuuuguauuuuuaguagagacgggguuucgccauguuggccagguugaucucgaacucccgaccucaggugauccacccgucucggccucccaaaguucugggauuacaagcgugagccaccaugccuggcugaaauauguuuauuuauuuuuuugagacagagucuagcugugucacccaggcuggagugcauugaugcugaaauaaauuucuuaugcaauaagacuucaaaguaaaaauuacuccuugaucugcggggcuguagaauggauguuguuuuacagggaugaaaacaacacucaucuccuuguucauccccaucagagcuugugggugaccaggugcguugucaaugagcacuaguauuuugaaaggaauuuuuucuucugagcaguaguucugaacagugggcuuaaaauauucuguaaaccgugcuguaacagaugugcugucauccaggcuuuguuguuccauuucuagugcacaggcaguguagauuuagcauaauucuuuuuuuuuuuuuuuuuuuuuuuuugagacacaguuuggcucuuguugcccaggcaggagugcaauggcgcuaucucggcucaccgcaaccuccgccuccuggguucaagcgauucuccugccucagccuccugggcagcuaggaaauacaggcaugcaccaccacgcccagcuaauuuuguauuuuuaguagagacaggguuucuccauguuggucagacuggucucaaacuccugaccucaggugauccgcccgccuuggccucccaaagugcuaggauuacaggcgugacccaccaugcccggccugauguagcauaauucuuaagagcccuaggguuuucagaauacuaaaaugaacaccggguucaagucaccagcugcaucagccuguaacaagagagucagcuuguccuuugaagccagacauugacuucucucuaguuaugaaagucccagaugacauauucuuccaauagaaaguuguuucucauacaugaaaauuuguuguuuaguguagcccccuuccucaaguaauuguagcuaggcgcgugccaccacagccaacuaauuuuuguauuuuuaguagagacaggguuuuaccauguuggucaggguggucuugaacuccugaccucgugaccugcccaccucagccucccaaagugcugggauuaugagcgugagccacugugcccagcccauucagaaaauuuuuaaaaacaagcagguaaguguuuuaaaagucagguuuuuuggcuaggcauggugggucaugccuauaaucccagcacuuugggagguugaggcaggugggucaccugagcucaggaguugaagaacagccuaagcaacauagugagaccccaucuuuaccaaaaauacaaaaaauuagcugggcaugguggcacacaccuguggucccagcuacuagggagaccgagguggaauaauagcuugagccugggaggcagagauugcaguaagccaagauuacgccacuguaguccagccugggugauagagugagacccugucucaaaaacaaacaaacaaacaaaagucagauguuuugaauggaaaguuaauccucuggauaucgguucagagguuuucuuccuuauauccagucuuucccccccucugccuuuuuccuuauagauauguauguguauaacaucuggaagagaacaaagauaagauuggacuauguuuaauacacuucagcuuuucuuuuaggucagaacaggagguuggcaaggcaacuguugcauaugcuaaaaucuauuucccaaaucgcuccccauaaccgauggucguuugggcuuucgucuuaccccagccucuuauuucugcuuugagaacaccuuuagauuucaguggcgucuaacugauuuagaagacauuggguaaaguagucaguucuguuaauuugcugugaauuaaaccauauucugcccacaaggcuguguuugagaaauaacuauagagagcuucaggggacucucuggagcuugacaagcucucuugucagcuugccaacuuguccauuuaguccaaaaaaaaaaaaauaauaaagccauauaggccuagguuguaauagcuagcacagcuguuuugguacugaucagaugaggcauguugugugcaaagccgauauuggcugugcacuuuuucuuucagaaagaacccccaagaccugaaggacuugccaauacuauauucuucccccucccagcauuuaggaaacaaugacuuguaucauuuaauagacaaagauaauauaucucauagaaagagcccagaauugggaaucugaaaaguguguuucuagggaguuggauucugugucuauacugaacuaacuuuguaauucuggaaguugauuuguuuuuuguuuguuuguuuguuuugaaauggaguuuuuuugcucuuguugcccaggcuggagugcaauggugcgaucucggcucacugcagccgcugccucccagguucaagcaauucucuugccucagucuccugaguagcugggauuacaggcgccugccaccacgccugacuaauuuuuuuuauuuuuaguagagacaggguuuugccacguuggucaggcucaucuugaacucuugaccucaaaugauccacuugccucggccucccaaaguucugggcuuacacgcgugaguuaccacacccauccuguaugcauuuuuuaaaaggcugguucuguguuauuguuauaguuauuuagaaauaaauauuuggggccgggcgcgguggcucaagccuguaaucccagcacuuugggaggccaaggugggcggaucaugaggucaggagaucgagaccauccuggcuaacacggugaaaccccaucucuacuaaaaacaaaaaaauuuaaaaaaaacuuagcugggcgugguggcaggcgccuguagucccagcuacucgggaggcugaggcagcggggagaauggcuugaaccugggaggcggagcuugcagugagccaucgugccacugcacuccagccugggugacagagcgagacucugucucaaaaaaagaaaaaaagaaaggaaaaauauuuggggcaaaauauaguguucagcaaaccaacuugauuaucuuaccuucuuauucaaguucaugaaggccauuuuuuuuuccucccacaaauuagagccugguauuucaacaucagauauucugucuuggauuaaacaagaagaagagccucagguuggggccccaccggaguccaaggagagugacguguacaaaagcacuuaugcuggugaguaugaaauuaaagagguguucauguccauauccagcucaugccaggacugacugaagaaacagcaggugaaauuuguagaggcaaauaugugggagaagaaugagggaaagaaaaagccaugcucaacauuaugaaugaaaccaaacagucacuaagauaaauuugaagugagugagaaaauacacucuuacaugcaaagacaaaugagaauugucagaagaagaaaaacaagugcauacagacgaaccaaaauuauggggauggggaaagacagaagacgauuugaaaaucauguagaaaggguagaaaacgugggagugggguggggagacaagcccuggagacagaaauggccauggagagguguaaaugggaauguuaauuaagagcccucccucagugaaaggaaaaucaaugaugggagaagaaauauaaguaucuuccuucuaagauacuuuugccauuuguauuguagaagagaaucucaagaucagaagggucccagucauuuauacagcuuaaugcauucuguuuuuuuuuuaguauuuucugugcucuguguucuuuuagacugggaaacacaaaugaaacauaagauaguuuuagcucuugaaaaaacuuaugcuagggacauacauaucaguacuaggcaagccuguuaagugucaaggaugagugggguggacgacuuauauaaaugaaugagaaguuucaggaacaugcaucagguuuggcuuggugacucgugccuguaagcccagcauuuugggaggagguugaggcagguggaucacucgagcccaggaguucaagaccagccuggguaacauagggagacccugucucuaaaaaaaaggaaaauaugcaucaguuuuaguuuagguauuuagauaagaccuaaagaagggcauaaagccacaauuguaccuuaaaagauugguaugauauggcuggguauaauuuggaaagauggggagagagggguagcauucuacaaaagggaggacagaguaagucaagaugcauagcagaaauguauacucuguucucaggggaaguaaagagacagcugaccacagugauggguugaucugauagaauacagagaaauaggaauagauaauuaugugauuuuaggcuuugucacaacaggcaauagagaaaguucuugaguagagguaaaauauagugaaaguaacguugggaagauugaugccaaggauuuucuguuucuuaacagauagcauagaagagguacaguguuaaauuuucugaugagggcugggugugguggcucaugccuguaaucccagcacuuugggaggcugaggcagguggauuacuugacaccaggaguucgagaccccuggucaauauggcaaaaccccaucucuacuaaaaauauaaaaauuaccugagcacagcuggacgcgguggcucaugccuguaaucccagcacuuugggaggccgagguggguggaccaugaggucaggagaucgagaccauccuggcuaacacagugaaacccugucucuacuaaaaagacaaaaaaauuaguugggcguaguggcgggugccuguagucccagcuacucgggaggcugaggcaggagaauggcgugaacccgggaggcggagcuugcauugagccgaguuugugccacugcacuccagccugggcgacagagcgagacuccgucucaaaaaaaaaaaauuaccugagcacgguagugcaugccuguaaucccagcuacucaggaggcuaaggcaggagaaucacuugaacccagguaguggaggcugcagugagcugaggucacgccacuguacuccaucgugggcaacagaaugugauccugucauaaaauaaauuuaaagugucauuucauuucucugaugauuugccacagagaccacagaugucucgguuauuauugcagccuucugcuguauuucugaucugagcuucgagugaucuguuagagcuggguaggaaugcaugagaguugcuagugagacaguuauugauggguauaacucuggagucuuuucuuucagaugaagagcuugucaucaaagcugaaggccuugcuagauccucguugugcccugagguuccagucccuuucucuucuccaccagcagcagcaaaggaugcuuuuucagauguggcuuucaaaagccagcagucuacauccaugacaccuuuuggacguccagccacugaccugccugaagccucugagggacaagugacuuuuacucaguuggguagcuauccccucccaccuccaguuggcgagcagguguucucaugccaccacuguggcaagaaucucagccaagacauguugcugacccaccaauguagccaugcuacugagcaccccuuacccugugcccagugcccuaagcacuuuacuccacaggcggaccucagcagcaccucccaggaccaugccagcgagacaccccccaccugcccacacugugccaggacuuuuacucacccaucaagacuuaccuaccaucuucggguccauaacagcacugagcguccuuuccccuguccugauugccccaagcgcuuugcugaccaggcucgacucaccagccaccggagagcucaugcaagcgaaaggcccuuccgcugugcccagugcggcaggagcuucagcuugaaaaucagccuccugcuccaccagcggggucaugcacaagagcgcccuuucuccugcccucaguguggcauugacuucaacggccacucggcccugauccgccaccagaugauccacacaggcgagcguccuuaccccugcacugacugcaguaagagcuucaugcgcaaggagcaccugcugaaccaccggcggcugcacacaggcgagcggcccuucaguuguccucacuguggcaagagcuucauccgcaagcaccaccuaaugaaacaccagcgcauccacaccggggagcggcccuaccccugcuccuacuguggcaggagcuuccgcuacaaacagacacucaaggaccaccuccguucaggccacaauggaggcugugggggugauagugacccaucaggucagccacccaacccaccagguccccucauaacugggcuugaaacuucuggccugggugucaacacugaaggucuagagaccaaccagugguauggggaagggaguggagggggaguuuuguaaauccaaaucucuguggcuucaugcuuguauaugcucacagcagggcacaaaauccaagagaaggucugugagccccauccaacacccacaguaauuauuaucuggcacaucaaugaauuugggguccuauacacuugacuagagacaugcuuguguuuuggaauuucacacccuuacaagaauaccacauuuugaaacccagaaagaccuggaaaggagcccagcauguccaucuuuucaaagauacaacaaaagcagaaguuacaagaauauugcggagagguuggaaagcaggauuuaaccucuaguucucuuguucucagagaacagcagguugauaguagauuaugucucuagguagagacagauacaugagaagagccuccaaaacuggaagcccaucauaaggcaugagaauguuuaacuauaaagccuuuuauuaguucuuugauagcuaagaugguuguuggagaaagugcuuaagccacuguuuauguugcugccuccucucucaaaaccagccaagaucuguucacacaccucuguggcugucuuucccugaaacaugguaacucaagacugccugccuagguuucuuagauuaauuauucacauaaauuuuguuuaauauugguugaacaagaaaucugacuuuaaaagauuauuaaggagaauauuccuuaacuauacuggcuugauuugaaacaggcucuuauugccauuuaaacugccagaaaucuuugccaagguccugguuaaaaaaauuggaaacgguuuucuuagccccagcuuuaaaagcuagagaucucagagaaauagcuggcuuaacaaugacagaacagcuuaaaauuugugccuacaccauguucugagagucguucacaucaaauucuuaucuuuuccaagccaguaaguuggcuucuccauuccuggugucugauauucuugacaaucaucagcaacaaagaucacagcacuuuccagaagcauggagcuucagaaagugccagugaacucuugguccucaguagugagaugauaacaguguuauaaugcagcuuccuugagccaucagagagaguguauguucacccuaucuggcuguaucccauuggcaguggacagauugaggaaauuccuagaucacugagagcuaagcaccaugcauagacaacaguuuguucuugccuguguugcuuuuagggacuuugacuaccacauguucuuuucuuggggugauuuaaucaccugggagcaucugagucugcuccuaaguggcuuugcaacugggccuaaguucuguuuccuuuauggaucucaaauuuucaucugcacaaugaggcuguugaaaggaaaaaaagugagccucuaggaauuauucaaaaaaagucugugauacauuccuuuuccugccaaaguucugucucugucuuuggcuucuguccaggcaaagcuaaauaagacagcaaagucaaagcagauaaauucuuguugaaacuugacuaaaauuuauuugauuuguuguuuuacucccacuuggaauccugagguagaagacagaaugcagaagucuuacaucuugggcaggaaacugguuuauuccuauacucuuguuuccucugcuucuuccugaggucuagaacaaggucuggaaauguuuagacaggauauuuucuugaugaagugauaaggaaaggacccauuuuuuugcucaucaccuagcccauccuucacucucucuaguuaugcauaacaacacuagaagaagguguuagcccagcuaacuuugcuucugggaaggcuaugucugaacauguugcucuguaggauaaucacacuuagaaaacaucugcuccaugacauucacaauaccagggaccaugggagacacaagaaaugugugucugcugucauaacuuacagugaaaaagcccaauaauacagaacaagacaugaugggcaauacccuagcauauugggauuaagagcuuucuagccagaaucuggaccuauaccaugggaaaauuuaggggugcugggaaucccaaagccaagguucuggcuucauuggcaacccacuaggaacuugaaugugagauucagcucuaguuugcaccuugauuuccccagugaaaagggagaagagccaaaguauugucuaggugcugaguucccuuuucugaguggauuucaagcauuugccaggguaugcuggaggagggacuccuaaaguaggugagaugugggacuagguaacacuuuaaauacuuuuuuacucaaagauuugccaagaacacagcuuauuagugaaagagaccuguggauugaaauggcugcagauagaucccgcagucccuucugaaaggaacuguguagccagcagggaccuaaacuuuggcaaaaagugaacacaauucaaauacgaaugaaggaagagcccucagauggaacgaaaggcgaugugcaaggccaucccagagagacggaagcaggugcgauacuaagccucagcccaagaauaaaagagaguucaacuguuacucuuuucuuucaucaauccccuaucaguuagaacugcaggccaguuccaaagaguguuugcuuaagauucaaaaguggguaaguaaaauggaucagugggaaggauaagguguccaacagaaaguguggaggagaaacucuuggccuaucaagugcuccugagagaaaccaugcaauuuaacacuucaguuaaagaaauacaugagaacugcuugucaugaccagacaagauaggaaaggggaaaccccagaaacgugcucuucaucugucagccuuuuggaccaagaagcugucacuaucacacauaagcaccauucccuuagaguggauccagguguugacuauaaccagauuuacucuuugcuuacuagguuuuccauugucaccauuggaugaaccucugguuuagccacaguugugaaaauaaauggaaguugguugauugucuagaaagugcaagaagauggcccugcuccuuuucugcugaacauuuaguauuggaaacuccuacuucccuuuucauuaauaaugugugcaaguuuccuauuagcggggaagguguggggcucugcugggcuucucuugagcauaucugagaagugauguucaugucuaucucaaccaggaccagacccugugacuuacucgguaauaacaguccacacaagccucguugauauuaa

SEQ ID NO: 191609 - RNA, 30763 nt, Homo sapiens
ccuacgggcuguagauggagcuguccggccccggagagggggaaggcgccuggaaaacguucuucuucucccuggccgacccgagcggggaacagcacucccaggaugcaguuugugucaacacggccgcagccucagcagcugggcauccagggccuggggcuggacagcgggagcuggagcugggcccaggcucugcccccggaggaggucugccaccaggagccggcgcugcgcggggaaauggccgagggaaugccgcccaugcaggugggagaaccccgccggcgccauggccgcgcugccgugggggcggggcgcgggcugggccgcgggaccgggccgcgccguccuccgguagccuugcggcgcccucccagcuuccgcgcccaggcgaggcccgaggcgggcggggcacggccgggcugcgcggcgggcaggacggagcgggcccgacgcaggcccggaagggcaggccuggcccgcgcggcgcggagcagcggucgccgggcccaagugcggaggccccgcggggcgggggccgggaccguccuuuccgggaccuggcagagcucugacccuguggcugagccccggcuuggggcucccuuugcgcccggccggcggagagcuucgcgggcagugcuuccgcccggccgcagaagugaaugccucguucguguuuacacgguggccaauuugacggggauauuuuuuaaauguuugauuaccaccuuucaccaaguguaaugaguaauucacucucccccugcaccgggugugauccagggagggggccauggagagaugacuucggggucuuuccugcgguugacaaacuuggccgcauguuggaauggccugggcagcuuuuaagacuccugagcccuugccuggucccagagcucagggucucugacgggugagaguagcaccaggcauuucuucaggcuccaucgaugaucuccgugggcagaaccggugcuccagaauuggguauaaaaccaggggagguggauccucagagaggccugaaagcuugcccagggaagacucucugggcccacccuggggcugggcugcucaggggccccucugcucaccacgcggcucucagccaggugcuaacgagggagccaggggcugcuguguuguguuugaucauuuucaggguuagggcuucaaacccgagaaaacuaaacugggccccgggacuuucuuaacuucuacuguggacucuguccccuucugugggcuagggcggaguggagccucugugauggaggaaugggugcuuuugauggaaacaccagcaccucuuacugguauuacagggccuggcgauccuagggcccugcucuccacucugcugugucccggagcaggucugccccggagcagggcugcucuugagucagagaguggggcuggucugcccagaucgccccaagcagcaggccuccccuuuuccuagccugagggccuuuucugcagccaucgggaggacagaaaaugacaccucuuccugucccaggugugaaggagagucggcugccagcccaugugguccagugagcccugagucugacaccaggucccagaugaccagugaacugucaccagccucaaccagccccccuuagccauaggucucagcucucaauugcaccaauuaguuuacccuucuggggugagggcucugugcuggaagauaaaagggggaguccccaggccauggggcaccccuuccccaggaagcaaggaggggucccagaggaguuuuucuuucucuugguccucuugggugugagggacauccccucuucaccucuaaugagugaccuuuuuuagugaaccuauuuucaauuuggaaaauguuuaugaaacaguaguuguauauggggggaagcugcuuuucugcccuagcuugggcucuccggucuuuuccuugacugcagcccugguaggaaugugguggguuuuuuuguuguuuauuuguuuguuccgagacggagucuugcucuguugcccaggcuggagugcaguggcaccaucucggcucacugcaaccuccgcuucccagguucaagcgauucuccugccucagccucccaaguagcugggauuacaggagcccaccaccacacccggcuaauuuuuguguuuuuaguagagacaggguuucgccauguuggccaggcuggucuugaacuccugaccucaagugagcugccugccuuggccucccaaagugcugggaaggugugagccacugcaccuggccaggaauguguuuuuuguuaccugcagcaucuagagcugccccagcuggcagugcagggaggcgcugcggagugaccagcugccucccugugcuucaguuucaucaucuuuaaggcagagaucaucauucuugcccuaaccugcugagagauugcugggaagauuagcgucagcuaacuuacaucaaaguucuuggaaacauaaaacacuaggcaaauacaaaguucgucauuaaggcuagcccuugaagaaaucaguuggucuauucaaagaaaguggccugugacauuuuaggcagggguugcagccuuaacuugcuaagggucaaugugggugaaccagugaccagccugacucaccuaggcaggagaugggagaguguugaguugggugggugggugaguggguagcuguugcuggggguguuaguguauccugaguuacgggggccuggcagaagaaagacgacauguagcaucugauuaguugaccccuguucccagcugacuuccccggcucacacaaggucucauccuggguugucgcuuucucccucugcauacaggcucaagaaugggacauggacgcccggcggccaaugccuuuucaguucccacccuuuccagauagggcaccugucuuccccgaccgcaugaugcgagagccccaguugcccacagcagagaucucacucuggacugugguggcugccauucaggcuguggagaggaagguggaugcccaggccagccagcugcugaaccuggaggggcgcacggggacagccgagaagaagcuggccgacugugaaaagacggccguggaauuugggaaccacauggagagcaagugggccgugcuggggacccugcugcaggaguacgggcugcugcagaggcggcuggagaacuuggagaacuugcugcgcaacaggaacuucuggguccugcggcugcccccgggcagcaagggggaggcccccaagguaugugguggucccuggggcagggauagaggugaggaacagcacaggugcauaaaauucuugauuucauuuugucagcccuucucauaaacuucucuggcuccccguuauccaauuucagugucuucuuaaagccugucuccacugaaacaaccuggucuuggacguucuaccccagcaaggcucacuccauucauuccccacagucugcauuucugucugggagccuuugcucucgcuguuccuagaccccucugaguugucugguugucugcaaguucuugcagcucuucacuccuugguuuucccacuugacaccuaccagcgaucaugugucauuggcugucuugguauaugcucaccggaauguggcuggagucgcaccucaaaccaggcugccuggaguugcuuucaagucguagucacuuaucucaggggggcccuucuuaaaguucagaaugcacacuccguaucuuacuccguucccucuccugcuuuccucccggauccucaaugcugcuuuucaguucacugagagaacggagucacccagaagaggcguccacaugcagccagcuuguucuuccaucugcugcucgguggccacagacucugcuuucccuuguuccuguggcuugauguccccugcccaccccaggaggucacccccagcgucucucuccuuucuccucugagucaucagcucuccccccucugcugggcuauucccaccagcaugugacuguucuguccugcuguccgucuuuaacagaaaaccucccugggcccugcaucuaccugcauuggugccucauuucuccacuccucuuuagagcagaaccccuugaaagaguugucuauacuuguugucuccaauucuuucuuccccauuuucucuccuucccucccuuuuccccuucucuuuauuauagaauauucaaauaaaaauagacagaauaguauaauggguccccauguauccaaauuccagcugcauuagcugcuaacucuuggccagucuuguuucaccuaaaucccugcccacuuccccacucccauuuuauuuugaagcaaaccccagacauuagucauuuccuuugcaaauaugucaguauuagcucaaaagguaaagacucuuuuuuuuuuaagugauaaucucaauguuauuaccaccaccaccauaguaaaagcuucagccuagaucacugucuagccagugauuagauuuucaguuguuucaauuuuuaaaaacauuuuuuuaguuugaauuaggauucaaguaauguccacacauuauguuugagaugucucuuaagucuuuuuuaaucugcgggcaucucuuccaucuauuauuuuuccuuucaguuuaucuggaaggaauugggccaccuguccuguuuugcaucucgcugucuggauuccacugauuacguccccuguggucucauuuaacauguuccucuauucucaguauuccaguugauugguaacuggaucuuucucucuggaacgcacucugaucaggccuuugcucacuaaugauguccgugguguuacagccagugguugcuucucagucuucauccucccuguccugucagcagcauuguguguaggugaccacucucuccgugaaaccccuugccguggcuucugggacaccucucucugcugagucuuuuccuaccucaccagcugcugugucucauuguuugccaauuuugccuccuuuggccagcuuucuaaugcauggagugggccagaccucugucuuggccuuuugcucuuuauuuacucuccucccucaugacugcaucccgucucacagucuuuauuauuuauuuauuuauuuauuuuuuuugagacagagucccgcucuguugcccagacuggagugcagugacgugaucuuggcucacugcaaccucugccuccaggguucaagugauucuccugccucagcugcccuaguaggugggauuacaggcaucugccaccaugcccaccuaauuuuuuguauuuuuaggggagacgggguuucaccauguuggccaggcuggucucgaacuccugaccucaggugauccaccugccugggccucccaaagugcugagguuacaggcgugagccaccacgcccagcuagucucacauuauuaaaagcaaucuguaugcucucaccucccaaauagaugcuuucucuccccugcucccuuucuauauguugcccagcuuucuuucuggaaugccagauucacauuccuaccuauuaauucauuuggaugucaguaaaucuuagauuuaacauguccaaagugaacugcggaucgccugccugagaccuguucuaccugaaguuguccucaucuccguugaugacggaugguuccauccuuucaagugcucaggccaaagccuuggagucauacuugucuccucucuuucucacacccuacuuccaaucuauuaguaaauacccugauuuuucuucagaauauauccacaaccuggccacuccucaccaccuccacucccaucgccaucgucuggucccaggcaccauggucuuucaucugauuuuugccauggccuccuggugggucucauugucuucauccuuguccccccacccauacagucuaucucaacacagcagccagagugauccuuugaaaaugugaagcagucacaucacaccucugcuuaaaccucccaaauggcugggcacgguggcucacgcccauaaucccagcacuuuggaaggccgggcaggugggucaugugagaucaggaguucaagaccagccuggccaacauggugaaaccccaucucuacuaaaaauacaaaaauuagcugggcaugguggcaggcaccuguaaucccagcuacucaggaggcugaggcaggagaauugcuugaaccugggaggcagaggcugcagugagcugagaucuuaccacugcacuccagccugggugacagagugagaaucugucuuaaaaaaaacccaaaaaacaccucccaaauggcuucccaucugauuagaauaaaagcccaugucuguuuauggcccacgcucucuuccccugccucucugaccuccucugcauccacucccuccugcucacucccaucugugcuguucugccagcacaccacgugcgcccccagcucagggacucuccacugagaagcuccugcccugaauaucugcauggccguccucgccaccucuuccaucagggucugcugaggugccacuucaucagcaugcccuucuacaaccauccuauaugaaagaaccacgucccccaagcacacucgucucccugcccuuacucgaauuuucuacaaagcacuuuugccauugacaucuuaaauauuuaagauaugcuucuuuuuuuuuuuuuuuuuuuugagacagagucuugcccaggcuggagggcagugguacaaucucggcucacugcaacuucugccucccagguucaagcgauucuccugccucagccucccgaguagcuggaauaacaggcaugugccaccaugcccggcuaauuuuucuuuuuuuuuuuugagacggagucuugcucuauugcccaagcuggagugcaguggugcgaacucggcucacuguaagcucugccucccggguucacaccauucuccggccucagccucccaaguagcugggauuacaggcacacaucaccacgcccggcuaauuuuucuauuuuuuuuuaguagagacgggguuucacuauguuggucaggcugguuucgaacuccugaccucgugaucugcccgccuuggcuucccagagugcugggauuacaggugugagccaccgcgccuggccuaauuuuuguauuuuuuaguagagacaggguuucaccauguuguccaggcuggucucaaacuccugaccucaagugauccauccgccucagccucccaaagugcugggauuacaggcgugaaccacugcaccuggccuuaugauauuauucuuaaguuuuguauugcuuuuuuugucuucuugguugguuuuccccaaccagaguguaaauucugcuugguugccugcugcaucccugugccuggaaugguaccuggcuuagacugguaugcaaaaaauguuuguggagugccucucuccagcuggagagcuaacagcuuccuggcagggacugggucuugugugucucugugucugcugaggcaaccaccccaaugacuuugccagaggaguuguuugacguuacucauugaggcuucacagaacugaguuguaaucguggcucugguuccucagcaaaacauuuccuggcacugcagccacagaggcugguuuuuaguaugguuuugcauaugucgcuugucuagcacaaucagcauuuacguacacacugcccuuuucuuuugucuguucugugugucucagcgcauauccuuguguggcacuguggcguguucugugcgcugcauuaggcauuagaggagacuugacuugacaagggcucuuacagaauaaugaaaugguuuuggggucuggaaucagaggacuuggguuuaaauccugacuuugccacuuacugguuuuuuguuuuuuugggacggucucacauugucauccaggcuggaguacaguuauacaaucauagcucaugcagcuuugaacuccugggcucaagcaauccuuccaccucagucucucaauuaauuaggacuauaggcacaugccaccacacccaguuaaguuuuuuauuuauuuuuauucuuuguagugacagggucuugcuuuguugccgaggcuggucuugaacuucugggcucaagcagucuuccugccuuggcuucccaaagugcugggauuauaggcuugagccacugcaugaggccugcuuguacugauuuuccuaucauuggucaaauguauuuuuuguuguuucugagccuccuuaauuccucuuuugaaggaagugaaguauaaacaauucaguaaauucccagcugguuucucugaguuucaggguuauuaucaauaaaacgaagaugauaauaugcuuacuucauggaguugugaggauuaauuaauuuuauuugugggaagacacuauguagauuauuguguuaguuaccuauugcuguauaacagauuaccucaaaauguagcagcccagccuaaaaaauaauuauuuaucaucucaccauuucugugggucaggaacuggggagcagcuuaggugagugggucuggcucagagucccaugagguuacagucaagcuguugaauggggcagcaguuaucugaagguuugacuggggcuggagggccugauuccggcauggcucacucacguaccuguuggugggaggcacguggucuugggggaggaagaggaaaaaguaaaaaagacacgugccagauggacgggaggcaacauaauuacgggaaccaagcaggauaaaauucuagaaagaugauuugaccuuucgaagaggucagaauuguugaggauuucaacagaaggucgcugaugaucuuccagagugugguuucagagaauggaagguacagaggcagaaucuaaggggguaaagaaugcauagauggugaagaggaaaaaacagaaugugucucuugggauguucccagugaauggggagggcagagugaccugagggagcagcguguugagggaagguuuuucugagguuggaaugacccugaaggacggagccaguagagagggagaaacugaugacuuagauuaagcuucacaggcaggagguggaggaagaggugaagggcacauaccgucggccuuggauuugcaaggagaggggcaagaaaggagcuugccggcgccuaccugagaucaaagacagacagaugugggaggucacuuaaaggucugggagaaugaaacguuugaaacaagccucccggagaacauagcaaggugucagcaagagacaaacaagaagcuucugaagcagccgugagacagcgguaugaauuggugguggaugucaucugcggaguucuaguaacagagaauuaaaaugaagaaagggggcugggcacgguggcucacgccuguaauaccaacacuuggggaggccaaggcaggcggaucacggggucaggagaucgagaccauccuggcuaacauggugaaacccugucucuacuaaaauaacaacaacaacaaaaaaauuagccaggcgugguggcacacaccuauagucccagcuacuggggaggcugaggcaggggaauugcuugaaacugggaggcggagguugcagugagccaagacugugccacugcacuccagccuggagacagagcgagacuccguuucaaaaaaauaaaaauaaaaaacaaaaugaagaggccaggugcaguggcucaccccuguaaucccagcaauuugggaggcugagguggguggauuacaaggucaggaguuugagaccagccuggccaauauggcgaaaccccgucucuacuaaaaauacaaaaauuagccgggcgugguggcaagcgccuguaaucccagcuacucgggaggcugaggcaggagaaucacuugaacucgggaagcagagguugcagugagcugguaucgcgucacugcacuccagucugggcgacagcgagacucugucucaaaaaauaaauaaauaaaaauaaaaauaaaaugaagaaagggaucuguauuaauuuucccagguuggggcuuuuccugcaucugguggaagguccaguagcuaaagauucuaguucugauuguaaagauggacagugaguugucaguccguagggguggggccauggcacugagguguagacaucgcaccugcgcauggcauucucagaguuacaagcaccugguaaaagggcugacauuucuaacuuacauaaaggugcugcccacucaccaugcugaguagugguagcugugcuccugacuuugccuuuucuaacucaccccaaggugccauacaagccagcuuuggcccuguaaaugcagauacguagaugaauggacuguaaucacaggaugggggaggauugaggggucggauuucagaccgagagugaaaggcugguucagucggaaugugaaagugguaagagggaaggcuguguguccagaggaggaaguucaguuaucaaagucauggaagugaaacgauuuuggacaauucgguccaaguugaggucgugcuggugaguggcugaagugagugauugcaaacugaaaucggcuuucuguaacagauccgaacacacuugucaucagucugacaagugacugacaccacgcgacgacucgggccgcaguggagcuuccugguguuggcacucgcugcgcagcacacucaaguauuuauugauucccuacuguaugcuccuugaugaucaagauaggguagugaacgaaguggaccaagguccugaaccuuagcacaggccuuagauuuuauaugcuuugcugacaaagagguaacugugugcacagaggugaccugaccugaaauacagguuugguaaccagguuuuacucuaccuggcucacggauacccacucugagaacccauuaccccucugucacccugaauaccaaaagaagcauauugacuacucuuuacccucagguauccaguugaccuaaaagugaaauaacaauggauguggcuaaaugcuuuuucuaaaaaggcaggguugaccauccguguuauugaaagcaugagaagguccgggacagagaggacugacuccacugagauggacaguggggacuggggagccacggagagcaaaggccgggcuuugguggggagugggucuuguggcccgcaggagaaggggaggugguggggaggaacaggcaggaggcgcuagauuaaccgcuuguuggcuuagguuccagugacuuuugucgacauugcuguguacuucuccgaagacgaguggaagaacuuggacgaauggcagaaggagcuuuauaacaaccuuguuaaggagaacuacaaaacccucaugucccuggguaaggacaccuucucuccucuuuggugagccaucucugcagaggguugugaaaugcuuauuuguccacguuagcaccgccuaggcagguuguuucauauuuuuauguaauggaaacucaggaaaccauuugcuuauaaugcuaguaggauagaacaguuuacaauaggauaaaaauuuaaaacccaguaacagggcccauuaccauagaacucaacguuacaccacuaccacguuggauuacaguaaaacagcaccauucgcaccucaccacgcaccacaucccagcagcccgcgguaagccauagcuggucugauguuggcuuucagagaccagcucuuccuacaguagaaauuugggcaucuaucgacucguuuucagauuacccgccuaacucgcauaacugcugccaaagagggacacccaggaggagagggggagaugggguaggggagaguucucccuuccccuugcuggaugcguuggucaacuucacucagccuuucccucccuccuccucacuuccagacgcggagggcucaguccccaagccagaugcuccaguccaggcugagcccagggaagaaccuugugugugggagcagcgccaccccgaagagagagaaaucccaauggaucccgaagcaggugauggcagcagaagagagugcgggguccagggaagggcgagagaggacagccggcuuuccgcacacugcugccgcgaggcgccacugugugugcaccauggggcgagggucuuggguggcucccaggggccaguucugccagagucgaaauuugguggucacuuauaggaagagaucucagggcucaaaauagcacccuggauauuuguggugugguuuguuaaagccgcguagcucuggacucucaaguaagcuggguggagagacgaggaagggcuuaggcuuacgcuaccgccccaggcccgggcucagagaggcugacagaggagggaaaaaggagucugcggcgcaugugggguuucgccccggcccgucgcuuauugcuuggccuaauguacagcgucaucaccucauucgucggccgacacaugcggcucaccugcaggcucgcccugcaagccgcuugccucacucaagaaggaaucuuaagccugaggaaaucgggccccccgagcacaucacacuugaugagcucuugcugggguggaaaggguggaaggcccuaggguucuaggccugccucugccuuggaaaucuuuccucagggucagcuuuccugagcauuguuggauuaggugaaaucuggugcucaaacuguguucucuaccucauuggaggaacuuuugccugucugggcccucuguccucccuuguuuuuuuguuuuuuguuucuuugagacagagucucauucugugguucaggcuggaaugcagcggugcaaucucagcucacugcaaccuccgucucccagauucaagucugcaaccucagccucacugcaaccucagccucccgaguagcugggacuacaggcauacaccacugcgcccagcuaauuuuuguauuuuuaguagggacaggguuucaccauguuggccaggcuggucuugaacuccugaccucaagugauccacccgccucggccucccaaagugcuaggauuacaggcgugagccaccaugcccggccguguccuccguuguuuuuaaguggagaacauuuuccugaaacucaucuuagaaugcagcucucaaggccacacucucuccuccucccauucccagucuuuccuuuuuuugagaugugauuuacagaccauaacauuuacuguuuuaaagaaugcaauucaguggcucacaaagucaugcaaccaaaaucauuaucuaauuccagaacauuucuaccauaagaaaccccacacccggcagggcacgguggcucacgccuguaauccuagcacuuugggaggccgaggugggcggauuagcugaggucaggaguucaagaccauccuggccaacaaggagaaaccccgucccuacuaaaaaauacaaaaaauuagccgggugcaguggcgugcaccuguaauuccagcuacucgggaggcugaggcaggagaaucgcuggaacccgggagguggagguugcagugagccaagauugugucaccgcacuccagccugggcuacagagggagacuucaucucaaaaaaaaaaaaagagggccgggcgcgguggcucacgccuguaaucccagcacuuugaaaggccgaggagggcgaaucaugaggucaggagaucgagagcauccuggcuaacacggugaaaccgugucucuacuaaaaacacaaaaaauuagccgggcgugguggcgggcgccuguagucagucccagcuacucgggaggcugaggcaggaggauggcgugaacccgggaggcggagcuugcagugagccgagauugugccacugcacuccagccugggagacagauuccgucucaaaaaaaaaaaagaaaccccacacccacaagcaguccuucccugcucucuuuuaccaccccccgccccugggaaccacuaaucgacuguccauaucuaugaauuugccuguccugggcauuuccucuaaauggcuccuucccugucuucaucaaggacugcagaaguuuaaggucagcagcgguaguaacagcaccuagucuuaugggguagauuuuuacauuugaagcacuguaaucucaacaguuucaguugguuaucaaaccaucacugagcaugagauagaacagggaucacuguguccuuuuuguagaugaaaaggguagaccggaacccagagaggcuaaaugacucauccacugaguuggugcggaguugaaggcaggaucccagucuucagauucuuugucuucucucuuuccuggugccugagccuccucuugcagcagggggcgccaucagaagaaaaggcccuguuuguugcaugcugggcuucuguguagaggcuauguccuugucuuuuaugcacagugaguccucacuuaaugucauugauagggucucggaaacuguggcuuuaaagugacauauaacacaaccaauuuuucuuucucaucaauguuauaacuaaacaucauagaaggaaaugauguuauuugaggaucugcuaugugucauuucacuugaacucacuguuuccaagaaccugcugacgacagugagacuggcuguauaaggagguucugcacuaucuguccaacaauagagcuuaguugugccuuuuugcccauccccgcuucucacaaaucauauauauacacgugugugugcaucuggccucaaccuggccagcucuuucugacuggggugacuaacaaggacuaaugacucccacagagagguccaacuuguggcccaguccugauuaggacccagccaguuacacagcucuagguuguuucugaauucucucuucagugucaucaccccucauuuugcugcuugccuagcccuuuuucuugaauguuggcuuccucucugcuccugagaccuucugcuccucagggucccccaugguuccaauaggaacccgagaccccugucuucuccccuggcaagugcugucagccaugcuucugagcccagaauguccuggugaccagcaugcagaaaaaaagacacaaagcaaugucauucucuguucccaggagcagagcuccuggugccugcagaaaaaaagacacaaagcaaugucauucucuguccccaggagcagagccccuggugccugcgcaggaugcguccucccaggugaagcgugaggacacccuguguguccggggucagcggggccuggaggaaagagccaucccuacggaauccauuaccggugagugagccaagcagccguccacaccagggaggggaggggaggggagaggguuagcauggucugccagcccccagaguuagcugucacaugugccaggccagagggcugagcucgaaauggaagggcugugcauccagggcugggcugagccaggauuccuccaggagacacagacguggcaaacagcauugacaauuugcugguacaccugggcucagcguguucuguuuccucucuuccucauauuauccguuuguaacuauuccaucuuccccuuuagaaacaauauccuggcagaaguacuaaguguaaggcuucaugggugggggaacagggaggucaggaagaccuguugugcccugaccaggaaggccuuucauuguuuuaaacaaguauuuaugggcugcuaccucugugccaggcaccuacauaccugcgguccugugagggaccuccucuuagcuggcauugcagcuggacucugucguaggugagagcucuguuauagcagauguauguaucaaucagaguucuccagagaaacaggaccuguaaggguguguguggaaaagagagauuuauuuuauuuuaaggaauuggcuugugauuguggaggccggcaaguccaaaauuuacagggcaggccagcagguuagagccccagggaauugcugauguggcugcuggagccugcaggcagaauucccuuuuccuugggggaggccagucuuuucccuuaggccuucagcugguugaugaggcccgcccacaucauagagggcaaucugcuugacucaagucuacugacuuacauguucaaaucucaucuaaaaauauaccuucauagaaacagcuaaauaauguuugaccaaauaucuggguaccguggccgagccaaguugacacauaaaaucaacaaucaugagacauauuaacauacuguagcccuuuacuuauccacagguuagagcuccacaaaccucaucccccccuuagucagagccucacacccauagguaagugcucauagugucuggguagaggaaagcccguucacuugucaucaggcaugacccuugaaagcaucacaguauuaggaucuuuaaggagaucuuuaagagauaagaaggcaauaagguguaaauuagguuucagagacucuguagaagaaagagaguauagggucuuuuucuuacaucuuagaaaaaucccauucaaaagauuuaaaggcuucuuguaacauuacuuuauaccccauaaauauauacaacuauaauuugucaauauauaauuuaaaaaaagaggcuuucuggaaguuuucaucuuuccagaggaaauaccucuuucugugguggucucagcaccagaaugggaaccucauucuaaggagauuuaaguuccugcagcacagaaaggcucuuucuuaaagacuguaauguuacuccccugcagcauccucuuauuugcagcaaaagcuccguuaauuggggccaagcugacuucaaccuuuaguuaaugagacuuauguaauuguaccugauguuuaggggaaagagauaauugcaugaaaucagagauuuacucaaaacacaaacuugcaggagauuucgcaucuucuaacaccuuugccgcucuuguucccgcaaguagacuccccaauuucugcccaggaccucuugucccggauuaaacaggaggagcaucagugcgugugggaucagcaggauuuggcagacagagauauucccacggaucccaauucaggugagaacaaggucagaaugaaucuugagggcaacaaguguuuuucaaaaggaaucauuaaauuaauaauuuauuguguuuaugcagcugauacuaaaauuacuucagcacugauuuuuuguucuuugagacggagucuugcucuguuguucaggcuggagugcaguggugugaucucagcucaccgcaaccuccguuucccggguuuaagcgauucuccugccucagccuccugaguagcugagauuacaggcaugugccaccacaccuggcucauuuuuuguauuuuuaguagagaugggguuucaccauguuggucaggcugcuucugaacuccuggccucaaaugaucugcccgccucagccucccaaagugcugggauuacgggcaugagccaccgcguccggccauucagcacugauuuuugaacaauaaaaacaaccaaaaagcaucuaaaagcugcauauauuucugugucagaaaauuauuuacauuuucuggaauuucucuugagugaauacuaguuagaaguuucccaagaaacuuguagggagggucuaggcauucagggaggcauaaaagaacaauggaagccccaccugcccacgaccuauguguguguccaugugauugcagagcugagaaguccagugucauugccugguaguuaggacacaagucucauccuacccaccauaccagggagagaggaugagaaguugaaucuaggauuccuuguacuuugucaacuucaccacagagaaauugaggggacccagggcagagggaaagcggggccuuccugcuucacugugguucuuaucaaugaccucugguugcagccucugccaucgcugguuucuaaaucauaccuguuagccauggcccugagggccguuaucuggggcuuucuucuggccuguccuggccccauggguuccucuggggcuaaguggcagagcugggagaucuggguuuuaaucccggcccugccacugcacagaccuugggcuaagccuccuucuggccaacuugaaaugcaucgagcagugagaguccauuuaggaaggggcuuaugaggguaaggaggauggccuggaaaugcaacaccgauaccaaaacaugcccugcagguugcagccaccgcaugggaugguuuucaaaccuuugaugggaggccgaguagaacugaacaaaaucuaagacugccuucuuuccaugacaacagagucucucaucucagcacaugacauuuugucauggaucaagcaggaggagcagccauacccauggggaccacgcgacucaauggacggagagcuuggauuagacucuggcccuagugaguaacguccccaccuagacccugggguuucuucucuggagcuguacagcugaggcguggacgaaggcugguccucuucucagcucaccccucguagggugauguucuguugauggcagcguuucaaaguucugcaccaaagcacucccauucuuuuuggagugugauauuguauuagcuccccaggacugucauaacaggguaccacaggcugggcagcuucaacaauagaaauuuauucucucacaguuccacagguugaaaguccaaaaucaaggggugggcugggccuugcuccagacuuccucugaagucuguaugggauuccucccucgccucucccagcuucugcugggugccaggaaccucuggcacuccuuggcuuguagaugcguugcugcaagccucuguugucacaugguguucccuugugucuguccucacaugccaucuuauaaagacaccagucauauuggaucagggccucccuacucuaguaugaccucaucuuaacuaacuacaucugcaaugaccccguuuccaaauaaggucacauucugaaguccuggggguuaggacuucaacauauuugguggggaggggggaaggcacaauuuaacccuuuauggcagggaggggaggaagggagaggggccgggagauugcugagccagugugcccgaggcaguugacagcagcagguggcucacaugcuggaagacacuagccaggcugcacacgguggcucacacccaugaucccagcacuuugggaggcugagguggaaggaucucuugagcucaggaguuugaaacuagccuggguaacauagugagacccacagggucuacaaaaaaauuaacaaauuagccaggcguggugacuuaugccuguggucccagcuacucuggaggcugaggugagaggaucgcuugagccugggaggucauggcugcaaugagccaugcuugcaccacugcacuccagccugggcgagagcgagauccugucucaaaaaaaccugaaagaaaaaacaaaaaacacuagaaguaccccaggcaucccugagcuaccaucccggagucacugaugaacacacugaagcucaaagagaaagggaggauuguuuucccaacagguauggaaccaaaugucucaccagacuugggucucuugggucuuucugaagcucccuuauugaccuaugacccuaggcauauguuuauggauuguugaacauucuuagcucaggcuaauauuccucgcuaaaacccaguaccauccccuugcccucaacauggcugaccuagugucuucuggcuggucaaaggcuuaacagaauagcugcauguguguucccuguccauauuuccugacauuuuuuuuuuuuuuuuuuuuuuuuugagacagagucucacucugccgcccaggcuggagcgcaguggugcgaucuaggcuuaccacaaccuccgccuucuggguuccagcaauucuuccaccucagccucccgaguagcugggauuacaggugugugccaccaugccuggcuaauuuuugaauuuuuaguagagacgagguugcaccauguuggccaggcuggucucgaacuccugaccucaggugaucugcccaccuuggccucucaaagugcugggauuacaggcaugagccauagugcccagugcugacaucuugaaggagcuuaaacuucacguaagagcggaggacauggguuguuucugguucugaacagccauuucaaacucaggcaagcggaucacacucucuauaagacaacuuaguucuagaagagccagugugggccuggaggaauuggcaggaacgagauaggaacaauguauguccuuauuucaaguagaauugaaagcgguccucuuuguaacugcuggcuuggugggaugagaugggggaagccaggaaacugguggugagcaccggaagaaagccaacuccaucucuuccuccacagcugguaggcuaccauugcuagcccuggcccgaaggcauaggaacuagugcaucugaccuggggccaggaaauucugcccaaacccuuccuuaucccucaaugcugucuucugauucuucccaguuggcuaggagcaugugggccuagaggagccuguucuuggggacuugugcuguguggaaagcagucuaggaaggcccauagagaacuugcaaggauuugcaaaggaccccaccauuuuccuacuuaaguuuggauaucauagaaugauuugccucauguuguuuuaucuuuuuuuuguuuguuuaaagacagggucucacucugccgcucaggcuggagugcaguggugugauccuggcucacugcagccuccaucuccuagguucaagugaugcuccugccucagccucccaaauagcugggacuacaggcaugcaccacugugccucaguaauuuuuuaaaauguuuuguagagauagggucuugcuauauuacccacgcuggucugaacuucuggccucaagcaauccucccaccugggccucccaaagcucugggauuacaggcaggagccaccaggcccagcccguuauuuuauauuugaaggaccuuugaacccuagcauuugggaggaaaugcacagaauuuaggagauaggaguaucuggaaaugguucucuugccugccaagucacgacagccucuuaucagaaccucuguucuuucucccaaagugagccugcuuccuauuuaucaguguuggaauuugacacuggccugucaucugugguuucuuugauguuuaaaaccaaccuaguauugugguugccagggacagccagaugguagccaugcuauuauguggaagagucuucuggaaaggggauggaggggagaagagucaggguagagaacacagugcagacacgggauaccuguccuugccaacuuccuucuccagcccugggauauguaagagggaaauaacugguauccguuugacucaaaggcagaccucaacccaauuggauauuacauucuuguaaaagggacuccugaauuuauuuauuaaugaguguauacugagucucgcucucagcauguuaguguaagacaagaagaagauucaguuugcccaaaguuaauguacaucagugccuccacugaagcaggaagcguagcuaggacucuggagugcaguggcuaaaaggugcuuccggagugagaggugguaaagauccugaagcugggccaccauucccaggugccaacacccacagaauaugacgugaaagcacccucuugaaauucccacauuauucacuacauuggguuaaaacagugguuccaaccuuucauaguuuauauuuuuuuuagcagguauuuacuuaaugccugcuauguguuacacaguauuguaagcacuuagaauaagcagugaagggccaggugugguagcucaggccuguaaucccggcacuuugggaggccaaggcaguuggaucaccugaggucaggaguuccagaccagccuggccaacauggugaaacuccgucucuacuaaaaauacaaaaaacaaacaaacaaacaaacaaaaaacaacuagccaggagugguggugggcaccuguaacuccagcuacuugggaggcuaaggcaggagaauugcuugaauccgggaggcggagguugcagugagccaagauugcgccccugcacuacagccuggguggcagaguaaggcucugucucaaaaaaaaaaauugggagugaagaaagaccuuuucuuuugugggaagaggaugaauaagcaggccagcaagcaggcaagguaaagccaggaugcagcaaugcucugagaacaauggcagggagaacaggaaggaguguggacaugaggcagagcaaagacagaguggucaggaaaggccuccgaggggaagcggugccugacugagugugcccuuggcagugggaaggagccggccgugggguugcagggggaagagaagaccaagaagagggaagugaaggcagggccauggaggcuuuggggaggaggauggagccguagacugaggcaccugagcauguaugaccuaugggccaaguuagaguuuggauuuuauucuuacaagaaaggagacuaggccgggugucauggcgggcaccuguaaucccagcugcucgggaggcugaggcaugagaaucccuugaacccaggaggugaaaguugcagugagaucaugccacugcacuccagccuggguaacaaagcgagacccugucucagaaaaaaaaaaaaaaaagagagagagagagacuaauaaaggguaugaaaucggacaugaucugguuuacguuuuuauaggauuucaggaguggauuggcggggggugcggagccaugucugaggcucaugcauuugaugcagaccaaguggagagaugcugguggucagagcugggguagcagcagugcacagggagagaaaggacagauucagaugcacuuugagagugucacucauggguugccugugggggcuguggaaucaagacugacuccugggucuggguccuacagaagugggugaaugguaguacuguuugcugaagugccaagcccuggaaaagaaccuguguugcugguucuaguuuggagucaagaguucuaguuuggaccuauuaaaauuugaggugacacucaaguagcagaucaaguaggugaauauaggagucugaaguucaagagagagcuuggggauagacugauuugggaguuacagguugcagugacuuccaacaucagcgaccuguaauuggccaaaccucacagguugagggcucaugccuccacaggaccguucucucuucagacaccagcugcaaauuuggggguucuaggccacccucacuucugaccagcuggcuacaaauucugggcuucccaucaccccgucauaauuugcuagaaugacucauagaacucaggaaagugcuauauauaucauuacaguuuuaucacagcaaaaggauucaaaucagagcuagccaaaaggagauccauaaggcuaggucugggaugguccuaagccugaaauuuccauuguucccucccuguggagucaggaugugucacccucccagcaugucaacgugugaaaauaugcagagcauugccaaccagggaaguucgcugagcuuuggcguuccgaguuucuguuggggcuucuuuauauagauaugauugauugaaucauuagccacgagguucagcucagucuccagccccuuucccucccuggagguugggccucaaacccuaaaccuuuagucacgugcuuggucuuuucagcauggcagccccauccuuugucaucuccuuagcuuaaacucucuaagaucccaccaugaauaacaaaggcaccccugucacucgggaaauccagagauuuagaggcuccuucccaggaaccagggacaaaggccagucaaguuauuacacuuagguuguucaggacuauaugaguucuagggacaguguaaacaaagaauuaaagagaucuuagcucugagcauggcagaaaaccagaggggcaagguguuacagaggcugggagaagagaaucucuuggggaggguuaacuaugucagacacccaugagugguugcauaugcaggacagggaagagccugggggauuugacagguuggauauuguuggugaucucggcaaaaguuuuucaauggagguugggugugguggcucacaccuguaaucucagcacuuugggaggccgaggcagguggaucauuugaggucgggaguucgagaccagccuggccaacauggagagacccugucucuacuaaaaauacaaaaauuagccaggcaugguggcaggcaucuguaaucccagcuacuugggaggcugaggcaagagaaucgcuugaaccugggagguggagguugcagugagcagagauugugucacugcacuccagccugggcaacagagcaagacuuggucucaaaaacgaaaaaguuuuucaguggaauggcaagggugcaugccugauuggaaucaucuaaaaagaaugggaggugaagaagugguaagggcaagugcagugacucuugaugagucuuacuaugaaaaggaacagaaaugacaugugaggagcuggggcacgggccacaugggccuagggaggggguucuuuuaaggucggagauaacuagaccauugucucgggucagaugcucccaacuacuuuagaacccugauucaaacugccuuaaagaauaaagaagccgggcacgguggcucacgccuguaaucccagcacuuugagaggccgagacgggcggauccugaggucaggagaucgagaccauccuggcuaacacggugaaaccccgucucuacuaaaaauacaaaaaaauuagccuggcguagucguggugggcgccuguagucccagcuacucgggaggcugaggcaggagaauggcgugaacccaggaggcggagcuugcagcgagcugagaucgcgccacugcacuccagccugcgcaacugagccagacuccgucuccaaaagaaaaaaaaagaauaaagaaauuucuucucuuacguaacuggaaguccuaagguaggucagguucaggcuuaguugauucaaagacucagcauguuuucaaggacccagguucuuuccaauuccuugccugaccauccucgguguggcuucauccccaggcugguagcacagcagcugcagcugucccaagcgucgcauccagacaugaguguacaggaaagcccaucuuuuccugcacacucuaaggaaugaggaaaucuuuccagaagccucccagcaaacuucccauacccuacugaccauaacuagguuacaugcuugcaugugaaucacuuaccagccagugacuggaaaggaaaagcccucagggccaugcauggguugggggggaggggcguaggauagaggaggaaggaugacguaaucauuccagaguggaaaaguaaaacccacuagagacgugggccaggaugccaggcuguguggaggccccuggaggguuuuuuuuuuuuuuuuuuuugagauaagguuucacucugucacccaggcuggaguacaguggcgcgaucacggcucaccgcagccucgaccucucagguuuaaauaauccucucgcaucagucuucugaguagcugggaccacaggcgugugucacaguaccuaauuuuuaaauguuuuuuuguagagauggggucucccuagguugccuaggcuggucucaaacuccugggcucaagcaauccuucugccuuggccucccaaugugccgggauuacaggcaugagccacagugccuggccagcuugugcaguuuuucagcugccugagugcagucacaggacuggaguucuccaggcaagcacaacggcggagcaaaggcaaucaccgugcccuugcaagugccugggcugccgggccuggagagccaaguugggucaggaaggcagaaaaagguuggagguggagggcauagcgggauggugagaacguggauugagguucacacuggguuggaagacggucagaguaggacugccuuaggugggcuucccgggagacagccccugggaguuuaugugcauauaguuucuuugcaaguccucugggaauaacaccugggaaggagugagaguagcaggacuggguagacagagaagcaaacacccucagugccguggccacagaggccacagcgaucucccgggauucucuggagcugggaugacccuucccaggcauccugcacugaugugaagagaauucuuuuggccucugcaccuggccaguguccugcagagaugguucucugccaggccaauuuugauugagacagagagggagggcaggcccagucuauuuaagaguaucauauaaggacagaccucagucaaacaccaacgaauauaggagggcuggguggaaacauggcagauguggccugggaaguggccuccggggagcaguuggguccuaggcagaggggugugagcacggagaaaaggaugcugagaagaggugggaggccgucucuuucuucagagcucuuccacaggcuuccccuaaauuggggagcaggacuccucuagggagaaaggaauucaaacugaagaccagggaggugauggagcgugaggcaugagaaccacugggcugggggacagggugggugggagggggaaggacugggccugacgucaccauucugaugcucagagccugggcuuugucucccacugccccccaaggugguggagaacugugcacuuggaggaaagggggcaagaaccgcauuuccuggggugguagguuggguggccacugccacgagugcaaggagggccuguuauggugcugccaagguccaggugggucaggugccagggugggacucacaugucccagcugcccacaccugcccaagucagaugccccacaugcuuaguggaaacaugacugccaacccaucugaugcuuauguuuccagcucccugcauuccauuccugugggccucuagaugguuuucaccuuggauaaaauucuuuucuuccuauugagagacuguccugagauaaaagugagcauugucagugugugugcuggcucacaucuguaaucccagcacuuugggaggccaaggugggaggauugcuugaucccaggaguuggagaccagccugggcaacauagugagacccugucucaacaaaaauuuauuuuuuauuuuuuauuuuuauuuauuuauuuuuugagucagagucucgcucugucgccaggcuggagugcaguggcaggaucucagcucacugcaaccuccgccucccagguucaagugauucuccugccucagccucccaaguagcugggacuacaggugcgugccaccaugcccagcuaauuuucguauuuuuaguagagaugggguuucacuauguugggcaggauggucucgaucucuugaccucgugauccacccaccucggccucccauagugcugggauuacaggcgugagccacugcgccuggccuuuuuaaauuguauuuuauuuauuuacuuuuuugagagacagaguuucgcucuuguugcccaggcuggaugccugggccagugcaauggcaagaucucagcucacugcaaccucugccuccccgguucaagugauucuccugccucagccuccugaguagcugggauuacaugcaugggccaccacucccggcuaauuuuguauuuuuaguagagacgggguuuuuccauguuggucaggcuggucuccaacuccugaacuaaggugauccgcccaccucggucucccaaaaugcugggauuacaggcgugagccacugcgaccggccgaaaagauuuguuuuuuuuuuuuaauuagcugggccugguggcgcaugcuuauggucccagcuacuuggcaggcugaggugggaggaucacuugagcccaggaagucaaggcugcagugagccaugaucucaccagugcacuacagccugggagacagagccagacccugucuggaaaaacaaacaaacaaaaaacauuguccaucagacugcaaguaagucuuguuguuucugggaaauucugccuuccaaaaugacuucuggacagcagguccccuaccccuuagcccucagcguucuggagggacuuccuguccuugcugcgugccaccugcuugacccguuucugggcuccacagcaggguggcuucgaacaggucgaagggccacguagaucguggcccagcaccuugugcaaucccucguaguuaguggaacugaggcucagauagcaugcucccugggccccccuucgggagcagugugggguccuggccgagaaccccugucagcaugucacuucuuccuaucuccccaggugacagccugcugauggugaagaacccacccccggccccgccacagccccagccccagccccagccaccgcagccgcagcugcagucgcagccccagccccagagccugccccccaucgcgguggccgagaacccgggcggccccccgagccgagggcugcuggacgacgguuuccaggugcugcccggggagcguggcuccggcgaggcgccgccggguggggaccgcagcaccgggggcggcgggggcgaugggggcggugggggcggcggcgcggaggcggggacgggggcaggcggcggcuguggcagcugcugcccuggcgggcugcggcggagccuccuccugcacggcgcccgcagcaagcccuacucgugccccgagugcggcaagagcuucggcgugcgcaagagccucaucauccaccaccgcagccacaccaaggagcggcccuacgagugcgcugagugcgagaagagcuucaacugccacucgggccucauccgccaccagaugacgcaccgcggcgagcggcccuacaagugcucggagugcgagaagaccuacagccguaaggagcaccugcagaaccaccagcggcugcacacgggcgagcggccuuuccaaugugcacugugcggcaagagcuucauccgcaagcagaaccugcucaagcaccagcgcauccacacgggcgagcgccccuacacgugcggcgagugcggcaagagcuuccgcuacaaggagucgcucaaggaccaccugcgcgugcacagcggcggcccgggccccggcgccccacggcagcucccgccgccuccugagcgagacuagggcugggcugggggagggcagggccggacggaguggaucgggggcggccugagcaccaaccaccuugccggguguccucagccaccgucuggaaaucggcaacaggcauugcacuccgguuggggguccccaggguggggcagggaucccccagaucugucuggucugaauggacgcccagcucaucuaggguggacccagcugcuggggaagagccagggggaccgcgaggagccgagcguccucgggcaccgcccucacaccuccucgagugcccugggaccacugggccacagauggucaucaggggaagccaccagggagucccgaagcccuucugagaucaggaaaucaggucccaagguuaggagacgcccugaaaaaaagcgaaggccgagggaugugcuaaggguaacaccuucaugaugacaacacugccucgcguuucaauagcgcuuuauacuuuuuuaaguguuuucuauccguuauccauuucacccuuggccuaucccucucagauaggugggguaggauuuuccuggugaccgaguaaagugagaggcaggugagacgguucacccaaucacacgggaaggggcgcgcgcugcccaaccgcgcucuccgccuaccuccgcugcucgggaagcugcuggccuggcccuccuggucucucuuccuuuccuggucucucuuccuuuccuugcucucacccacggauaaaaccagaagcgacaggaggccagcuccugggguuccugggagccgggaacagauuggcuacggaacgccccagguuguacauucagagggcucuuucuccaugggagcuccuggugccgccucggccccagccuguccccagccccucaaucuggugcagcagcaucuugucacugcacaacaguggccuggucccccacaggcaguuagggccccaggucagaccucaccaugaugauuuguuccaguucucccagggcagaggggcgagggagaggcuuuugcugugagaguagccgucacgugucucuucccagcagcgccgggcaagugggugcuagagucugagccucaggcucuccugcccugggccucccaauuggugcuaucuguuacugcccgugcucacggacauggauacagacccugcugugcuccacacccugcaggcgccucgggaagcgcccaaaggauuccccuucacguuggugcaccugcuccauagcuccgggcgcugcgucccgaggggccacagucuccauuucagcgucuugcauggccuggcaccggguggggugguaugccccaggacccuuguuugugucaaaaaugacuuucccugcccuugccguggguccggcguuccucccagccgggaucacagugggcagccggcacccggcaccacuuuggcgagcguccugcuuccgcccucgcccucaucuacgcugcuccgcuuuccucagaccccuuuuugccgugcaaagggaauucuugacauuaaauaaaagguauccagauugcagacugcauguucacagagcuggggguucuccagcuugccuacaguaaagccucaaugaacuggaauccaauucaa

SEQ ID NO: 191610 - RNA, 160168 nt, Homo sapiens
aagacuuaggaagacugguggaugcguuuggguuguagcuaggcuuuuucuuuucuuucucuuuuaaaacacaucuagacaaggaaaaaacaagccucggaucugauuuuucacuccucguucuugugcuugguucuuacuguguuuguguauuuuaaaggcgagaagacgaggggaacaaaaccagcuggauccauccaucaccgugggugguuuuaauuuuucguuuuuucucguuauuuuuuuuuaaacaaccacucuucacaaugaacaaacuguauaucggaaaccucagcgagaacgccgcccccucggaccuagaaaguaucuucaaggacgccaagaucccggugucgggacccuuccuggugaagacuggcuacgcguucguggacugcccggacgagagcugggcccucaaggccaucgaggcgcuuucaggugggcccgggccuggccccacccgggcucucgccccagcccugcaccgcccgcccaggcccaccggguggcuccgcgggccccaggcccggcgcgcugggggagcgggggugaggccugagcgcccacacccacgcgcgugggggccggggcucuccucagcuccggcucccacuccggcccgcggcucugcuuccccggccgggguuugcugggugagggcgaacgcgcugucaagaaagccccggcgcuggcuaaggggggcgcggggcugggggaggcgcgcucccccggcgccccgcccgggcccaggcgcgugcuccaggccccggcacgcugggccucgggggccgagcuagaaugcccgccugugccucguuccuuccugcuuuccucggucguuauuuacggcgcugucugugcugcgccccgaaacccccggccguggagaacggaaaguggccucgaccgugcugccgagugagaccgcgaggcuggugccucgcacaggcggccccgcgcuuccuccccacccugugggaggagagagugugugcccgguuuccccguuccaccuccccugguccgacgagcgauaggggcaggugggcgggggcggcuggucgccuggaagggagucgccgccacgcaccggccgcccgccgcucuccgggcccuggcgcggggcugcggccuccggguauggcuccgccagggcgagggacggugccgggcggagcaggacgcccagggggaaggcugcguugggguccccaugggagccccgugccuuucggcuucccuuuuaaucaauucagacguggugcgggcgccucgccguccuucgcgccugguucagccugugccgagcugcgccucugccaguucucccguucguggucuccccugccguccccgacccuuucucgccacucccugucuuccucaagcccaccgcugaguguucccggcgggucugggcugaagcagagggcagggccagggcgcccccuccugaagaaagccaggggagcccccugccccgagucugcccuguggagcguguccagggcggugagagggugggccgcgucccucuugcgggccucgugguguugguggcccccaggggugggugggggaggcuuggagacuggacugauacccaaguagugggcccgccagcggacccugcuccccaaccaucugcgaguuaaaugcccacgccgcucgagggggucggcuucucccuccgccuggagccgcguccgggccucgggggcccuucgagggccucaggaggccauuugugucgccgcuugggcugugcgggucuucgggcagggagagccgcugaacucggccgaccgucucacuucuuguguguccgcagguaaaauagaacugcacgggaaacccauagaaguugagcacucggucccaaaaaggcaaaggugagcugcugcuucuguuugccccgauucuguucucacuccguuauuggguggagagacucagcugagaacuucuuguccucuggugcuuacccccugccguguggcgugguguuccggucuuuaauccuugcuuuuaaguuuauggcggggguguguguguugaugaugcugggcaggaauugaaagcuuuucuguggccucugccgcgggauuaugguuauugguuacaaaaucucucgaaagcucacagcugaauguccucgguccgagcgggucaaauugcuccuacgggaaaugggucccaacaagcaguuugggggguuugcagggcuugggaagcagcggaugauucccccaccccuccaggagcaggagaggcgaaagcagcugcggacacgcgggggucccuccuuuccuucucuguccgggguugggaggccgugggcgcggccgaguggagaggaauuugccucugcccugugagcucgccagggguauuggaacgcgugcguaaacgcuggggccucucuggcccagaagugccuuugagucacuccgaaguucuacagguuccugcagucagcaccuuugucuccccgcuuuccaccccacuccuccuggguacauuuuugcuuacaaccaccaaaagaugaagacaggaagauucguacuacuuaaggacggggauuucucgucuccgagaucauguguguaguaugucgcuuuacagaauguuuauagacuguuuuagccucugaagcauuuuggagacauggcucuuucccuuuuucuuuuucuuaugaagccuuauggagcaguggagacuccuuuccuuucgcuagagcaggccggauuccggcucuauuuuuuuguuuuguuuuguuuuuuaaaaccuucagccaacucacaccauagauuccggcucuaacugcaauuggaaaggcacugcucccucccagucgcaccggggugggccucuaagccuuucuggauuuugcauggugggguuaggguuucugccugccccucucccauccccccaacucccaaccugagccaaauaauaagcugaaaguuaauuuaaaucagggcugcguguaucugguuagauauuggugagagagugugugcuggagagcaggaggguuugcuaugcauuucucuggugcugugcagaaauagauggcuacaaaacaucucaucuguaugccuguguagauuucagcucucuucccaggcaaagcauuuucacaaaucuuguuuuuaaggaugaguugguuuggauuuuucuuguucucauacuuaaauuucauuaagauaauugaaagggauuugagugaccugauagauuuaguucuaguugggaauuuugguaggggucacaugauuuucauauaaauugagcuugguuuaacaagaauugaaaaucgagggagaagucauauucccguaaaaagaagcuuaaagccauagccugaauugguuaggaaaaaaacauaagcccauuuuacaaauucuaauuguuauuauguuuggucaguaugucuuaauuuuguuaaaauguugaauaaauaagcaaaugguugugccucaaggacuggcauuuuaacauuugagagaguuucuaaauuuaaaaaugaaauguuuuggauuuuuacaauucaucgagcuacauguaaauacagauuacugugccuuccccugcugcuuuucuuuugcuaaccgaugggaauuucuccccagguguaggggauuaauuuaaaaacauuaccuguuaacaacugccuguuuuauucuuaaaggcuuuugcuuaguccaaaagcauauauauacuuaguuacuuguuacuuuauaauaaacaggaguuccucuuuaggaaagcacauaagguaagaugucaccagugacagcaaguauuuaucaauguaucuucaguuuauuaacaauguagauuuaaauuuucaaguucauuuuucaaguucauuuuuaacaauguaaauugaauuuucaaguucauuaaaaugcucaggauuuuaaaugauacaguacuaucuuacuaacaaaguaaacagggaugagaacauuggagguuguuuuuacugauagaacaaucauguuccuugcuuguguugaaaugucuuaaaaguagagccuuuggcugggcgcaguggcucacgccuguaaucccagcacuuugggaggccaagguggguggaucgccugaggucaggaguucgagaccagccuggucaacauggugaaaccccaucucuacuaaaaauacaaaaauuagcugggcaugguagcaggugccuguaaucccacccagcuacucgggaggcugaggcaggagaauugcuugaacuggggagcuggagguugcagugagccaucgugccacuucacuccagccugaacaagagcgugaaacucuaccucaaaaaaaaaaaaaaaccuuuuuucucugccucuggaaaucuauauuacaguuauuuuaacugacccuuggagcugugaugcaguuuccuauaucuggacuguuccaccauuuucauaggcucuggaagcgggcagagaaggcaucagggugaccacaugcccagcaccuaagggaaggucaagagguuguacugacugauggggguugcucugauaguugaaugccacaaaccaauccuugccaagccugcuggacuuuaggguggaguucuuucugcuuagcagucauuucauuccaucccaucaucaugugggcaucugaggcaggcacacccacaugugcagcagugaccuuuguacuugauauacaaggcaugucaggaaccuggugcuggagaaugcacgcugagauggaugaaugggcuugcacugacuaaacaggggagcaggcccaggaggugauuggaggcuuggcaggcuggccuggcuuugacuuccaguggagcuuggggggggacccuuucaggaaguaguaagguugaauuugguucagaccaagcuuagcucccaauuacugaggucucaagggaauguggaaggaauguggcuuuucugcauucagauaccccucaguuggggaagauuauagcaguuacuuuacagacauugaagucuccugcagcuggacuaaagagaagauugcauuggauaucugugauaguguugcacucucuauucuaaauauaaaagauacagaacaugaagacuuugacuccgaaguauaggcucaacuuuuuucccuccaccuuggaaguaaggguagguguggaaaauaguugguacuuggaaauguuguagcuguguuugguuggaagagcugcugguauccuguggggccuuguuugugccccuaugugauuauguaaauagcacugauguccuuuuuuguuauguugugggcuguugggcaugggagagggaagaggaaaauugcugacacuggggaacugagaggauggugguuuuaguucaauuuccauuacuuuuuaaaauuacgaaaauaauuuuucauauguucaguuuuuuagaaccuaaccuuuuuguuguuguugcugccuccuaugugaugaagaaccuaagcauauuuuuauuaaacuuccucaugauuuagcgguuggcauuguuuaggauuauguguaggaaaaauacauuugaagaaaggagaaaaaaauaauaggauauuauaguuaauauuuuucuaggcaggauccuuuaccuuuuucuuccuuucaggguaggauuuuuucuauuuuuauuuuuauuuuuauuuuuauuuuuauuuauuuauuuuuuuuuaagauggagucucucucuguugcccaggcuggagugcaguggcacgaucucggcucacugcaaccucugccucccagguucaagcgauccuucugccucagcccuccuaguagcugggauuacaggcaugcgccaccaugccuggcuaauuuagaguaagaucuuuuaaaacagacuguggugccuaagcucaaacguuguuuuuuguuuguuuccuuaaaaaagaaaacagugauaguugcccaacacuaugaauguauuuaacaccauugaauuguacucuuaaaagugauuaagaugguaaauuuuauguguauuuaccacaguaaaagugggggaaaaugcaaaaaagaaagugaagaacuuauuuccauauuagucuuguguuuaaaauguaaauuggauagaacuuauaaaagucaucgggguuuuaaauguaacuuacuuuaaguggcuauuuaaaagcuaguguugcauuuuaauagguguuaaggauagaauaggcuagugucaugaccagcaacgugcccauuagccagggcacaugauccuucaaugcugccuccgacuucaaagucuuaggacagcaaaagcuguuuuuaauguagaacguuuaaacacagguacgaauagcagugguacuccuuccuuaucaguguauggcuuaggugaaucuugcgauucgggaaaguuucucacacaugcagagacuugagguucugaauguuaggaaacuuucuuggcugguuaaauaauuauaaacuagguuaucuuucaagugcucaguuuaagaucagcgugggauugccuaagugguuguagcuaaaaagauuuuuuuuccuaauuucauauuuucucaaaacaaauucagagaucuugaaagauuucuuacuuugguuuuaauaagaguuuaaaaaaauuagaugcauguugauaaguggcuucuacuguauggcuguccacaguaacucugaggaagauguuacggaaacaugacaugugccaggagccaguggaaaucgagaaucuuggcuucuguuucuggcuuuccuuuugauuugugugaucaguuacauucucuuuucaggccagaugccauuaugauaaacuacaagggguauauaguauuuuguucugagguuuugccauugugcucaaaauaaauagguuaucagcuaaggcuuaaaaauaucuuuuggaauuacagagaucugggguuuuuccuguaaggagcuugacuuaaauuuuuuuucuguagcucuguuguuuuugccuguguaccucuuucaugcaguuagcaagggggaaaugaucuuugccacgcuuugaaacuauuaugagcgacacaaguuuaguuaaugugugguuauaggauugggauuuuguauuaaagugaagcugucaaacuaccuucauguauuugaagugacuccauuauaauuguuuuuagcagcagcauccaggcagcaacuuuucuagcaauaacuaauuuuuggaaggugugaguuauccauucaguaacucuggugguugguuuggucugggaggaaggagaggcggaaagacgagaugguuagcugugcuauucuuagcugaguuuccuuuaucaacuguugccucugauucaagcuuccagagucauaagacaggagguggcagugugguagcaaugaccaagggguaggauugguauucuuaguuaagaucucagccccauaaaucugauguuacaaauuggcuuggauugccagaauuuugcuugaaggcugauggcaagcauacauaguuuugaguguuccauuaaaauuaaggguguaauguaucauggucugaaauugcuguuuggcaaguauucaguauugguaaauaaacacaguucuaaauauugacauauucugugaauuuuguugcccugaaggggacuacuuuguaguacauaaacuauagauauuuuagagaauuauccugagaccauauaacuugauuaggaaauaguuuaaaguuauuguagaaauauccuugggccaggcgagguggcucacaccuguaaucccagcacuuugggaggccgagguggguggaucacgaggucaggagaucgagaccauccuggcuaacacggugaaaccccgucucuacuaaaaauacaaaaaaauuaaccgggcgugguggcggucgccuuuagucccagcuacgcgguaggcugaggcaggagaauggcgugaaccugggaggcggagcuuacagugagcugagaucgcgcuacugcacuccagccugggugacagagcaagacuccgucucaaaaaaaaaaaaaaagaaauauucuuagaggaaucuauugaacuauaagcugaaaggagccuaagucuuuagaaugucuggcauuauugcauuauuauuaguuguugagggagcugauucuauugugguuaugguauaucaguuaucuauugcugcauaagcaaaccaccccaaaacuuaguggcucagagcaauuuauucuuucucauucugugucuguuagguggugguuucugauccacaugugccacucagguccauuacuaaacugggcuaaaaggaccagggaaucuuugcugauguaacuggccguccuuguaaccuuucuccaaaugauaccuuauuguucagaagaagcuggaguuuuuuuuuccuggcagaguugacugaucuuacccuaagugaaaauggaagcugcuagucuucuuaaaggcugggcucagaauuggcacauuacuucugucacauucuauugauuaaggcaagucaucaggcuagcucagauucaggggagauauggaaauagacuccaucuuuaguugguagaguggcaugcauguaccgagagaggaauugaugguggcuaucuuuguaugucaucuuccacaaauugaaggaaggguggaguagugguuucaaaaugcuugcaacagaaaauaccugaaaauugcauuuagcacaguuguaauauuccggcaggagaugauauguuacuagcuuuggagguaaugaguaguggcuauucucuguauagcuguaaggaacagccaacaggauuugcugauggauuagcugaggaguaucagaaaagugaagaauugcaagauuuuuuggccagagcaacuggguggaagauggugccauuuaccaaaauggagaauauugggagaggagcagauucuuggguagaaaauaggaacuuugguuuugauaugguguuucuaauacuuacuagaaauuuaagugaagaagguuaguaggcagauauaucaauuuggagcucagggggagaugggacauagaagugacauuuggagacuucauuagcuuguggcauuugaaaccauggaauuggacaugaucaucaagggacugagccuauggcuguaggaugaaggaaagaccagcaaaggagggugaggaaggacaguaaaguagaagaaagcaagcagggcaaacuguuucugggagauaaaugaagaaagccuguggagaaggaggguguaaucagcuguguagaauaccaccgagagugauguagauggaugaauaagugagugagggugguguuaaaucucggccuggcucugcuguaaauagaaggagaacgauuuacaaauuuuggagcaaccugggauguaaccuuucuuucagaauucauuuauucaauuuuuguucacuuucuuaguuuuuuauuuauuuauuuauuugagauagaaucuugcucuguugacaggcuggaguacaguggugcgaucuuggcucacugcagccuccgccucccggguucaagagguccuccugccacagccucccaaguagcugggacuacaggugcgcaccaccaugcccaguugauuuuuguaguuuuuaguagaggcaggguuucaccauguuggccagaauggucuugaaccccugaccucaggugauccaccugucucggccucccaaaguguugggauuacaggcgugagccacugugccuggcauuuucuuaguuucuagaaauaucugaguacuuauguauauguuagagauggaagaaucuccucaguagauccucugacucaauggacaaggcuugucugugacaaaugacgauugaucuacucuuuuuuuuuuuuugagauggaguuucacucuugucacccaggcuggagugcaguggcgaucuuggcucacuugcaaccucugccuccugaguucaagugauucuccugcuucagccucuugaauagcugggauuacaggcacccgccaccaugccuggcugauuuuuuuuuguauauuuaguagagacaggguuucaccauguuagccagguuggucuugaacucauaacuucagguaaucugcccaccucagccucccaaagugcugggacuaccgcuccuggccaguugaucuacucuugcacuuuuuuaacauuucuggugagugugagcucacuuucguuuuuguuuuuuuuuuuuuuuuuugaggcagggucucgcacgguugcccaggcuggagugcagugaucacagguguagacuacaggcaccuacaggcacaugccuccucgucuggcuaauuuuuuuuuuaauuuuuaguagagacgaugucuugcuguguuacuuagguuagucuugaacuccuuggcucaagcgguccucccacuuuggccucccaaagugcugggauuacagacgugaacuacugugccuggccuucacuuucuuacaaauucauucugcuuucuuauuaacauaacauugggaaaauugucugaaccuaucuuagguuccaaaagaguguagaccaaguccaguucuucuucuuuuuucgagucagaaucucacuuuguugcccaggcugaagugcaaugguaugaucucagcucacugcaaccuccuccucucagguucaagugauucuccugccucagccucccgaguaacugagauuacaggcgcacaccaccacacccagcuaauuuuuguauuuuuaguagagaugggguuucaccauguuggccaggcuggucucgaacuccugaccuugugauuugcccaccucggccucccaaagugcuggaauuacaggcuugagucaccgcaccuggccccaaguccaguucuuccaaaugguggucuaaaugcgugauuugacaagcagagguugaaacuguuggccaaaacguuuauggauaucaugagccagguuuaaaauaccuuuaccugguuauuuuagggcacuggcauaaauuaaguauuccuuccauuuuguucauuaaacuuuugcuaaaagaaauagaagaaaucuuuugggaggagcuaaauucccucauuuuuacauuuaaaaaaaucugguccuugguaaaguagcauguuuccccaauuaugaauccugucuuuggucacaauagugaccaaaacuauuaaucaaaaacugggugauauguuagaucaguugauuuugagauaggggacuuguucugaauaacuccuuucgagacuuuucugcugucuaugcaaguccuuugaucaauagaguacuacuuccaggauguauuuaaauauuauaagaaaggaaaacuaauaaaaaugagauagcacaguagaugcuuuaccaaaggauucuccauagaacccugggagaagcaaccugccuaaggcccuccagauaaucaugggaacccauugccaccugcugcaacucugccugacuucaucccucccauuuaaguuguccaaauccucaaaguagcuugcacaggagcccaaucauguuugcaguggcaagucagagcagagauguccuauuucuugccuucucuaaguacagaaauccuguuuggcuuuuuugaaggguugauuuaucuucuuuauuuaggaaaaagacuaguauacagguagucugugccccagggcuuauuguagaauaaaaacauggauauccuguuuuaagacagaaaaaugagacuuuuuuuguuucaauguguuuuuuaguagcuucaucuuaauauaaguggcuugcggagaaguuggagaggggccuaaagagauaggagguuagagcagagggcauggggagguagaugucacggcuuugucucaggaggcugauugugguuccuggggauauguucuuagauugcaagagguagagguaucuggaguggaguccacggugucugucugucucagcuuguuagcaaguuuuguaugacccugacaugcagaaaaaaaugucuugaaugugagauacugcugaggaacaggagaguaggaaggagaaacuaugcugaaaccucucggugaggagacugguugcuugccacaugugucuuuguugaacugaagggaaaagccaggaggaugugggauaugaggucuagaucugggcuuguuuugugggauaugaggucuagaucugggcuugauuuccagcuccacuuacuaaaugcaugcuguagcuugaggaugaggaauuugaggucuugggaaguuagaauggacaugaugcuucauaggauccuguuggacaauguguguaaaggaugaauacaacgucacccaguagucauuccaauggaagccguuguauuuuucuccuugagauucagauggggaagcuggauggauguaaauagauuugauggugauaacagaaacauggaagaucuuuguucucuuuugggauguggacucaaguaauaaucugcaggugguguguuuuuaauuuacaaugagcauguauuaccuuuuuuguucagauacaacauagauacaacagauuguauaaauauuaaacagguugauaauuuuuacauaugugcacauucagauuaauucaaaauacauaaaauguggaaaauguuuuucaauccucacucucucuaguaguucccagggcuugcuuacacucguugcugaauauauuuucuagaagcucuaugcauguguccacagacaucuuugaauauaguaaugaaaucauacuguuuauaauuugugcuuuuacuaaauaauguauccugaagaaucuucaauguagguacaaauaguucucuuuuguaaccaacagaugcauuguucagcauaggugugcaauaauuuagccauccuuuucauaguaacuuuauucaaguguaccuacguguaugccaucagacuucuuguugagaaguuuaaaaaaaauuuuuuuuuuuuugaaacagggucuuggucucgcccaggcuggagugcaguggcgcgaucucugcucacugaaaccuccaccugccggguucaagggauucucaugcuucagccuccugagcagcugggauuacaggugugugccaccacacccggcuaauuuuuguauuuuuugguagagacggaguuuugccauguuggccaggcuggucucugaacuccugaccucaagugauccuccugccuuagccucccaaagugcugggaguacugagugagucaucgcacucagccccugguugagaauuuuuauaacguaaauucuuaaacugggaauuguuaugucaaaagauguggacauuuaaauuugaaagcucucugaaaaaccuaaaacuaaauuucuucuuuguuuuuguuuuuguuuuuugagacagagucuugcucugucgacugggcuggagugcaguggcgcgauuuuggcucacugcaaccuccgccucccgguuucaagggauucuccugccucagccucccgaguagcugcgacuaugggcgcgugccacuacgcccagcuaauuuuuguauuuuuaguagagacgggguucaccauauugguuggccaggauggucucgaucucgaccucgugauccccucgccgcggccucccaaagugcugggauuacgggcgugagccacugcgccuggccucaaaacuaaauuucuuauguugacauaauuaguuauaaguuugacaacaaagagcuucuuucaaugaagugugcagugagaccguuugaguaagaacugucucaucaaacauggaggacuauauaauuguaggaacacacucuucuaccauggaugugcuaacucugacaagucuuugcccauuucauuugugccccuuguauauaaaaauuaaguaaaaagcuguaaagcugaaguucugauaccuuauagcuaagaugucuaggacucaugcucucccguacuuagcaccuuaaauuuugcauccuacuucagaaacuaacaguaguuucuugcggaggaaacuucaagaagguccacauuuugaggaggaauuugauuaagaauuagcuuccaaaagaaggugcuacucagcuuuuggucccagcagggcagauaaugagagaaucuaguuaagagaaccugugguaauagugguuaaaaaaacaacaaaaaaaaugcugguugaaaagugacugagcucuccccagaugucuuuuuuuuuuuuccagcugguuuugcaaaaaauggagaagcucuugcucuuucuuuggagaguuaaguugaaauuuuuaguuucuguauuucuuguaugcgaguuuaccuauuuuugcauuuuuuugaguuucugaaaugacuuaauaucuuauguaaauuuuuaguuuaacaagcauagauuaagugccugugcucauaguugauucuaugcuagguuucaggggcuagaaagaagaguaagacccugccgggcgcaguggcucaugccuguaaucccagcacuuucggagccagaggcggguggaucacgagaucaggagauugagaccauccuggcuaauacagugaaaccccgucucuacuaaaaauacaaaaaauuauccgggcguuguggcgggcgccuguagucccaguuacucaggaggcugaggcaggagaguggcucgaauccgggaggcggagcuugcagugagucgacaucgcgccaccgcacuccagccugggcaacagagggagacuccgucuccaaaaaaaauaguaagacccuuguccugaagaaagacauggaguacaguggcuuucacuuuguucugucugauuuccugggugacagucuuuuuauuuuucaacaguaauggugguucacugugguagugauccuaaagguggguuaaaaucucuccaaguaaagagaaguugucaauaugucauaggguauaugugagaugccccagaacauaggaggagggagcauuauuaggcuuagccugguuguuaccagugagaaauacauucagagagggaugugaaaauaggcagaggcuaauaaccgugugcacccaggagggaagaggcagaagggacagcaggagccaccucauguaagugugaaacauccuggggugugugugggaacuacaagcuguuugagauuaaagaggcuggagugugaggcaggauggugauugaggcugagcggagagggcagcuggagcagccugcgugcgugauggagugacugcauuauucucauucuucauguguuugacuuuaggagcuaaguaguuuaguucaugccauuuagcaaaugcugauuugggauuaucauggaagacugaugccuagguuaauuuuggaaaaugcucaccagagaucccacugaacuuuugcgucuucaguacuuuauaagcaugggucuggcuaugcucccaaaacauuucauggaguucacagcuguucuuaggguauccucugacaggguaauuaaggcaaauugugauacaggacuaggaaucuuauaauaagguugacugagcccauguaauuuuuuuaagguuagcuguggcaagacaaucaauggugcugguuaaagcuccugguauuauaugauuuuuguuaaagacaucccaagugauguaaugaaccuuuggagaaaaaugugauagacacuucugugugcacguacuacuaccuaaaguuggggacagcaguacagcacagugguaagggugggccaguggcaucuugcuuggagcuacacaggccucaguaggaaccuuugcuuagcccugugaucuugugcaaacugauuaaacucugagauuucuguuuuuaaaaucuguaaaugaggguaauaagaccuauggcagaggguuguugggaauuaaaugauaaugucuguaaaggacuucuuggauuaucugguacuaaagugauauugucucacuaauaaguuuguguguuuaccaugugguaguggaaaaugggggaugggugugccuauucccguaugaccccgugguuuaugguuuauguuucauauauacggagacauaggaguguuucacauuucuuuguaaaauauggguuaugcacugugaauaaguuaagaauuggugcuuuauaucuaggugcauggaucuuagaaucccuaaaauguguuuaguuauggaauuaucuuaggagagaucauacguaaaggaaauaauagaccaggagaugaauuccuaauuccaaagagguagaaacaguauaaaaaugaacgaaggaugagaaguggcaguucagaagggcacagcugaaaagucagucuguguacaaaaagauauccaaucuaggcugggcacggugguucaugccuguaaucccagcacuuggaugaaucgcuugagcucaggaguuugagaccaggcugggcaacauggcgaaaccccgucccugcaaaaaauaacaaaaauuagccaggcaugguggugcgugccuguagucccagcuaacuggggggcugaggcagggggauggcuugagcccagguuugcaccacugcauuccaagcugggcgauagagugagauccuauuucaaagaacaacaacagcaaaacaaacaaaaaaaacacccuugucuaacuaguuauuagggaagugccaacgauaaugacauuuucugccuaugagguuggagaaaaaugaauaagauuggccguaucugguguuggcaagguuguggaggcauggccacucauauagcuaaagaguaaauuggcaaagacuucuuggcacacuauuuggcaguaucuauuagaacuuaaaaugagaauaccuuucaacuaaguguuauggaaaacaacccaguccucauggcuuuguguaaucuguaagcacaguuuuaaucagcaauaucguacaauauuguaaaagagcuccauccaaaucgccaagcaggaauugguaaaaagggucucuaguaggugggagucuguaaaacacagaauucuuagguuauacuauauuacacgucacauuuuaacaguaucguacagauaaucugaaacuaacacuguugucuacuuuucgagcaaaaaagaucucuagcucuaauuuuacuguuugggacauuuugcaauugccuaucuuugaguuguagaaggggaauuuuuguaaaggaagacaauacugagaguccuuccuuuuuucuucuuguuuaaaagugcuuuaaggccaaggugcuuggcucauacuuguaauuccagcacuuugggagaccauccuggguaacacagcaagaacccauguuuauuuguauuuuguuuguuuguuuguuugagacggagucucgcucugucacccaggcugaagugcaguggcgcgaucucggcucacugcaaccuuucugcucgcuacaaccuccgccugcuggguaagggauucucgugccucagccuccagaguagcugggacuacaggugugcgccaucaugcccagcuaauuuuuguauuuuuaguagagaugggguuuuaccauguuggccaggauggucucgaucuccugaccucguuaucugccugccucggccucccaaagugcugggauuauaggugugagccacugcgcccagcccugugcgccccccacuuuuuuuuuuuuuuuugagaugagucucgcacuguugcccaggcuggagugcaauggcacgaucucggcucacugcaaccuccgccuccuggguucaagcgauucuccugccuuagccucccgaguagcugggauuacaggugcccaccacuugcccagcuaauuuuuuguauuuuuaauagagaugggguuucaccauguuggccaggcuggucuugaacuccugaccucgugauucacccgucucagccucccaaaguguuaggauuacaggcaugagccaccacgccugggggaacccauguuuuaaagggaaagaauaagcacuuuaauguucaacuauuuguaacuuugaggcauguuuaauuccuuucuccauaacagcaauuucacuuguaguauucuauuacaaagacauacuuggcaaaaagacauguguuuuuuccauauuguuuaauaguuaaaaauaggaaauaaccuaaauggccaucaaaagaaaacauacccuauucuggccaggugcgguggcucacgccuguaauuccagcacuugaggaggcugaggcaggcggaucacgagguuaggagauugagaccauccuggcuaacacggugaaaccccaucucuacuaaaaacacaaaaaauuagcugggcgugguggcgggcgccuguagucccagcuacucaggaggcugaggcaagagaauggcguggacccaggaagcggagcuugcagugagcugauaucacgccacugugcuccagccuuggugacagcgggagacuccaucucaaaaaauaaaaaauaaauaaaaaaaaaaaaggaaaaaagaaaacauacccuauucuaaccauauauuccuuuuuuuuuuuuuuaucuugcucugucgcccaggcuggagugcagugguguaaucuuggcucacugcagccucugccucccguguucaagugauucuccugccucagccuccugaguagcugagauuauaggcgccugccuccauacuaggcuaauuuuuguauuuucaguaggacaggguuucacuacguuggccaggcuggucucgagcuccugaccucaaaugaucugcuugccucggccucccaagguguugugaauacaggcgugagccaccgugcccagcccuaacgauauauucuguggcauauuuuguagcaguuauaaggaaugauagaggucuguuuuguuuuguuuuugagauggagguuagcuguuguugcucaagguggaauucaauggugcaaucucaucucacugcaaccuccaccuccuggguucaagcgauucuccugccucagccuccuggaaugauagggguuuuauaaaaaacccauuacauguuaucauaaaauuuuaaauaaaaaacucuuuuuugagacagagucuugcucuguugcccaggcuggagugcagugaugcaaucucagcucacugcagccuccgcuucuggguucaagcgauucuccugccucagccucccgaguagcugggacuacaggcaugcaccaccacaccugacuaguuuuuguauuuuuaguagagaccagguuucaccauguuggccaggcuguucucaaaccccugaccucaagugauccgcccaccucagccucccaaaguacugggauuagagguaugagccacugcgucuggcccuaaaacacucuuauaaaagagaacuguuuuucauuuuuguaaguuucuuuggccuaagaggcaacuggaaacugguaacuacuacugcauucaguuugucgucauguauuguuuugauugaaguauaugaggaaaauccagccacauauggauauguguuuagaaaaggaaggaguauaaauaauuacagauauucuuuggugcuacaucaaaauaugacaagugguaguuaaaaaaaaauuccuuuuuaaauuuaaauugagacaggaucucacuauguugugcagacuggucuugaucuccugggcuucaagugauccuugugccuuggccuccccaaaguguugggauuacaggcgugagccacugcacccagcuacaagugguagcuuuuuugcggaggugcgggggugggggcuuacugguaaagaccggaaaaccaccugcuggacaaauucuaaaagagcuguaacaccaagugguaguuuuuuuaaagucuaguuucaauguggaaucugaaaucauaucagugaauuuuuuuuguacuuguuacaaaaagaauccauugauugucuuauacucggaaaggaucuuuauccacgaggauugggaggcugucaaagcucauugguaauagauagaaguuuuucaaaauacuaguuuuuacuuaaaagcucaaauuuagucauuuggcaacagauacuucaggaaaaucguuuuaccugaagugacagacucauuuuauuccuuuuugagaaaauaucugccagauacucaaguuuuuaaguaacuacauuuugcuucuaguucuucagguagaaacggugcuugacugguucgucuugcaacucaaacaacugcacagugcuuuuugugcagacaaccaggauagguagcagaagugcuuuaugcaugcuucccuuuucuucauacagaucauaaaaggauguauacugaaggauugagauuaggacauuuuuaaacaguuugcauaauucuucgcugcaaaugccagagaagaauacagugacuacuaguacaguucagugccacugcauugcuucaugcuaaggaccagcagcuuuacucaucauugccuuugcucuaccagugcaaauacaacacagcagaaaaggcaaauaacaucuuaguguuauuaggaaaauagucuuaacuucuuggaccuccugaaagugugucagggauuccuuauaccauacuuugagaauggcugcucugcucuaaugugugguuugaaauuagaucagguggcugggugugauggcucaugccuuucacaugaacuuugggaggcugagguagccacauggaucacuugaggucgggaguucgagaccagccuggccaauagaguuaaaccacccccgucucuacuaaaaacacaaaaaaugagcggggugugguagcgcauaccuguggucccagcuacucaggaggcugaggcacgagaaucccuucagccugggaggcggagguuugcagugacccaagauugcgccacugcacuccagccagggcgacagagugagacucucucaaaaaaaaaaaaaaaaaaaaaagaaaaagaaaaaggaaaaaaaauuguaucagguauuuuuuuagacggagucucgcugugucccaggcuggagugcaguggcgcuaucucggcucacugcaagcucugccucccgguuucaugccauuuuccugccucagccuuccgaguagcuggaacuacagacgcccaccaccacacccggcuaauuuuuuguauuuuuaguagagacgggguuucaccguguuagccaggauggucgcgaucucuugacuucgugaucugcccgccucggucucccaaagugcugggauuucaggcaugagccaccacgcccggccuguaucagguauucuggugaauauguauuuacaucauaacaagagcaagugaggauuuuaugcaauuccauggcauauuagccuugauagggaagucaguuuggaaaaaaaaaaaagauaauaaaucgguauaggaagauaagcaaaugaaaaaaugucaaauucuaaacaaaaagaagaaaaaucuaagugcaugaaagauaaaauauugccaggugugaugucucacgcuuguaaucccagcgcuuugggaaacugcagcccagaggauugcuugagcccaggaguucaagacaggguggguggcuggaugcaguggcucaugccuguaauuccagaacuuugggaggccaaggcgggcagaucacuuuaggucaggagaucgagaccagcuugaccaacauggugaaaccccaucucuacuaaaaauacaaaaaaauuagccaggugugguguuguggccuguggucccagcuccucaggaggcugaggcaugagaaucguuugaacccaggagguggaggcugcacugagcugagaucagguuacugcacuccagccugggugauagaacgagacucugccucaaaaaaacaaacaaacaaacaaacaaacaaacagccugggcaacauagugagacccucaucucuacaaaaaauaaaaaauuagcugagugugauggugcaugccuguagucccagcuacuugggaggcugaggugggaagauugcuugagcccagugagcugcagugagcugugguugugcuacgcccuccagccugagcaacagagugagauccugucucuaaaauguauuuuugaaaagauaaguguuuagaauaaacaguuaaggacugcugaaaacaaguacacaugaggaggaugaaaugaauuuggacaucugggcaucuaucgauacacuuaaguucuucaaacugaaaugaacccuacauguugauaccaggucgugccuaaggaaaugaauagcauuuguuuccuucuguuauuccuaaaacuuuaacaaaaucuaauaaugauuucaggaccccaucaacauuucuucugacaguuuacauuuugaggcuggaaccuuguggucacucacuguauuuuuaaggaugaccaaauggagaguccggccucugacauguuucagacagcuuuccuugcccuggguaaauauuaguuaaauguaaaaaauaacuggcugacuuuuaucacuggauagguucuugucuuuuuuuauuuuuauuuuuuagccagucuugcucugucacucaggcuggagagcagugcugugaccauggcucacugcaacucgaacuccuggacucaagggauccucccaccucagucuccugaguagccaaaacuacaggcacacaccaucaugccuggcuaauuuuuaaauuuuauuuguagaaacaggaucucacuguuuugcccaggcuggucucgaacuccugagcucagguagaucugccugccaaauuccagccuccccaagugcugagauugcuggugugagucccuaugcccagccuguuuggucucuuuuaaucugggacaguuccuuggucuucauuuuuuuguuguuguuguuuuuuucugagacagagucuugcucuguugucuaggcuggacugcaguggugggaucucggcuggcugcaaccuccgcacccagguucaagcaauucucauuccucagccucccgaguagcugggauuacaggcacacaccccaugccuggcuaauuuuuuuguauuuuuaguagagacgggauuuuaccauguuggccaggcuggugucagacuccuggccccaagugaucuaccugccuuggccuccuaagugcugggauuacaggcaugagcgaccuguaauccuucauuugauuuaaugacuuuccuguuuuugaggaguauaagcuaguuuuuuguuuguuuguuuauuuuguggaaugccccucaauguggguuuaucugaugucucccaugguuagcaucaggugaggcugugugugugugugucagucagagucuuacucugucgaccaggcuggagugcaguggcgcgaucucggcucacugcauccucugccucccggguucaagugauucucccucagccucccaaguagcugggauuacaggugcccgccacugcacuugacuaauuuuuuguauuuuuaguagagaugagguuucaccauguugggcaggcugggcuugaacuccugaccucaagugauccuccugccucagccuccgaaagugcuaggauuacaggcaugagccaccgugccuggcaccaggugaggcauuuuugauggaauuccucagaagugauauugcuuucagugcaccucaucuagaggcacaugguguuuguugauuuuuguuucaguaguggugguaacuuugaccaauugguuaaguagugucugccaggcuucuucaggguaaaguuacuauuuuuucuuuuguaauaagaacuuuguggggagauauuuugagacaauguagagauucugucucucaauacuuucacuaauuuuagcauccauugaugauucuugucagcaacugucacugcuacuauaguggcugucaaauaguggcuuucuacuucucuuuauuuuuucuacauuuauuauuuguuuuuuauuuuguucaagauggagucuugcucugucgcccaggcagcagugcaguggugcgaucucggcucacugccaccucugccuccuggguucaagugauucuccugccucccgaauagcugggauuucaggugcccgccaccaugcccagcuaauuuuuuguauuuuuaguagagaugagguuucaccauguuggccaggcuggucucaaacuccugacuucggguaauccacccaccuuggucucccaaagugcugggauuacauaaagguaugagccaccacacugggcaucuacauuuauuauuuggaauaaacuuuacuuuccccaauuuacuuuguuuauauuaauauuagacucauggaaucuuauugcauagauuauaacauguuacaguuguuauuuuguugcucagacuauggaagugagguuuuuuaaaggcaaguguauuaacguggugguauucugaaggcaaugauucagcacagagggaaagaugauuaugaccaucuaauguccaaagauuaugaucaucuaauuucaaagaugaaaucuuugcuugugcuucauuuuauuuuuucuuuuaauuuguuuugugcuucauuuuagacgagcagcuuuauacuuacuacagacuuaucuaccuaaauguaauaaaucuaauacuuuucuggggauaucuuacaacuaguggaaauaaggucauucuucauauacaugaugcauugccuuaaauucagauacugcccucuacuuaaacauaacuauuguauguuguguaugucacuuaugguaauuguuaaucaccugcagguuauuuuuuccauaccagucuaacuuuagcucaugaucaugcauuuuuccccagucucuggcauuuugaugugcuaucuauaacaauauugguaaagcauuguuacacgcuucuucaguguuccuauuuauucuuaggucucuugaugaauaauguacauaccgaaacaaaucuaauggaaucuuaagcuauuuucuguguacaaaacacccacaggaacuaaguaaaaguaguuuuacuuagucauacuaaguaauacucuauaguguauacgaaacacccguaggaacuaaguaauacuuaguuacacuguauacaaaacacccacaggaacuaaguaaaagcaguuuuacuuagucauacuaaauaauacucuauaguguauacgaaacacccauaggaacuaaguaauacuuaguuacacuguauacaaaacacccacaggaacuaaguaaaaguaguuuucucuaaauuaauuaaaaagcuuggaagguuuuagaaaaacagugcacauggcaaaauuuaaaugauacuuuauuuuucuccuuccucaaaugcaacuacugugcaguuuauuguguuccuuuagggaaaauuuacauguauaugugagcaucugugaauguaugcuuuuuuagaaaaaauacgacuuagcaccauaccuuacuguuuuguuuuauuuauuguuguuuuuuagagacagggucucacucugccgcccaggcuggaaugcagugguauaaucauagcucagugcagccucuaaauucuggauggaaguaauccuuccaccuuagcuuccugaggagcugagaccacaccugauuaauggcuuucuuuuuaaauuuuuaguagagaugggaacucuauguugcucaaacuggucaccaacuccuggcuuugaguguuccuccuccuucggccucagauugcugggauuacuggcaugagccaccgaacccaacuaccucacuguuuuaaaaagcaauuuuuuuuuuuuuuuuuuuuuuugagacagagucuugcucugucacccaggcuggagugcaguguugcaaucugagcccacugcacccuccaccucccagguucaagcgauucucgugccucagccucccaaguagcugggauuaccagcacuuaccaccaugcucagcuaauuuucguauuuuuuaguagagauggggguuucaccaugauggccaggauggucuugaacuccuggccucaagugauccauuugcuuuggccucccaaagugcugggauuacaggugugagcccccgcaccugaccuaaaaagcaauuuuaaagguucuuuggaaggugggauagggaauaauugcaguaaagugauauguuaaauacuauuaaaguaguggacuugauuuaggaguaaaguauauucacccauauguaggucaauaauacauuauaaccuauuuaaacaucuugucauuaauaggauauuaauaauaucuuagguuucauuauuguacuuguuaaagauuuuucugauauucaggaaacuccagcaugugguuuaccccaauuaugauggaaagaagaaauguguugugcaauguuuaaccaaaaauaaaaaaagaacaaaacccccaaaccucugaaaaccucagagcagucuuuuuaaauagcauaugcacaacacauuguauuaacuggaacuuguucagugcucuaaauuuaauucuaaugguguuuuuuuuguuuuguauuuuguuuuuugagacgaagucucccucuguuucccaggcagaagugcaguggcgcgaucucagcucacugcauccuccgccuccuggguucaagcgauucuccugccucagccuccugaguagcugggauuacaggcgugugccaccaugccuggcuaauuuucuguauuuuuaguagagacgggguuucaccguguuagccaggauggucucaaucuccugaccucgugauccacccuccuuggccucccaaagugcugagauuauaggcaugagccacugugcccagcccagaaaaucuuguauauuuuauuuuuuauuuuugcuuauuauuauuauuauuuuugagauggaaucucacucuguagcccaggcuggaaugugcaguggugugaucucagcucacugcaaccucugccuuccagguucaagagauuccccugccucagccucccaucccaaguagcugggauuacaggugcaugccaccacaccuggcuaauuuuuguguuuucaguagagaugggguuucccaauguuggccaggcuggucagcauggcgaaaccccgucucuacuaaaauauacaaaaauaggccagucgcgguggcucaugccuguaaucccagcacuuugggaggccgaggcaggugaaucaccugaggucgggaguucgagaccagccugaucaacaugaagaaacccugucucuacuaaaaauacaaaauuagcugggagugguggcgcaugccuguaaucucagcuacucuggaggcugaggcaggagaaucgcuugaaccugggaggcggaguuuacagugagccgagaucgcaccacugcacuggguguggugucaccagccugggugacagagcaagacacagucucaaaaaaaaaaaaaaaaaaaaaaaaaaaaucacuguaauguuuaaauauguagaucugauugauacgguuuacuuuugguuguggacgauuuguguuucaguauuaauauuuaacuuuuucaaaauaaguuuaauaacaguauaauuuaagauacugaaauuucacuaaacugcuuccaaaugguuugauuaaacauaaaauucuaguuaccugguuuuaugguacauuuuaauuugguuuacauacugccaccauaaaucucugaauuuaucaaaggacuagauggacauuuuaguaaaauaacaucaaaacauguaaaaugaauauuuauaaauuaaaauugaaacuguaacuccuuaaaaucuagagauugguauaugcaaagucugauuauaauauguuauuucuuguuauuuuaaaaaugaaaaaaacagacugggcucgguagcucaagccuguaaucccagcccuuugggaggcugaggugggugggucaccugaggucaggaguucgagaccagccugaccaacauggcgaaacccugucucuacugaaaauacaaaaauuagcugggcgugguagugggugccuguaaucccagcuacuccagaggcugaggcaggaggauugcuugaacccgggcgacggugguugcacugagcucagaucaggccacuguacuccagccugggugacagagcaagucuccaucuaaaaaaaacaaaacaaaaauggaauguuauucuauguuauugaccuugcauaaaaccuaagaugacauuaauccguuacacaacugauaaaucugccuuaagggauuacauuuuaauguuguugauguuugcaguuugauuuccauugcuuacuugaaauuucauuuucuuucaacuuauguuuugagcccugccaaugacaaccauuaugccuaggugcuagggagacagaaaagcauuaauuuacaauuuugaaagagaaaaauuaacuuuuuaaaaaaauuuucuugagacagaguuucacucuuguugcccaggcuggagugcaauggcaugaucuuggcugacugcagccucugccucccagguucaagugauucucaugccucagccucccgaguaggugggauuacaggcaugcaccaccacacccggcuaauuuuuuuguauuuuuaguagagacgggguuucuccuuguuggccaggcuggucucaaacucacgaccucaggugauccgcccgccucugccucccaaagugcugggauuaaaggcaugagccaccccgcccagccagaauaauuaacauuuuauaguaaucuuauucaauuuauaaacagauuuaugugaaugauacaaguauaauauuuuuaaccacugucauaauuggcagucacuuuaaaugcuuagcuggacugaguuuucacacucucugaguagguaauuugcaauuucugguagaggugggagcaguuaagguucugcaagucuuuuuuuuuuucccuaaaucuacagaauuuuaacauaugugucuuuuuuuuuuuuuuuuuuuuuuuuuuuuuuaagagauggagucucacucuuguccccaggcuggagugcaguggcacgaucucagcucacugcaaccucggccucccggguucaagcgauucuccugccucagccucccaaguagcuggaacuacaggcgugcaccaccaagcccagcuaauuuuuguauuuuuaguagagaugggguuucaccauguuggccaggauggucucgaucucuugaccucaugauccguccaccucggccucccaaagugcugggauuacaggugugaaccaccgugccuggucuuaacauaugugucuuuauuuuuugcagagaugugaucucacuauauugcccaggcuggucuugaacuccuggccucaagcgauccuuccaccuuaagaugugugucuuguuagaaguaaaucagaucuggugguuuugaugcuauuuauucagucucauaacugucaugacucugaauauauaggcucuugaaaugguagaccaaaaaauacuucaaguauauuauuugcuauucuuuucugcuuguaggauucugcaacuaauuuuuaaguuauuuauguguguaaagccuucccaagucccaggauaccuaaaguuguaaacauagggguaaauaacuauuuaaaugaugucugauagauaaaucuauagagaagggauucagaaucccaaaugcuugcaacugauauuguauucuuauguucaagguuuaaucgucaguagaguaggcuuaaauuuguuuauguauaugaugugggaccucuuagaaaaaagcuaaaacuuugacuuagguccuucuauagcccuaguagagccugcguaaaaauaaaaaugaccugauauguggacagguggcuggugguuagggguuguuggaguccuggugugccgcucccccaauagacaguaugucgggauagcuuauguuugcacuugauucuacuagucuguuucaggcaguuguuaaaguacuuggcuguguaacacauucuuaaagcuuacgcauuuccaaaacacugauuucaacauuuuuacaagguguuaaggcccaucccacuaaaguguaauacccuauacagauuguuaauaacagauuuaguuuaugaugauuuuucaaauuauaaagcuuuguuuugaaacagagucucucucuguugcccaggcuggagugcaguggcacgaucucggcucacugcaaccucugccuccuggguugaagugauucuccugucuuggccucugcaguaacugggauuaagggcacgugccaccaugcccagcuaauuuuuuuuuuuuuuuuugaaauaacuaaacaauuucugcucuguuguccaggcuggagugcaguggcacgaucuuggcucacugcaaccucugccuccuggguuccagugauucuccugccucagccucccgaguagcugggacugcaggcgcgugccaccacacccagcuaauuuuuuguauuuuuaguagagacgggguuucaccguauuagccaggauggucucgaucuccugaccucgugaucugcccaccucggccucccaaagugcugugauuacaggugugagccaccucccucaacuaauuguaaagcuuucaaaaaagagauagaagguuuggcagagaggaaagggccauuguaaauuuuugugguucuguuacagagaaagcccgagggcagguagaugugcucuagguacuguugagugugaguacuaugcaaaggugagagccauuuguuucuaucuuuggugcuuggugcucccacccaccucaguuucuuuguuuauguuaaauguuuugaccaauuauaucaacacuggaaaggagaccaagaguuuuucuuccuuugagagacuuguauccucugugagauugguugguuacguguuaaacucauagggguaguguguguuguguaaucacacugauuauaagcaugauaucacaaccuacauuaucauaagggacagaguuuaaacaugucuuuuuuuuuuuuuuuuuuuuuuugagacggagucucguugucucccaggcuggagugcaguggcacgaucuuggcucacugcaagcuccgcccccuacucacgccauucuccugccucagccucccaaguagcugggacuacaggcgcccgccaccacacccggcuaauuuuuuuuuuuuuguauuuuuaguaggugggguuucaccguguuagccaggauggucuugagaucuccugacuucaugaucugcccaccucggcgucccaaagugcugggauuacaggcgugagccaccgugcccggccaaacaugucacuuuuuauuuuauuuuuuauuuugaggcaaggucucuguccccagcccggagugcaauggugguaucauagcucauugcagccucaaacuccugggcuuaagggauucuuuugccucagccuucgaguagcuagggcuuacagguacaugucacugugcccagcuaguuuuaaaaauuuuuguugagaugaggucucacuucguugcccaggcuggucuuuagcuccuggacugaagugauucuacuucagccucccaaaauguuaggauuacaggugucagccaccaugccuggccuauaaacauguaacuuuuuaaauugaaauugaaaaauauguaacauuuuuaacaacuauaaugguggaaaguagaaucguuaaauuuuuuuuagcaucucagucuuaugaguuuauuaaguagauuuuacauuauugcuacuggaaaucugucaucuuuucugagaaaguaauuuaacuggaagugugacauaguuacugaaguuuuaaaggaccacaacuaggguuauuauaacuaaauuuauuuaacuaaauuuuuaaagauuauuuuaucagccuaacaaccauuauaagcgugugggguccuugaaaugacuucccaguagaaaggaauuaaaaaauuuuuuaaaaauagagucggucucacuguguugcccaggcuggucaaagggaacuucuugaaacaucauaugcauuggaucuuuugucaguuaguguacuuauuugucucauuuaccuuagauggugacugagguuggauauuugccuugaaaugaucuauguugaugugaccuugagucuucuuuauaaaauuuguauguggcccaguguaguggcuuggugguucaugccuguaauuccagcacuuugggaaugccaaggggggcagauuacuuaagcucaggaauucaagaccagccuggcuaacauggagaaaccucgucuuuacgaaaaauacaaaaauuagccaggcaugguggugggugccuguaaucucuugggagacugagacaggagaauuacuugaaccugggagguggagguugcagugagccgagaucguggcacugcacuucagccugggcaacagagugagacuccgucucaaaaaaauuaaaauuugaaaguaaguucgauaauuucuaguguuuccuccaggagauugggauucauguuguuauuauauugaacaauuuuccugaauaucuguguaagugaguuuuauuuacacagaagccaaauaguauucaucuaagauaaagguagacguagcauggacauugggagguaugaguuugaauuuggcuuuucguugacuugcguuuugacuuugguuaaaauaauccuuugaggcuguuuccuuaaucuguaaaaugggagucuuaaauugaccucacuuguuugguguaaggguacaguggaaauguauuucaaguacuugguauggcuuuacccauaaggagucacugaauaguuuuuuacuuuuguucucaauauuggugaaaucuuaaaguuuguuguuaaauugcaguuguggcagaaauaaucuggaaaugauuaagcuuccuauauguuaaugacuuuguuuugcuggcuagaagauguaacuuuucauguacagcagcuuuuuugcuucuaucagaauuggcauaaauaugaauugugcagaauugucuuaauguaacaaaggauuucauuuaaguggacaguccagauuguuuuauuuauuuauuuauuuauuuauuuauuuauuuauuuuugaaaugaagucucgcucuugucccccaggcuggaaugcaauggugccaucucggcucacugcaaccuccgccuccuggguuuaagcgauucuccugccucagcccccuaaguagcugggauuacaggugccugccaccaugccuggcuacuuuugguguuuuuaguagagauggggguuucaccaugugggccagacuggucuugaacugcugaccuuaggugauccacccaccucagccucccaaagugcugagauuacaggcaugagccaccaugccuggccgauaauuuuauuaauauacauuaaguuauagaacaaaguuuaaaaaguauccuauauuugcuuuuuuguuuuguuuuuuuugagacagggucugacucuaucgcccaggcuggagugcagucgcacgaucucagcucacugcagcaucugccuccaggguucaagcaauucuccugccucagcuuccuaaauagcugggacuacaggcgcacaccaccaccaugccuggcuaauuuuuguauuuuuaguagagacaggguuucacccaguuggccaggcuggucuugaacugcugaccucagguaauccacccgccuuggccucccaaagugcuaggauuacaggugugagccaccgggcccagccaauauccuauauuugaaguuauacuauaguuacugcagcaaaauaaauccaaauguacuuuccuaggcaaaggaaggacaucuaacacugucuaauguaacaaucuuagaaaauucuaguuuuuuugugguauaggaaauacuaauaucaucucagguuaugugcauggaaaguauuuaacaucucuuuacuaccagauagucauguaaaguuaaauuauauuuuucucuuaaaaauuccuucuucuggguacuaacaagcccagaguuugauuuuaauggaauuuaacauuugugucgauggugacuucuagauuuaagagaguagggaaaaacaguggaaauuuuaaaaguaccacagaggagauaaugguauaauaaauccuccuauacugaucaccuagcuucaagaaucaccaaaugaugacuggcuuugauucaucucugugccucaaugccacaccuccccaaauuauuucaaaacaaauugaagacagcaagcuuuuuacauuccuaauucuucagcauguaucucuaaaagacagacuuuuaaaaagcauagacauuaucauuacauauuaaaaaacaugacacuaacucacugguauuaaauauuccaauuuuccugauuaguuuuuuccauuguauuugaauugggauuuaaauaaguuucuuccauuaugauugguuaauaggucuuaaguuuguuuuacuuaaugucaaggauucccuccuccuuuuuucacuuugaaauuuauuuguuaaaaaauuuagauguuggccgggcauguggcucaugccuguucucccaguacuuugggaggccgaggcagguggaucacuugcggucaggaauuccagaccagccuggccaacaugguaaaaccccgucucuacuaaaaauacaguauuagccaggcaugguggcacacgccuguaauuccaaugacucaggaggcugaggcacaagaaucacuugaaccugggaaguggagguugcagugaccugagauugcaccacugcccuccagccugggcugcagagcgagacugucucaaaaaacaaacaaagacaaaaaggccaggcacaguggcucacgccuguaaucccagcacuuugggaggccgagguggguggaucaugaggucaggagaucgagaccauccuggccaacauggugaaaccucaucuuuacuaaaaauacaaaaaaauuagccgggcgugguggugggcgccuguaaucccagcuacucgggaggcugaagcaggagaaucgcuugaacccaggaggcggagguuguggugagcugugagaucaugccccugcacuccagccugggcgacagagcgagacuccgucucaaagaaaagaaaaaaaaaaaaacuuuagauguuugugcuggagaguuucccaggucuggauguugcugacaguguuucugugguguauuuuuauauguaauucuguucucagaagacaugauagggcuagagacuucaucauuuucaggauuuuuuuuuuuuuuuuuuuuuuuuuuuuugagacagagucuugcucugucgccugggcuggagugcaauggugcgaucuuuguucacugcaaccuccgccucccggguucaagcgauucuccugccucagccuccugaguagcugggacuacacguacccgccaccacaccuggcuaauuuuuguacuuuuaguagagaugggguuucaccauguuagccaggauggucucaucuccugaccucgugauccaccugccucggccucucaaagugcuaggauuacaggcaggagccaccacgccuggcccauuuucaggauuuuuguguuuaauuggcaaauaugucauaggugagaaaagggaaaauuuuaauacuuuggccaagguuuuauucauucaaggaaaugauggauuaaugugacugaguucaaauuugggaaaauacugauguaguuggggaagcauguugcacuuaagugaaaguuuuuuuuuaacuuguuuguccuuaagugugguaaacauaccuguucuaucucacuagaaggaaaaagagcuuaguaaucaggaacaauuugcugcuauuggagacugguaacguagcauugcauuugcauuguguuuucugcuaggagaaggguuaucuacaaagccuagugaaauuauaucuugggagaaaagaaagaguugaguuaccuaggaugaggaaugucaggcagaaauauuuagaucaaacuugucaaccuuuuguuuuguugauacauuggaguucucagagugcgugaaacugagaauucucauacugaguuucuugaacacaauuauuugcuuauuuucuuugccuacuuguagaaaacauuaaaaauggaaauauaaacaagucuggcuguguaagucuaccucugggaaacagucuucaagcuuugggguggugagauuauuauaguuucuaaaguugaugagaaggugguauaauuugauaaugaucaacugcaacuuucccacgaacaaaaacaaacccaaggaucugccuugucuaagaaccacauccacuuagcaguaauacgaaauaaaaacuguuaauguagacauaccccguauucaaaauacagugguuuuaaaaguuuaguaaucuuaaaacaccucuucuugcagguacaguuuuagugaugguuacuuuuauguggaaaauacguauuccauauaaaacuuuuucuuuuuuuuuuuuuuuuuaauuuuaauuuuuccagacagagucucacucugucucccaggcuggagugcaguggcacaaucuugucucacuguaaccucugccuuccagguuuaagcgauucucuugccccagccucccaaguagcugggauuacaggcacacgccuccgugaugcccggcuaauuuuuguauuuuuagcagagaugggcuuucgccauguuggccagacuggucuugaacucuugaucucagaugauccucccgccucggccucccaaagugcuggguuuauaggcauaagccacugugcccggccuaaaacuuuuucuugauuguucuucaaauucccuugacaaacaaauuaaauuuaaucaauuaguuuuagauaagcucuguucaauagaaauacaugaacuaaauauauaugauuuuaacuuuuuaguagccacauuaaguaaaacaaaggcccaguguggugaugugugccuguauccuagcugacugggaggcugaggugggagaauugcuugagcccaagagguugaggcugcagugagcuauggucgugccacuacaguuugggcgagagagcaaaaacccugucucaaaaaaaaaaaaaaaauuaguuauuauauacaaccuaauauaucuaaaauguaacaguauaauaaauuguugagaaauuuugcuuuuuuugguauugaaucuucaacaucuguauguauuuuauccuuacagaacgauucaauucagacuagccacauuucaaguaguuagacacauguggcuaguggcuucuuuauuggacagagcagcuuaagauguacgguuucuaaaaaucacuguuuaaaaauaucuuguugcugggaaaaaaauauaaugauauuuauaaaacuaguuuuagcuauggaaaaguaugggaauaauuaauuuucagugcuacucaagcauguuagagguuuuauauccaaguucuuuauuccuuucuuaccacucuaauuuuuuaggaagauaaguacaauuuacuauauuguguuaauauuaagacuuuugaaagagcuaugcuuuuaggucauacaggcagugaggcuuuuauuuaaauaguaacuguucaacugcguguguuucugugguuguaauacugguggugacuuuuuaguuuaaaggcacauauacaggcugggcgcaguggcucaugccuguaauccuagcaguuugguaggccgaggcaaguggauugcuugagcccaggaccagucugggcaacguggugaaaccacagcuuaugaaaaauacaaaaauuagcugggugcgguagcgcaugccuguagucccagcuacuugaggggcugaggcaggaggaucucaugaaccucggagguugaggcugcaaugggcagagaucaugccguuugcacuccagucugagcaacagagcaagacccucucuccaccaaaaaaaaaaaaaaauuaaaaaaugaagcacauuuacuuaguuaaaaucucaguaugaagacuauaaaaaucuuugguuauuuagggaucaaggauuaguuugugcccuguuuuuuuuguuuguuuguuuuuuuccuguuugacauucuacauuaagaugugcgugcccuucuaguagucacauuaagaaguaaaacaaaggcccagugugaugaugugugccuguaucaauugucuuucgaacaguguuagguuuuccuaacuugcacauguccuaaggaaguauaaaaacuuugacuauguuucuucaaggaacauuuaaucuucuaaaagaaagacauagcaguguguaaaugcaagcaaacaauaguaguaagagaguacguagaaaaacauucagucuuuuuuggacucuucuagugcauacucauggcgucagucaaguuuucauccaugcacgucuggcugucagacucuguucuacauagauggagauaacgugugcaaauguaaaagauaaaauauaccucuguuuuaguuaacgggacuaaaacauagcuguuaccauggagaucugggagcuggggauaauggaaaaaaccauguuuagauucucacuuagaacugugauguaaagagacuuuguucccuugcucauuguuuaaguaauauugaauaauugccugagaugagcuaagcaaucuguuaaccaguggaaugugcaacagugaauaaaacaaguaauuuugccuuugagacucgcccuguuaacuauaccacaguggccaccaauccauaagagagagagagaauguguguguguggguuggcgggggaggggccaaguuccccugccccacccccagaaauuacgauuuaagucuguuuuggggcccuggaaucugcauuuuaguuagucccuuguggugauucuaacauaggugguucucggaccauaauugaaggacaucucuuuauuuuacgguguaggggaccuuguaaucuuuuuuuuuucccccuuccuuccuccuguucaguucacuagaaucuggcauucuuuuuaacuguugcaggaaguaugcuuuucuuuaguguaccugugacccucuguuaauccacuagaugcaaugccaucuuucauagggauuuuugaccugggucuaccuguguuacuccuaaguuauguuuccuccuuuccacuuuuacagauacuuauuuaagacugaccuaaaguaucuaguuucuucugcuaaacuauaaaaucuauaggaauuuuauagggggauggagaacugaugucacagaacuaguuagaacuguuagaaucuagaauuguuuuccucuugguucauucugauauuaugcugcuggcuagaaacaauagcuuauuuuucccucaacaacuaguaaaguucauuuuauaaaacacaaaagcuagaagaaauggaaaacugcagaugauucuaccagccagugcucaucacggucaguaucguaaugcucucucuuccuuacuucuguuaauguucauguguauguguguauguacagauauguacauuuuguuccugguuggaauguucuuuuugugauaaaaccacguauuuuaaaaugagaucauauuccauguucucuuuuagugaugcacuuuuuucagugaacagugucauaagcgcaugucuucauuaaauauucuuucauauuuauaauaucuccaugagauuucauucuguguauuguaauugaaucccuuuuuccuggaccucuaaguucuuccuaguucucccuauuuacagacagcuaagccuuugagcguguuacaacuuuaccuaaggaaaugauguaagaaagauaauucuugaguuagaggauaagacacugccaagucagcaaugaggcagaguuaugccaguugacauauagaccaggaauguaagacugaucauuuucccaaguauuugcuuggaguacaguauuaaacuucuugaaaauugagguugaccuuuuaaagagcugauucuuaacuguauaaaccaagaaagaauagguguaauuacaguauagccauauugaaauuagccaggcugaaugaaguccucuuuggacauagguuuaguucggcacagcuggaaugaaaauuugcagccgguacagagugccaccaaguggcggguuggaaagcccaugcuagacugcuuugagccauaaggcuuggcuuuuuacuugaaaauaccaguccaaauccgaaccuuguguuccaguuuuuuugcauaagaaauaaggcagcugggcgcgguggcuccugccuguaaucccgccgaggcgggcggaucacgaggucaggaguucgagaccagccuggccagcauggugaaaccccgucucuacuaaaaauacaaaaaauuaacugggcaugguggcgcgcgccuguaaucccagcuacugaggaagcugaggcaggagaaucgcuugaacccgggagguggagguugcagugagccgagaucgugccacugcacuccagccugggugacagcgagauuccaucucaaaaaaaaaaaaaaaaagaggcaaagaagaacauguuacaaguuagacuugguuuucuccuucugucaucagcugguguuagcagcauuaugucaguaucugucuuauaaagcagggaagcagugauucccacuugauuuguauguaagcauugguagaaggaaggggcugagacagagccuuuuccagaggaauaaguuaaaggugcauccaggacuuacagguaauuuggaugaaagguugcaggucuaauacaguuuugugucuugcauugggacuugacuugauaugacuagcuucagaaguaccugaggugccuauguauauaaucuuuguaaugcuugagacaacugaguaguuguguuuuccucauaguugccuuuccucucuuccuucuuucuugguauuaauauguaagcuuguccacuuaauuucaauauugagucgccauauguaaguuauugugguuuaaagcuaagguguaaagggaaaauauugcuuaggauuagcauauauuuuuaucuuuugaauuucaugugcaaucuauacuuuuuugugaaguuauuugguaugguuaugcuguugguuggauuauaagugaaaucaguaagaccgacuagaguaugguuaggaggauagaaucuguggccagaaugcucaaauacauaugcugacccugccacacaguagcuguguguguauucagacaaauuaaauuacuucugccuuuguuuccuaaucuguaaaaugccaacucugaggguuaaaugagaaaauaaacauaaagcacuuuuuuggguucuuauuucuaucuuuugucagauuuuuuaguggaagaaaauaugcaaauauaagagacuuucugugaaauuccagucauccaaaaucugaguuggaaauaaucaguaugaacccaugguuuauuuucuuuccaaguguauuuucuagcucuggcuuggaagcaauaaccaaucuaaugagugccucuagugaccagauuguagucucucuguacuuuuucugacuaaaagggaucaaggauccaugcugauaaggcugauuauagaugggggcaagaaacauacaagcuaaaccuagaauaucacgucauaacagaaagcagaaaugcucacaaauauuauuggagucacaucaaaagaugaaggagcuaacaugaagaagccguuuugcuggccaaagaugggacaauuugagcaucaaaaaagauugauacaagcaaaauauguaugacucugaauuaauaaugauacugaaggaaugaaauauuugauugucuuugggcaaugucaggucccuaacauguuauucugaaaaauuugaaauaauaucuuuggacuccuuuuuuuuuuuuucccccuaaaaaaaagaaaaaaagaaaaagaggcuugcucuguugcugaggcuggagugcaguagcauagucauagcuuacuguagccucucaacuucgugggcccaagcgguuuucccaccucagccucccaaguagcugggacuacaaguauguaccaccauacccauuaauuuuuaaaaauauauauuauauauauauauuuuuuuuuucuuuuauacagcaucaaagagaagccaauaauauuuuuuucuuuuuuugagacggagucucucucugucgcccaggcuggagugcaguggugcgaucucagcucacuacaaccuccgccucccgaguucaagcgauucuccugccucagccuccugaguagcugggauuauaggcgcaugccaccaugcucggcuaauuuuuuguacuuuuuaguagagaugggguuucaccguguuagccaggauguucucaaucuccugaccucgugaucugccugccuuggccucccaaagugcugggauuacaggcaugagccauugcuucuggcuuuuuuuguuuuuugagauggagucucacucugucucuuaaggcgggagugcaguggcaugaucuuggcucacugcagccuccaccuccuggguucaagugauccuccugcuucagccuccuaaguagcugggauuacaggugcgugccaccacacccgguuaauuauuuuauuuuauuuuuuuugagauggugucucgcccugucacccaggcuggagugcaguggugcgaucucagcucacuacaaccuccgccuccuggguucaagcaauucucugccucagccuccugaguagcugggauuacagaugccggccaccaugcccagcuaauuuuuuauauuuuuaguagagaugggauuucaccaucuuggccaggcuggucuugaacuccugaccucgugagccacccuccucagccuccugaagugcugggauuacaggcgugagccacugugccuggccuaauuuuucuauuuuuaguagagaugggguuucaccauguuggccaggcuguucuugaacucuggaccucaggugauccacccaccuccgccuuccaaagugcugggauuacaggcgugagccaucacacccagcaaaauuuuuuaguuuuuaauuuuuuuguagagacgaggucucgcuauauugcccuggcaucaagcgauccuuccaccuuggucucccaaagugcugggauuacagaugugagccacugugcccagccuggacuccucuuaaagcagagauugaaacagggauuugccaaaguugguuuauuuuggagaugauuucaagaagaagugagggaaggggaagaaugaauuggggagugaggaaaagccaaugauagauacuuuauugaguuuccuauagggaaacgggaccuccaagaaauucacggaaugccucccagguuuaucuaucugaaaaauuggagcuuccugcccgcacccucauacaccuauauuuaugcaaguucuucuuaaggauuuugucuguccaguguuucugggcugcuccuguacucuagagacuuuggagaaagcccugagauaaagaagcagccuuguguaaggugugugcuuuuggguggaaagaagcgagacaacugaaaugugugugggauugauuguccaccacagcgaugagucaggugaugugauaaggagcacaaaaccaucugcugcagaagggaaagaauaaaguauuuauccugucuuuacuauacuuaguaugcuucagagcauccaaauauuugaugagggacacuuguucuuuauggaauaacucuggcuaaaaaacacagaaggcaugauagaaugagaaaaucaugguuuucaaccuugaaugaaauaguggguuuaggcagugaucacuaguagcugccaacaucauagaaagauaucagagguaacaacucccauggaaguacagaacacucccuauggaauauugccucucucaaauaugaaacaagagaaaccaaguugagccuuuggaucuaacuacaacuuuauagggaacagaggaauguauuaaacacuauuacaggagugucacuagcaaacuccagguagugagaaacucaaagacaaaugacagcauuuuagguuuuugguuuuuuauccaaauaaguugcaagaaaaaggguaacauuuagguuauaagacuagagucauaagcaaaugccacauauggaucuuaucugaauacugauuugaacauaccaguuguuaagaaagauauuuuuuaaucaggaaaauuugaguacugacuagauaguauuaaguuuugcucauuaaauuuuuuccccccaaccauuucuggcaauuuuggccccaccccccuuuuuuuuuuuuuuuuuuuugagacagaauuuugcucuuacugcccaggcuggagugcaauggcacggucucagcuugcugcagccucugaguucaagcgauucuccugccucagccucccaauuagcugggauuacaggccugugccaccaugccuggcuaauuuuuguauuuucaguacagauggguuuucacgauguuggccaggcuggucucaaacuccugaccucaggugaucugccugccuuggccucugaaaaugcugggauuacaggcgcgagccacugcacccagacaauuuuggucauuuuuaaggacugcuggcaccauuuugucuacuuuuuaaaagucaggguuuuuuuguuuguuuuuuuugagauaggaucucacccuguugcccaggcuggagugcagugguaccaccaccacucacugcagccucgaccucccuagggcucaguugauccuccugccucagccucccgaguagcugggacuacaagcaugcaccacuaugccaggcuaaaaaagucaguuuuagcagauaacuguuguaaaucaaagcaugagaauaaaaaauuaggggugauaauuauauucugggaggaggaggguugggggagaagcaugcaauuaucuucaauuaucuucuaauuauuggagguggguucauagaugucuuauauauauaaacaaauuauacauuauugaggccaaggcaggaggauugcuugaggccaggaguuccagaccagccuggggaauguagugagaccccaucucuacaaaaaauuuagcugggcaugguagcauaugccuguggucccagcuacucagaaggcugugaugguaggaucacuugagucccagagguuugagucugcagugaggugauuguaccacugcucuccagucugggcaauagagcaagauccuaucucuuagaaaaaauacauuauuauauaucuaauucuauguaguaaacaauuauuaaaaugauacaaaggggguugcagugaguaaaauccagaaugaguaaucauguaguauuuuaugacuuuggaccacuacauaaaugugaagaaaacagugaggggaaacucuuguauuaaauagaccuaagauuauauaucagcauaucaacuguaugcauauguauaucuuguuggcaucuugauacgaacaaaccucauguaaaaagauaguuauuagcaauuggaaauaaacacuuaguggauaucuaauaaugaggaauuuuugcuaaucacuucuaggagcaguaaugcuguugugguuauguugaaauaaagcuccuuauuuuucauuguuguuuacuggaguaguucagcauggcaugcuacguaagggggacuugguacagguguggguauagaauaaacaagaucagauuaucauacucguuaauugaaacaggugauggguauuuggaggcucacuuucucuaauuggugacaauuugaacauuucuauaaaaucaacuuaaaucaguuucaucgauuacuaaacaucuugaagaugcccuucagagucuacaugagcugcucuauuggcucuuaaaaauuaauuuuaauuuugauuuuuuuguagauaggcagggccgguguggggggucucauuuuguugcccaggguugucuggaacuccugguuucaggcaguucucccaaagugcuggguuuacaggcaugagcuacccugccgggccuaucauugacucuuucuuuugugauuaaacaugcuuuuaauaaauaaugauugaauuuucauaguaacuaauauuucuagcagagugggcaguuuuuaaauuguuuauuuuuauuuuuugagauggagucuugcuuugucgcccaggcuagagugcaguggugcgaucucggcucacugcaauguccgccuccugguucaggcgauucuccugccucagccucccgaguagcugagauuacaggugccugccacuacgcccagcuaauuuuuguauuuuuaguagagacgggguuucaccaucuuggccaagcuggucuugaacuccugaccuaaugauucccccgaccucagccucccaaagugcugggauuacaggcuugagccacugcgccuggccuuuaaauuuuuaaucuauuagccugagaacuaaaauuuaccguauuuccccucugguggggaacccuuaaacuguguugaaaaaaaaauuuuuuuguuugagauggagucucacucugucgccuaggcuggagugcaguggugcagucuuggcuaacugcaaccuccgucucccggguucaagcaauucugcugccucagccuccugaguagcugggauugcaggcgcauaccaccaugcccagcuaauuuuuauguuuuuaguagagacgagguuucaccauguugaucaggcuggucucgaacuucugaccucgugaucugccugccucggccucccaaagugcugggauuacaggcuuaagccacugugccuggccugaauuuuuaaaauuaaugcaaaugcuuaaauaauucaauauuuugggguuuuuguuuuuuuuuuccauucucaaaaauguguggcaguuguuuuucucggucccuuuauaagcuauaaggaaaucauuugaaauguuaguuucuggauagugguucugugagucuuucccccccuccaccauauaguguaacauuuuaacuaucaauugaaugcuuaucagaugccaagcacuguucaggcucugaaugcagcaacaaacaagauaaccuaauuagucccuguuguuauggagugugcauccuauguauuuauguauguuuuaggagauggugaaaugcuaauuuauuuucugauaguuauauugaacuuuaaugacuugguaauuaauaugauagaaacacucuauuaaaauaugaauaccuuuucuugacuuguaaguauuuagaaucaaacccaaauauaaacucauucucaaaucucagauggaacaugaccaaagaagcaguagaguauuuuaauuguguagcugacugagauagauuuuucuccaguucuuuccaugccagaaguuuguauuuaucugugcuggaugauuauaauucaugccuuugguucauucuuguuaauguugagacuuuuggcucuuguacugauaagagcagagcacgggguuaggagccagagguaaacgucacacaguuuaagauuaguuacugagcaaaugggaaagaacaauucuagauaucaaacgcuaacugcagggcugggcgcagcggcucacgccugcaaucccagcacuucgggaggcugaggcgggcagaucacuugagaucggguauuugagaccagccuggccaacguggugaaacucuaucuuuacuaaaguuagugggcaucuaauaaucccaccuacuaggaaggcugaggcaggagaauugcuugaaccugggaggcagagguugcagugagccgagauuacgcuacuauacuccagccugggugagagagcgagacucccaucugaaaaacaaagcacaacacugcauaaaaauaacucagauguuugucuaaaaugaaacuuaagaguaucagguaagggaaacgagaaaaccauuuaagggaaauaauuauucuggaguaacauccaaacuuccaauaauuaaauggguguuggauguaaauuuugaagaguggguagaaaauccgugggauccuugaguaugagauucuuaaaaagucuuugggaaaacauggcaaauggauugcuuugugugcgugugugagacagggucgcaaucccuugcccaggcuggaguacaguggcaugauuauagcucauugaaacuuuaaacuccugggcucaugugauucucccaccucagcauccugaguaucuaggacuacgggcgugugccaccacaccacgcuaauuuuacuccuggccuuaagcacuccucccaccuuggccccccaaaaggcugggauuacaggcaugagccacuguguauugccuggauuacucuuaauaaacaaaagauaguauccucuuugugaaguggauauuuauuuuuguaauauguaugaucacaugcuaauuaaccugaacucucuauguauauuuacauguguacuuuugggaaaauuuuuugguaauauauacacccuccaaaaugaggccaguguaggugugaauacuuaguuucuuaacucugcugcuaauccuuacuguguuagauacuugauuaaaacagaauagggccaggcaugguggcucacaccuguaaucccagcacuuuggggaggucaagauagaaggacugcuugagcccaggaguucaagaugaaccuggacaacauagcaagaccaccaucucuauaaaaaaacuagcuggaugugguggcaugcaucuguagucccagcuacuccggaggaagaggcaggagaaucccuugagcccgggaggcggagguugcagugagcuaagaccacgccacugcacuccagccugggcgacagagugagacuccaucucaaaacagaacaaaaacaaacaaaaaaccagauuaguacuugcauauauguaguaaaucauaccuucauuagucagguaaauacagugugagcaccuuuuuuuuuuuuuuuuugagauggagucucgcucugucacccaggguagagugcaguggcgcaaucuuggcucaccacaaacucugccucccaggucaagcaauucuccugccucagccucccgaguagccgggauuacaggcaugugccaccaugcccagcuaauuuuguauuuuuaguagagaugggguuucuccauguuggucaggcuggucucgaacuucugaccucaggugauccgcccaccucagccucccaaagugccgggaucacaggugugagccacuguguccggccgcaacuuucuuuuaauugaagcaacauauaacaguugugaaaucuaugaauuauaaaucuuuuuauuaggguauauuuuuuaaaccuuuuauagaaaauacugccaggcacaguggcucaugccuguaaucccagcacucugggaggccgaggcaggcggaucacuugaggucaggaguuugagaccagccuggucgacauggugaaaccccgucucuacuaaaaauacaauaauuagcugggugugauggcgcaugccugcaaucccagcuacgcaggaggcugaggugggagaauugccugaacccgggaggcagaggcugcagugagcugagauugugccacugaguuccagcauaggcgacagagcgagacucuugucacacacacacaaaagaaaaagaaaauauaaaacuuacauaaaagcagagagguaccuguccugaagcuuuaacaguuauuaccacaugaguuauuuugaaacaaaucccaaacuagcauuuagucuguaaacuuguacuagcuauaguuuggauuuuugaaucucuuaaacuggcauucucuuuuauuucuuugguauauuuuaccuugaugacugugcuuuuacuuugucaugaaaauaauguaaaagugcuucucuuccuucccuccuccauuuuaugauuguagacaggauguaccugaguuuaguuaaucuagguuuucuuuguuguucucgaagggaucaauggcagcugugguauuuguuuguucucacccuuuuggggaaagggaagaggcaaaggacuaaacuagguuaugaaucuagacuaaacugguguuuuccucagauacuucaaaauuguggauuauuugaccuggaaagagaaguucacuauaguucuuuguuuuuuuucuguuuuuuauuuuucuuuuuucuucucuuuucuuuuugagacagguugucacucuguugcccaggcuggauugcaguggugcagucacagcucacuguagcuuugaacuccuggucucaagcaauccuuccaucucagucuccugaguaggugguacuacaagcaugcaacaccaugcccagcuaguuuaaaaaaauuuuaaaaagauuuuuguagagaugggguuuggcuauguuguccaggcuggucuggaacuccugggcucaggugauccuccuaaagugcugggauuacaggcauaagccacaaggccuguccuauaguucuaauugugaaaguuaaguaauuuauuucacuugagaugucaagcucaauugcuaguuuuuguuuuguuuuuaauagcuaguugacuauaaauucuuccuccuucaaaggaggugacuggcaugugacuucuaugguauagucucauacaguuaacaugcaguuguguuauaugugucgcccucuuccuucccuuauacauacauauauacauguguagggaggcauuuggacuaaggugcugauucuuaacauuuucuguacugugcacuccuuuagcagucugaaaccuauggaucucuucuuauguuucaguaugucuuauuuuuuauuuuuuugagauggagucucgcucugucgcccaggcugcagugccgugaugcaaucuuggcuuaccgcaaccuccgccucccagguucaagugauucuucugccucagcaucuggaguagcugggacuacaggcaccugccaccaugcccagcuaauuuuuuguaauuuuaguagaggaggaguuucaccauguuggccagucugguccugaccuccagaccucaagugauccaccugccuuggccacccaaaguguugggauuauaggccugagccacugugccuggccucaggauguuuuaaaaugcauaaaauacguaggauuauaaaggaaaccaauuauuuuaaaauguaguuagcagaauguuaaaacuuggugauaggugcuuaguauaauaagcaacaaguucuagcaacacaucuaaguuucacaguaaugaguauagaugauaaagaucuccaacagucuaaugugguaugaaaauaucugauuuauauugaugucaaaauuacaaguacuguaauucugugguuuagugccagcauucauaauugaaggacguguuaaauuucauuuaggggauagugaagauaaauguguaauuuccugccacccacaccucauuuuuauuucccugaauuuuauccauggacuccuuagcuguaacggucagaguaaggucaccuggacuaaggccuuguuuguguccugggaugccuaauuugaagcuaacggauuugaacuuagaauguagucaucagauaaguguguuuuaaacauucuaucugccaauuuuaguggcuuuuaaaauaagucauaacaguccgauaaaugcuggaucuccaaauggucucuaugcauuuuaugacuuugcuucuuugcuuuuccuucuugggcuguauuuucuuaauagauauugguuuguaauuaauauagaguuaauauuuuaaguaguuucuaaacuuccauguuggcuauuauuguuuugcuuuuauguuuuuuucuuuuaaaaaacauuuuaauucuucugcaggauucggaaacuucagauacgaaauaucccgccucauuuacagugggagguaagaauuucuguauuuaaaauuaagaucuaaguauggaagccuauugcuguuaguuuuuucaaagcuuuuucuccuuuccucaacucuugggugugcuagaacauaaaauucuucuccuaugacccgugccuugguguggguuuuucuuaguaagggcacaguguaucuuuuaaaaaucugcucuuugggauaagaaaccaaauauugaaauauauucuuggguaacuggguaaucuuucucauucagucacuucccaacaggauuuuguugauuucaguucuuucugaugaguuugccaauuguauuuaaauaugaaguuccuaucuuggcaaaguuuuaaaaagacaaauaccugcuauuuugugcuguuacuuuaaaauguuauucugcuuccuuuugcucagaugguggcacugcacugauuguguaauaugcauaaacacaaacuauuuagcacaauugaauagccugugucagcaguuuccaaagcauaauaaugaugucauggugagaaucugagacaccaguaguugaagggauaaaagaaaaugucuuuugacucuucagacaauggaaccugaaaguucuuaaaacccaccuuggagaggguggugcagagaaacugcuuagcuuuuauguaucucuaauauaaaaaaaaucaagacuaacuaguuuuguguguuuuagacuagucuucuaaaaugacauuugaugagucacuaaaucauaacccccaucaaaaugcaaaguuugguuaaaagguuaguuuggugggaaguugaucuaagucugauucuccaagguuucucaguuggucacaggugauuugugcugagaauauuuaucuucagaacaguauuauugagauuaagcuuugcaggaagggguugguuuuugguauaugcugaauauauugcaaguuauauaaugcacuaaaaauauacuuuauagauggaaacgguggguuauaagauuaaacuuuuuacauguuccuguuuuagauuaacauuuauuuagggaauucaguagcuugugggauagguccucaaguguuguaauagcaagauuacuaguucaauccccuuauuuuaagaugagccauauuaaauaugauuuaaaauguaauuuaauaugauuuuuuuuguucaggagcuacaucugguaugauguagcuuucuaugaaacagccaaaugguagaaaccaaguuuaaguaaauuauuagaguacuagcauaucugcuaugggcagaguuuccuuuuaauucauucauaaucucuucaaauuuagagaauuuagcuuuuaguuuauugcauuuucccuuauucuggguauuugccguaucuaacuuuucuuaauuuuuguauuucacuuuacucuccucauuguccuuugagguagugucaaguuaguggauuaucucuguuuucaaaugggcaaauaugggcacgcaagauaaaguuaauuaagcaagagcacauacugaaucguaagaugcuuggaacuagacuuuggaauucuucaccuuugacucccuuuaaaaauuuaaugauuauuuacauauugaucaacaaaaacaauuuuauugagaguucguuaggaauaagaugggcugcugcuguuagguguuucuuuccuuaaaggcuugagggaacacuauuuccuuuuugagaagggucacuuuguauguuuuuguuuguuuguuuguuuguuuuuugagauggaguuucgcucucauugcccaggcuggaguggaauggugcaaucuuggcugacugcaaccuccgccucccagguucaaaugauucuccugccucagccucacuaguaguugggauuacaggcauccgccaaccacgccuggcuaauuuuuuguauuuuuaguagagaugggauuuuaccacguugguuaggcuagucucaaacuccugaccucaggcgauccaccagccuuggucucccaaagugcugggauuacaggcgugagccacugcacccagccuguauauauuuuauuuauucacgcuggguaugccgcuuguuuugugccaaagccuuaucauaaacagcgauaauuuugcaguucuggacaauuuuuauaauggaagauuaggcauugagucccugauuaaucuuagaaucacugaaaguggaaugaccggaccuuauguaccuucuacuuuaaugcaguagaauauacaugucaccacagaggaaauagucuuaucucaauagguucaacuggcuucagucuuaaucuaacuuugaguuuacaagaaauacagaagauagagugacaaauuaaaugaugcaucaaagaaacaacuagccauguccuaaauaugggauauuccacaggacauccuguuuugcuagaggagcagugggaugaaaaaaggaaggggccuguuacagaguaagacucaagaggauaacaaaaaagcacuauaguaaguucucugugagcaauguaaauagcccugugaagcagcuuggagcaccuaaaaaagccuuauaguuguauuuuauuuauuuauuuuuauuuuuuuugcaggaaauggggcagccuugaggucagacuuggaauuauguccuagcuccacuacuuucucauugugugaucuaguuaugggaucucugaacagguuuuuaaaauucuuugagccucauuuuccucuuuucuaaccaggggugaugaugguggcccccucauuggguugcuuugagcauuaaauaggauuaugcaugauaaagccuuuaaaacagugcuugguacauauaaguacacaauauguuuuagcuaugauauaauaagaacaacaaauucaccagcucucagccuuagguuuugugcuugucucagugagauccaggcaggagcacagauaacauacucgguauuucaccagggagaaucacacaggugcugaaaggcgaaagaacaaagagaauccagaguagugacuguaaggagcagccacggccugaggguuggaaggccaaagaggaaguugagguuuuggauccuagagacuuggagggaagagcccugagcaccugagacuuagauuucugagccaugggagcuccuuggcuauggcuggcgccugggauguggggaggagagaggaguuauacaucuuguucagaguguccagaggagcuagaggcuguaaccaacugcugauucagugacgccggcugacagacagggaccugcggaugcggugaugccgacugacggacgggaccugcggaugcagugaugccgacugacggagggggaccugcggaugcggugaugccgacugacggagggggaccugcggaugcggugaugccggcugacggagggggaccugcggaugcggugaugccgacugauggagggggaccuggcgaugcggugaugccgacugauggacgggaccugcggaugcggugaagccgaugaacggggaccugcggauguggugaugcugacugacguacagggacuuggugaugcggugaugccgacugauggguagggaccuggugaugcguugaugccgacugacggacgggaccugguguugcagugaagccgacugacggacgggaccugcugauguggugaagcugacugacagacaggaccugguaaugcagugaagccgacugacggacgggaccugcuaaugugguaaagccgacugacagauggggaccugcggguggggugaugcugacugacggaugggaccuggugaugcggugauaccaacugaaggacgggaccugcagaugcagugaugcugacugacggauggggaccuauggaugcagugaugcugacugacggagagggacuugcagauguggugaugccgacugauggacagggaccugcggauguggggaugccgacugacggacagggccugcugaugucgacugauggacgggaccuguggguguggggaugccgacugacagacgggcaagagcaugucaucucuaucccgacuccugcuuucuaguaccccucuggugccuucuauuggcagaaacuaacagguaacagcuggcaaaggagagauuagaguccauaguccuagaccuggcaucacaaagcugagaaguacauuuggaacugagagcuuauuuuucuuuguuugcccuaaugccucauauacccugucagucugauggaacugagagcuuaauaucaaggcaaaccucuaaccuugaaguaagacaaucuccugccccaauucuaggagucaucuuguaagccagauucugugaagucacugaagagguaacagaaucugggaccacagcagaaacgcuugugacguuugguguuuuguaagaucuguaccuggaguguuaccuuucuguuacuguuagaucuuuauuauuuauguuaucuguauuccaccauauacuacuaaaugaucagaaggggauuccucaaguucucuggaccgcauaucuuacaugcugugucaagcagcuuuaaacaguuucuaaccacuuaguuuuagaugaugauaaagcacuuaugggugggcacuggauucugcuaaauguuuauggcagaugaagauacugggagacuaacuuuuuuuuuuuuuuggagacagagucuugcucugucacccagguuggagugcaguggcacaaucucggcucacugcagccucugccuccuggguucaagugauucuccugcuucagccuccugaguggcugggacuacaggugcgcgccaccaugcccagcuaauuuuuuguauuuuuaguagagacgggguuucauuguuagccgggaugguuucaaucucuugaccuugugaucugcccgccuuggccucccacagugcugggauuacagacuaacuuucugaaggacucacugcuagagaauuagguagguuuguuuucucccaaauauauggaauauagcaaagaaauaagggaaaauggugguuucucauccauccuguuuugccugagguaccugaagaguagacucagugugaccagacuggaaggauuccuccacagaaacagucccagcagacaacgauguggauguucagaugccacaggggaaguguacauuagaaggaggauuugagagcccuuccuuaaauggauaaggguagggcuuugggagaaagccuuaguggaguacuugacauuaaacaccuuuagauauuuuuucuuuugccuacucaauuucucaagugggcuccauuuucuaaauuuaaggaaugucuuuuuguuguuguuuuguuuuugagacggagucuugcucuuucaucgaggcuggagugcagugaugcgacgaccucggcucacugcaaccuccgccuccuggguucaagcaauucuccugccucagccuccugaguagcugggauuacaggugccugccaccacacccggcugaguuuuguauuuuuaguagagacagggcuacaccauguugaccaggcuggucucgaacuccugaccucaagugaucuguacaucucagccucccaaagugcugggauuacaggcgggagccacugcgcccggcaggaaugucuuuuuguauguaaaaaauacacaguaaguggggccaguugcggugacucacgccuguaaucccagcacuuugggaggccaaggcaggugggucacuugaggucaggagaucgagaccagccuggccaacauggagaaaccccaucuuaacuaaaaauacagaaauuagccgggugugguggcacaggcuuguaaucccagcuacucaggagguugagucaggggaaccucuugaacccgggaggcggagguugcagugagccaagaucgcaccacugcacuccagccugggugacaaagcaagacucugucucaaaaaaaaaaaaaaaaaaaaaaaaaaaaaaaaaaaggccagagucuuaaggaaaggauuucucaguuucuccuaauguuauuuccuugaaacuacucuccagucaaaagaaucaaaacuccuaauaaguacucaaaaaaugcccaaagcuggggguaccuucccugaagugaagcauaagaccuuauguaaaggaagacauuagguaaaugaagugguccuagaggaaagggcaaggaagguugucauuuugggggcugaugaggaaggugaaacaauauuucccuguguuuacuguguggggaaacagccuaugcaccagguucuccaugcugguggggcccccacaucacucaugacuggaaugacuguuuuccgagcaaagauuugaauacgugaucugacagguacuuauggggaauacauacuuaaaaaucacagucuugcuagaaaauucagaacguuucuugguuuuacuucaacacuugcauauuugauuuuuuuccuggacuuaauugaucugggaagaugaguauuaagugaggcucuggucaaagaagggaaaccaaguauuccuuauuuagaagaaacaaguaggccugguaugguggcucaggccuguaaucccagcacuuugggaggcugaggcaggcaaaucacuugaggccaggaguuugagaccagccuggccaacauggcaaaacccaaucucuacuauaaauacaaaaauuagccaggcaugguagcgcaugccuguaaucuuagcuacucaggaggcugaggcacaaaaauugcuugagccuaggaugcagagguugcagugagcugaaauugugccacuguacuccugggcggcaggcgagacucuacugaaaaaaaaaaaaaaaaaaaaaagagaaauaagugggaaaguagugaagaaauaaguaaauggaaaaguagugaugccauguuaucuagucuggaggaaaaacgaaacaauaccauaguuaauauaaaauagcucagagagaccccacuguaagccguggaugaacgugugcugagaaguggaaagcugucuugagguuuguggggagguagaugacuuccuggggaagagaguaggcagggaccacggagugaguuaggugacaucccugcuggauguuggcaucuuuaaaggcaggaacugucauucaucuucuguccaacugcugauuguuuuugaugcuguguuaggugcuacuugguccauguggauacaggaauuaaugucaaauagaaauuugagaagcauuuuauuuacuuacuuuuugagacagcauuucacacuuguugcccaggcuggagugcaguggcgugaucucugcucacuacaguguccaccuccuggguucaagccauucuccgccucagccuccugaguagcugggauuacaggugugugccaccacgcccggauaauuuuuguauuuuuaguagagacgggguuucaccauguugaccaggcuggucucaaacuacugaccucaggugauccacccacuuuggccucccaaagugcugggauuacaggcaugagucacugugccuggcugagaagcauuuuagguguaauuggcaacauaaagcuaacaccaugaggugcuuuaacucaacagaagaaaacaucuguagaaacagugacguugagacuguccaugagcugagcgagaaguaguaaugggagucagagauguuaaauauuagaaauaaccaguuuaaagguugccuuuauagcagacagcuuggaguucuaaauaaauagcagauaaacugcauguucucgguaggugccuuucuucuucucaguggccugacuuugagcaggccacucggccaauaaguagcugacacguacuaggcacuuaugugccggguacugaauuaacacguuuuaaucuucacagcagucccauguccccacuuuacagauaaggcaguggugguacagagaggugaaguagcuugucugggaucaugcagcuggaaaguguuagugucuccucuuaaucagguugcucuaacagaaaacuuccucccaaaggguuguuccuguuucuucuaguuauuaugauuugguuucaacaugccucugaaaagcuugacagugaagccaauagaaacuggauccuccccaggucuggacguaauguaugguuaugagugaugaaugaauuucauuggggaaguuauuaguaaaguucucuguuuaaagaacuguagacauagaguucuucaugcauggcugcucugggaugggccagacuuuacaucacuagagguaaucuggugaugggugugcaaggggaauaccagaguucucuacaaccgguauauaugaaugguguaugaggcaagcauuucugaccccacccugcucccuccauguuuaccccauguccuuugugcuaugcugccuggacuuuuguccugugcuucugucauuuuucuggauaugaucaucuuaaaggucaucaugcccuuuaucaguugauugagacagaaucuugacuccuaucgcccaggcuggagugcaguggcacaaucacagcucacugcagccuugacuuccugggcucaggugauucucccaucucagccuccccaguagcugggacuacaggugcauaccaccacaccuggcuauuuuuuuuucuuuuguaucuuuauuuuuaaaaaaaauuuuaagauggagugucgcucugucacccaggcuggagugcaauggugcgaucucggcucacugcaaccucugccuccuggguucaagcgauucucgugucucagccuccugaguagcugggauuacaggcgcccaccaacaugccuggcuaauuuuuguauuuuugguagagaugggguuucaccauguuggccaggcuagucucaaacuccugaccucaggugaucaacccaucuuggccucccaaagugcugggauuagaggcuugagccaucgcaccuggccaaaaguuuuaaauuuuaaugaaguucaguguauucauuugugccaaucucauuuuaugaauaguauuuuugguguccugucuaaaaacuuuuugccuaaaucaaaguuaugaagguuuucuccuauugucuuaagccuauggugcauuuugaguuaauuuuuauguaauguaugcuucacaggcugugguuuuauuuuuugcauguaaaugucucauucuaacaccaaaaauugaaaauauuguuccuuuuccauugaauugcccucacacuuuuguuacaaaucaauugaccauauuugugugggucuguuucuggacucuuuuaucccauugauuuaugugucugucccuuugcuacuacacuuucuugguuacgguaucuuuauaagucuuaaaauugaauaguauuauuccuucaacuuuauuguuuuucagaauuguggcuauugucuuuacuuugcuuuuccacguguauuuuggaaccagcaagucuauacacaaaaauucugcugggauguuuauugggauugcaauaaguuaacaacaaaaaaacccuuuuggaauaauuaucaacuuuacuaaguugucuuuuuaugacuggcuuauuucacuuaguaugcuguucaaccauguuguagcacaggggucccuaacccccaggccucagacugguaccaucuguggccuguuaggaacugggcuguaccacaggaggugaguggcaagugagcgagcauuacugccuaagcuucaccuccugacagaucagugacagcauuagauucucauaggaaugcauacccuauugugaacugcacacguugagggaucuagguugcucacuccuuaggagaaucuaaugccugaugaucugagguggaacaguuucauccugaagccaucccccccauccccacucucuguccguggaaaaauugucuuccaugaaaccagucccuggugcgaaaauaguuggggaccgcugucguaguaugugucagaauuuucuuuugaaaguuaaguguaguauuccucugucuguguauucuaccuuuuguuuauucuucuguccaugggcauauggauugcuucuaccuuuuggcuauugugaucaaugccaccgugaauguaggugaauaaauaucucuuugagacucugcuuucaauucuuuuggguauguaccuagaagugggauugcuggauguuauagcaguucuucuuuuccucuccuugaauaaaccagugaaaaagauguuauagcaauuauguuuuuaauuauuucaggaauugccauuacuguuuuccauagcagcuguacuguuuuacauuucuaccaacagugcccaaguguguucuaacuucuccauguccacuucaacacuuguuauuuuguuuuguuuuuuuuucuaaauaguaggugaauauuauuuuuuaaguuuggacuuccacuuguuuuuaguauguagaaguauuuuaaauuuuuguguguugaccuuauauccuuugacauugcuaaacuuacuaguucugaaaguuuguuuuuuauuuuuuaauagauugcuugggauuuucuacuuagacaauuauguauucaaaugggcauaguuuuauuccuuuauagucuguaugccuuuucuuuuauugcuguaauguacugucuaggaccuccaaugagaguugacauccuuacccuuccucaauuuuugugagaaaacauugucuuucaucaucacauaaaauguuagcuguggguuuuuuguagauacucuuuaucagguugaagacauugccuucuguuucuaguuuguugacaaucuauaugaugagugaauguuggauuguuucaaaugcuuuuucugcaugaauugauauuaucauguaguuuuuaggcuguaaaugaauuacauugacuccccccccccccgccccccgcccccugccccccacaaauguugaaccaacccugcauuccuaugauaaacuccacuuuauugugguauuuuauucuuuuugcuugguuuaauuugcuaacauuuuuguugaggacuuacugugucucugcucaugaaggauauuggucuguaguuugauguuuuuuguauugccauugauuuuguuaucaggguaacacagccuuaaaauguguugggaaaacauguuuaccuuuucuggaagugauuugcugaauugguguuauuucuuuaaguauuugauagaauucaccugugaaaccacuugaauaauuucucucagaaguuuuuuuuuuuuuuuuuuuggagacagaguuuugcuuuuguugcccaggccggagugcgauggcccaaucuuggcucaccacaaccucugccuccugguucaagugauucuccugccucggccucccagguagcugggauuacagacaugcgccaccaugcccagcuaauuuuugcauuuuuaguagagaugggguuucuccauguuagucaggcuggucucgaacucccaaccugaggugauccauuugccucggccucccaaagugcugggauuacaggcaugaaccaccacacccagcccuuuuuuuuuuuuucuuaugcucaaauucaauaucuucaguaauuauaguguucuucagguuauuucaucuugggucguuuguaguguucaaagaauuggucaauuucauccaaguuguuucuuuuuuucuuuuuuuuuuuuuuuaauaacuacaucaucauggacaaguugcauaaagcuuuguaguauucgcuuauccuuuaaugucuguggggucucuagugauaucuccacuuuuuaauucugauacuaguaauuuuuguguucucucucuuaaaaucuucaucagccuugcagagcuuuaucuguuuuauugauuucuaauaacuucaugauguugaagcugaaugagcuucucugucuccaugauuuugagaggugaagguggcugggcuucugggucagguggggacuugaagaacuuuucugucuagcuaaaggauuguaaacacaccagucagcacucaguuucuagcuaaagguuuguaaacacaccaaucagcacucuauaaaaacgcaccaaucagugcucugugucuagcuaaggguuuguaaauggaccaaucagcacucuguaaaauggaccaaucagcaggauguggguggggccaaauaagggaauaaaaguuggccaccugagccagcaguggcaacccgccaggguccccuuccacacuguggaagcuuuguucuuuugcucuucacaguaaaucuugcugcugcucacucuuuggguccacacuaccuuuaagagcuguaacacucacugcaaaggucugcggcuucacuccugaagucagcaagaccacgaacccacuggaaggaagaaacucuggacacaucugaacaucugaaggaacaaacuccagacacaccaucuuuaagaacuguaacacucaccgugggaguccacggcuucauucuugaagucagcgagaccgagaacccacuggaagaaaccaauuccggacacaauuugauuaguauuuuguuucccugaggcuucccuuuuugauucuccaaucagaaaagcaaggaccuuagauaccuugcgugguugugcacuuccuguaacuguauacauguccagggcuaacgagaggcaaacagacggaaaagaagcaaacagguucaauccauccccuuggaacuauagcuucuucccuccaucaguguuuuagaucagugauccccaaccuuuuuggcaccagggacugguuucguagaagacaauuuuucuuucuuuuuuuuuuuuuuuaaucagaaaauuuugaucauggcuuuuauuucuuugcaacagucguccagagguucugaagagaacucaccgguuguagagucuguguuaaucacccagcauuaauauuuccauugcuccaucaucauguguaagccuguccacagcauucuucuccagaagcaaacuugcucaaccuuuaguuucacaucagugaaggcgaauucuuucaccaagauggacuuguuuguucucaggaaauccauacagcccugguugaagaguucagaaacucuuuuuaugcauuaaaacaauuuuuucaugguuggggaaggggagugguuucgggauagaaacuguucuaccucagaucaucaggcauugguuagaaucucauaaggaguaugcaaccuagaucccucgcgugcgcaguucacaauaggguacgcacuuccaugagaaucuaacgcugccauugcugaucugacaggaggcggggcucaggcauuuaagccugcucaccuccucucaccuucugcugugcggcccgguuccccuuucuugcuucuccagccuaaacuacaaggcuucuccuaagaucugucuguauccacuaacaacuugaaaguuuuuugcugcugagucuaggcuggggcauagcagagggaaaaaaagaagcaaaucacuucaguuucuguaguacuauagaguuccuagucugucuguuaucuuuacuuugagucuucaaauuauuguuugauacuuucugucuagauuuuuuaacugcuuucagugggagaaacaaggugggugugcuuauugaaauuugucuggaucuagaaccuggaacuaaaguuuaaguuguuucuuugaauauuguuuuuugaugccuuuuaaauuucaaaagaggugaauuugaauuuuucauuucucaagaacagaguaacuacucauaagugauuugcuuuuuucuuguagauaaccuuugguugaauugagacugaacaggacuuacccucuuaaaagaaaugcguguucaauuuuuccaugugacucagcacuagagauguguaugcagugcucaucauuuuaaauuuaaguauauaaaaaccuucacuuguugcucuuuuccugucuuucuaccuccaguuuuaaugaacaaaauauacaagguuaagacuggggagggcaaaggucuccugguaggguuuuagaacaguaaaccaauugggagugacagggcacuauuaaugcugugucuaauuuuauuaucagcaaccagaaaagcaagaguuuucucaguacuaaggccauccccacccccaccccccacuugccguauuuugauuuccugaauggccuacuuugucuuacucaaaacacaauauuacuauucaguaauuacuauucaguauuacuuuccauguggggaugagaaaggcuauaauuuacugcgaucuugccuagaugucuauuguauauauucacaaauaccuuuccucaguuuuuuauuccaaucugguagacaaagguggugcucaguaaguuaaguguugguugaauugaggguguaugaugcuuuucaaagcuugacuaucaacccagauagagauuucuguguucaucuugcuggauuuuuuuucuuguuuuguguccacuacuccuagacucucacauguguccagguauauauacaaagauugaaauuguuuaauuagcuuacucuggcuaaugguaaugacugauauuucagauuucuuuuuaaaagaaggccuauauuugaugugucuaucuuucacucauuuuuaugccuacucucauauucuuagcucauuuccuucucuuuaguacucugccuuuggguuuuagaguaacuuaauaucacacauguggguugugucgauuaugagcagagcaauaugcgaaccucuuuuuuuuuuuuccauuugauuuuuucaagacucugucacccaggcuggagucagguggcacgaucacgacucacugcagccuuaaacucuuccugggcucaagcaauccuccugccuuggccuccugaguagcuaggacuacaggcacauaccgcugugccccauuaauuuaaaaaaaaaaaaauuuuuuuuuuuguuuuacaaacagggucuugcuacauugcccaggcuggucucaaacuccugagcuuaagcgauccuccucccuugaccucccaaaguguugggauuacagucgugagucaccgugccuggccaaguaccucucuagauggauucucuucuuguuauauucuuagagccaacccuagauauagaagggaauugugcuauucuuauuuuuaaaaacaacaaaguaauugggaaauggaaaaacuugccaaggucuugcagcuaccauuggcugaauuaggauuuaaacuaggcagaaccuccuuuuuuagcugcuacuguaucuaaacuguauauucuucugucaucucaaacguggaaauaaggaugacuucuaauaucuccugcaaguucacuuacgcauuuuugacuuuuagcaccaauuucaucaguguuuuuauugagaucuauaauuuccuccuauguaauguuccaauuacaauccugaagugaaauucacagaaaauauagccacuuauauauaucuauaauuuaaaaaucaauguaauguccuaguaauaccagaaaggagacauaaaaauuauuuauacaaaaaaauuuaguacauaaauacuuaggcaugaucagaguuuaggcauaaugaaauagcuaagugcuuguaccauauguagaauaauccucaguggaccaauacugguguugagacaggaauaauauacaggcaaugcaaaguugugugcucucaguuuagugguuuucucuagugauaagcagaccaaaauauaauaguaucuugauuuacaugauacaguuuuggaagaugcaguauauaugaaaacugagcaauaaauauuuugucagguuauagggucagauaaauggguuuccccuguaucugaauaucaaggaccuucaaaggcugugcaggacaugaggccaccucucuuuauugugugaagcuguacugcacacuucaggaugugugacauaccuggucugugacuaucaaauauuaguaaaagacucuuuuccuaaucccaaaagauccacagauuucuaaaaccacuuccuuaaggggugaagcuuucuccauugagaauuacuguucuaaaucauuccuuccuuagcuguguugaaggaccaguuauuuuuaaauuucuaauugauuacugacuuuuuuguaaaacacaaugaaaauaaauuauuacaaugaaauuuuaaagucagccaaaagacaagcugauuuuuauuauuagauucaacagacauaaaauucuugucagucugcuauaaaaauuuguaaaugcuuaaucuccacuuauaaguuugucuugucaugauauggucucuaucuucaucucacucuuuuucuucccacagucacccaaaaugacgguauguuccuaaaauacuuucccguggaagguguaaguuccccucuuccuggccaaaugcucaaauguuuuacucccaucaccuccuuuguuuugcauaaguaucacuuucuauaaaaauuaucauuuaaugauggaaaugaacuuaacugccuuuaccaucagcagucucuuuuuauccaugauaaaauuugcagaguaguuuaacaggcauaacucaagcuguuuauuucuucuuagcuuuauauacuuacggauaggaagucaugcaguacaagugugcaaaaguucugcaaaguauauguuacuuuugcugaucacauacagguaaauccaucuuagaugaucugauuucuaauacaacucaacucuaaaagucuaaaaauaucucugagcuauguauuaagcaggugguuuuggacuuagacugcauuucuuuguuuguuuuuguuuuugagacagagucuuguucuuucacccaggcuggagcgcaguggugcaaucucggcucacugcagccucugccuccuggguucaagugauucucaugccucagccucccgaguagcugggacuucagggacacgccaccaugccuggcuaauuuucguaauuuuaguagagaugggguuuugccauguuggccaggcuggucuugaauuccugaccucaagaccucaggugauucaccugucucagccaaccaaauuccugggauuacaggcuuuacagguuucagccaccgugcccggccuagacugcauuuugcuucaugccaaucccuagggcagcagugacuuuuuuuuuggagacgagucucguucuguaacccaggcuggagugcaguggugcaaucuuggcucacugcaaccuuuaccuccuggguucaagccauucuccugccucagccugucaaguagcugggauuacaggugacugccaccaagcccagcuaauuuuuguauuuuuaguagagacaggguuucaccgugauggccaggcuggucucgaacuccugaccucaggugauccaccugccuuggccuccugaaguacugaaauuacaggcgugagccaccgugccuggcauagcagugacuuuucaaaucuuaauuucagaagacuuccugcuguauuuuuuguacugugaguuugaaugauggaagacaauuccuaauacaaggcaggaaggguccuggauuaucagacucccggcaguucaugaugcugccuccaugaugcuggcagccaugauguugauggugaacccccucagcagggggcccgcaacuguuccucuggugggucugugugaaggcaaguacugcugggaagggguccuacuacucggccacagugacugaaucuuaaauauggaugguguccuuacuuuuaguuacucuguaucagcagaaaaguuacaauuuuuaaaaggagaccauuucuucaaucaugguuuaacaauuaggguuuugggcugggcgugauagcucacaccuguaauuccagcacuuugggggaggcaggcaggucacuugaggucaggaguuugagaccaaccugggcaacauggugaaacccccgucucuacuaaaaauacaaaaauuagccuugugugguggcacgugcuuguaaucccagcuacucgggaggcugaggcacgugaauuacuugaacccaggagguggauacugcagugggccaagaucgugccucugcacuccagccuaggccacagagcaaggcuccaucucagaaaaauaggguuuugacagcaucuuaaauacuucugcucuuccagcucacucauuuuauacacagucauuacacugcgaugcauaugguuggcuuuggugugugcuuguguagguauuuaugguuggauccaugcacacagucaugagguggcuuuugaaguuguucucgugugaaauggaaauucuugggcaucuaaguauuucuuaauuuucaguggguggaacaaguacagccagauugaaggaugugcuuuuaucacgugccuugcuuucugaggcugggucagccuuagucagaauggccccuuuugguuguaauguugguguggcagacaguacuuaggcugccacaccaacacagagauaugaagaaccucugauagcauuguccucaaaauguuacccuggaggagcaggacaaggucagcuguggcucucuaaguccaaaaccaccugcuuauuauauagcuuagagauacuacuucuucuaauggugaaaacuccaauuacuuuuguaccaaccuaauacuuuguuuuagacuuucacagaauugaauugcauuagaaaucagauaaucuuagaugcauuugccuauuugugaucagcaaaaaguaauauaauacuuuggagaacuuuuucacauuguuuuaaugcaugauuuacuauccuggagaaacaagauauuggaaacacaaauguuucuuuaguugcucagcuccugugugccucuuagauguacugagaacauguuuaaggaugcaaacuuuuuauaccauguaugccuuauccacuagccaaggaccugguguggcauugaaguaaagauaugacaacuuguuccaauguuggggaaaaaaaaacuggcucauauggcucagugggagaugguguagaaaugugauuccuuucuuaggaauuuuaaagugacuuuuuaaacucucuacuuugggaguuuucaaacauacacacauugagaaaauaguauacugaaccccccaucuaccgaccuuaaugauagucaacauucugcuuuuguuuuacugaucaauauugcuucacuguuuuuagguggaggagagguguauuauuuuagagcaauucaauaugagugaugguauagaaaauuuacauugcuaacauaaaauaagaauagguauauuaguuuccuaugcugcuguaacaaauuaaucacaaacuuggugguuuaaagcaacagaaauuaauuuuuguucuagaagccaggagucugaaaucagucucuguggguuaaagucaagguugucaugagaacuggcucccucuagaagucuuaggggagaauccguuugcuugccuuucccagguucuagugccuggcuguaguccuuggcuuucaugguuuccucuuucuuuuuuuuuuuuuaauuuaauuuaauuuuauuauuauuauacuuuaaguuuuaggguacaugugcacaaugugcagguuacauauguauacaugugccauguuggugugcugcacccauuaacucgucauuuagcauuugguaccaaaacagagguauagaucaauggaacagaacagagcccucagaaauaaugccacauaucuacaaccaucuaaucuuugacaaaccugacaaaaacaagaaauggggaaaggauucccuauuuaauaaauggugcugggaaaacuggccagccguauguagaaagcugaaacuggaucccuuccuuacaccuuauacaaaaauuaauucaagauggauuaaagacuuagauguuagaccuaaaaccauaaaaacccuagaagaaaacguaggcaauaccauucaggacauaggcaugggcaaggacuucaugucuaaaacaccaaaagcaauggcaaccaaagccaaaauugacaaaugggaucuaauuaaacuaaagagcuucugcacaacaaaagaaacuaccaucagagugaacaggcaaccuacaaaaugggagaaaauuuuugcaaccuacucaucugacaaagggcuaauauccagaaucuacaaugaacucaaacaaauuuacaagaaaaauacaaccccaucaaaaagugggcaaaggauaugaacagacacuucucaaaagaagacauuuaugcagccaaaaagcacaugaaaaaaugcucaucaucacuggccaucagagaaaugcaaaucaaaaccacaaugagauaccaucucauaccaguuaaaauggcaaucauuaaaaagucaggaagcaacagguccuggagaggauguggagaaauaggaacacuguuacacuguuggugggacuguaaacuaguucaaccauuguggaugucaguguggcgauuccucagggaucuagaacuagaaauaccauuugacccagccaucccauuacuggguauauacccaaaggauuauaaaucaugcugcuauaaagacacaugcacacauauguuuauuguggcacuauuaacaguagcaaagacuuggaaccaacccaaauguccaacaaugacagacuggauuaagaaaauguggcacauauacaccauggaauacuaugcagccauaaaaaaugaugaguucauguccuuuguaggaacauggaugaaacuggaaaccaucauucucagcaaacuaucgcaaggacaaaaaaccaaccacugcauguucucacucauaggugggaacugaacaaugagaacacauggacacaggaaggggaacaucacacucuggggacuguugugggguggggcggggggagggauagcauuuggagauauaccuaaugguuuccucuuucaaaguguaccacuucagccucugcuucuguccucagauugucuucucucugacuuugccuccucucucgccccuuuuguaaggauccaugauuacauaaggcucacccggguaaucccauauaauaucuccaccucaagauacuuacuuauacccucaaagucccuuuugccauauaagguaacacucgcaguuuuuaagcauuaggagguagauauauuugggaccauuauucaauuuaccaccaguguaaucagcacucaagugucaaauaaaugcuaauaggaccacagccuugagaguggggacucuaaauacucaguggugaaauacauuaagauaaaguucuucaguaccuagagggauuucuaugcagaauacauuuugucauuucauguaggggaugcagcauuccuauuaugagaugacaagauagaaggaggcauguguugguguaaggccaguuagguguugaaggaggcauggcguauggcuaguuagaugauagaaggaggcauguguugguauaaggccaguuugagaccuuagaggagacggcugcaguucaacaucagagcugagauggugcuaguucauggcuccugucucaggcuugacacugacaguugacaacacggugcucuccugggccuuaggccauucugucacccucccugagcuguggagcugagcuccuucccuguccuugcuucugccucuucuuagaagccuuuuugaauuuaucagagugccuacuaugugccggaggagaauuugcugcacaagacaacuuugaugucuuauccaagucagcuucucugaacucgcaaaaaaacagauuccuucuagcucugauuuucacuaaauguuucugaggucuugguuauucuccacauaaaccuggagacauacuuuucauuaaaauauaaggcagagguaugggguuucugggucugaaccucagaauagucgaauggaagacaggguagggacuuugagggcagcuucuuacuggcuaugagacuuuggauaaaagugacaaccauacagagucccuuucccaucugugaaaaugggauuaacaaaaaaaaguccuuucagggucaaugugagaaccagcgaauaagacaagugccucgcccugcugcacugugaauuaacuuuuuuuggaggcauuuguccuuuggcugaaauucacaugcugugugcuccaguacugugaaguacuuuacuuccucaaccccauccuucucuuagcuucaggacuuuuugcauacauuuucuuugccaagaauccauuugcucuuuuuuuucccccccaacagucuuauuuuguucuggauccuuuccaucuuucuuuauucucaccaauuauuuagcccucaauuuagacaucauuccuaccacgcuuggauuagacaucucuccuguauuucucccauacuuaacacuaugguagcacuuaacauguaggcuugcauuaucucauguauuuuuuuuuucuucagaaaacuagguuuauugcuacacaaucugccaguaauuccagcuauuuugggugauuucauuauuugacuuagcauuguguguguguguguguguguaaguacauauuucagaagucagagucuucucuguugcccagugcaguggugagaucauagcugacugcugcaucaaacuccuaggcuaaagugauccucccuccuuugccucccaaagugcuggggcuauaggugugcaccccucccugcccccuacccccaagccagcacuuuauauuuaauugucuuaugacuugugucuguuucucccaccagagcuaagguggguagggcucuguccucccauguuaucaaagacccagaacaauggcugguguggacuugcuggucaguauucacucacugaaaguguauugguugggaauuuuuucaacucuguaauggguuauuggguuaaaaaaaaaaaaaaaaacucacuggauuuuuuuguguaggggugggguagggggauggguauaagaaaauaggauauaaauuuguugucucgggucauugagguuuguauuuuuguuauuuucuucuuuuuuugagauggagucucgcucuguugcccaggcuggagugcagugaugugaucucagcucacugcaaccucugccucccagguucaagcaguucuccugccucagccucccgaguagcugggauuacaggcaccugucaccacgcccagcuaauuguuguauuuuuaguaaagacaggguuuuaccauguuggccaggcuggucacgaacuccugaccucaagugauucaccugccucagccucccaaaaugcugggauuacaugcgugaaacacugugccuggccuguugguuuuucaguuaauuuuuuucuuuuuuuggggggguggggguagagauggggucucgccauauugcccaggcuggucucaaauuccugggcucaagcuguccucccaccucagccucccaaagugcugggauuauaggugucagccacugcacuuggcccgaggucauugaguuuuauugaugcagaaaucacugaaguucuuacaaauguuuucguuuuuuuguuucuuuguguuguuuuuuauuuuuuggugguggcaaauggaaaucuuggugccagcuguguuggcccuucacuagcagggaucagauguuuuggaaaguauauugcggguguuuuaucuugaucugguuacuugcuuuaaauaguucagguuguuuugguuaggcuuucuaauaguaguugaucauaauacucagcuuucuauuuuggggaaaguuuaauuucuuauuaaaaaaacuuuaaggaaaaccucagacuuuaguguugaaaaaaugagucacaaagaagucagaaacaucagugagggcugcuccuuauggcugugaaauugagcaggcugugccuccagaugccagccucauuaggguggauuaaugcuaagcuccucugagcuuacacccaucauuacuccauguucuucuuucucagcaaaucugaugcccaucaauucugagcauguucugugcacuuccaguauuccauuauuguuuaccacuacuugaaguugcccagcugaacaaacauuucugacuucagauaauuuacaugguaucuuucccauaaaggacauggcuucauuguguuaauuucuuucuugcuuaacuaaacaagcaaaccuuucuuuugucacagcuuuguuucuguaugguaggaauucuauucugacgugcuguuuaauuaauguuugaaaacaggaccuuugcuuauaugcuucccuuggcuaccagagacagcuuuguagcgcaugauggagccugcauaauuucucacugacuguguuugccuugguguugucugcuacggaguuuaagggucaccucuacuauauauuguuagaauauuuaacuucaccacuaacuucauaccaauuuauuuucagucuuaauuuuuccuggcuuuauuuuucucucaugguuuguuguuguuuugggggaggguaggcgcaggggagacagagucucccucugucacccaggcuggagugcaguggcaugaucauagcucacugcagccucgaccuuccaggcugaagcgauccugcuaccucagcuucccgaguagcugggacuacagguacgugccaccacaccuggcuaaauuuuguaauuuuuauagagacaggguuucgccauguuguucaggccggucuccaacuccugggcuuauacacuuagcuugcccuggccugccaaaguagauguguuaaaaagucuugcugauuauaaauagcguuaucauuuugggaaguagauuuuuuaaguugugcaggugugucuguagcugaaagaccuuguugugugaacuagauuaccuuuagaaaccuauaacacuaauaauuuuuuuuuuaaucacacaaccccuauaccugucugaaagauuaugguauacacaaguguaggaauuacuguuuauuugccuuaucagaaagucuugaaagcauuauggauuuguguacccuccuaauaacucgacuggccucuuaaguauccaguccauuggugaaggucacugcugggaauccaugguacuuguucagccuccuuccuuccgcagcaggagggacucucaaggagagacucuucucacugauccuagauuaggccgcagaauccuucucacacaggcuguggauaaucacagccaguuguuugcaguuggcaugcaaaaugaacaugauugccccccuugggcuagaugaucuuuuaagagccuguucauuucaacuuccauguuuauuuuagcuccuuugagaauauaaaaauucucccaaugugugaagagagcacauucaaaugguucaucgucugagaaacucuccagaccacucaucugucccucccagauuccccuccacugaccccucucagccuguuucccuuugggggcacgguuuccgagccccuuagaguaggguucagaauugagcauaguacuugcuacaggucuaaacugugcuuauugcagggugggaucuuagcuguccuugacauuuguugacauuuguucagugaauagaagaucacaugcccguauuccuuaggcaugagaugaucaucgguuacgauugaacuagcuuuuaguuauuaauaauaacuuguuauugauuuacauguuacaagguauguaugggagggaggcuuuugugaacgaguugucugauuuaaccacguugccugguacuagcaugaaggaccauucugagugaacauuggugaggugauagcacaguucuguagguaaaggguccuucuggaaggccacuccagcgggcagaagacaucuugaguuggaugaaagcaaguucucuugaucacagaagcaaagguggguuaauuccaaggacgcuaaugagacuugcugaguguccccuaaggaagucagauaucagaguguccucuagaaacuccuaagaaauugaugaguggccaccuuauagcaauugggaguuauaugccacucacuuuaauuuuuuaaauuagaaauguuuuuggcacaguggcucaugccuguaaucacaguacuuugagaggccaaggugggaggauuucuugagcccaagaguucaagaucagccugggcaacaugauaaaaccccaucucuuaaaaaaaguacaauaauuugccaggcgugguggcccacgucuguagucccagcuacuugggaggcugaggugggaguaucccuugagccugggaagucgaggcugcagugagccgugaucaugcaaucauacuguggccugggugucagagcagcaagacccugucuccaaaaacaaacaaaaaaaaguguuuguguucacuguagaaaacagaaaaaagggcuuaaaauccuaccauucagaguuaacuaucauuaauaguuguauauuuguguguguguguguauguguguguguauauauaugugcauauguguguauguguguauauauauauauacauauauauguguguguguguauauauauauauauauaugaugauaagcuguccuugucuuuuuuuuuuucuuccaaaugguuuuccauuugugacagcacuacuuacugaaucagccuuuucuugaggucagccuuugugcuauccagcacugugacauguucgcagaaaguguugccuuucucauuugaggcuuagcuaagcuugaggaagucuugguucauuaggguuagugaagaagggacugaugguucugcccucauuuuggccacaucugccauacuguggacaguacuggccaucaguuuacaacauucaugaaugcagagaagaguagucucuccuucuuuacugcuuaccuuaaauacuuucuguagguuagcucuguugguuaggguguguagcgggugacaccaguauuguguguuuuaaucugggugcauuaucuuuuaugucauuaauauccuagaagagcuauuaauaacacuugcuggguuguucgauuuucaguuuuguuucagaugcuuagcaauuuacuuauuguuucuugaacuaaauacauugaagaguaaggccuaaaaguagugguucaugaacauucacuuguaaaaacagaaacauuccuucuccuugccucaaguucuuacucauuuugaucuugccauucuaccuucuguguuacaaauuauucaacuaggguguguacugggccugucuacagacaaugaucagugcuuuuuaucauuuuaaaaagacuuuuucauuugcaaucuuuuggaugaaacauuucucagguuauucugccuuuggugauacuugauucuaaguagaugucuuguaguaccuuagucauuguaauauaagucccaguuucauguuuuguuuggggcucaguuccaaagaaguuaaaaauuaaucagcacuggcuuccaggaauagaucagaaagucugagugucuaaacccauuacagcuguuaaagcuguccuugcacccguggaaagcgagagugucauggauggguuguggcuaugucaguaaccuuacaacugagauuuuaaaaggcaaugacaaggccgggcacgguggcucacaccuguaaucccagcacuuugggaggcugaggcaggcagaucauuugaagucgggaauucgagaccagccuggcgaauguggcuaaaccaugucucuacuaaaaauauaaaaauuagcuggguguaguggcacacgccuguaaucccagcuacucaggaggcugaggcacaagaaucgcuugaacccaggggguggagguugcagugagccaagaucgugccacugcacucuagccugggugacagaguaagaaucugucuuaaaaaaaaaaaaaaaaaaaagccaggcgcgaugguucacgccuguaaucccagcacuuugggaggccgagacgggcagaucacuugaggccaaggguucaagacuacccuggcuaacauggcuaaacccugucucuacuaaaaauacaaaaaauuagcuggcguaguggugggugcuugugaucccagccacucaggaggcugaggcaggagaauugcuugaacccaggaggcggacguugcacugagccgagaucaugccacugcacuccagccugggcaacagagcgagacucugucucaaaaaaaaaaaaaaaaggcaacaauaaauccaaggugacaaaaacagcuguaaaguuuuuagcugucuuuucaaaaacgaaaguuguaugcuguacaguuguggucuuggcauuccugugcugccuauacacaagcuaugaagagggagaaaaggggguaaaggugguugugcuguuacagguuuuguauuuaauucuagcuggcaugugagggauuucauucaugugccagagugggagguccuggagugggguugcccugcugucugaaucuucccaccagcuacuccuaacgagcucuggugguuuacccuaaucuagcggcacucuuugcuuuccuguagcucaguggcuucaucuguuuucuugucuuggucagucaagggacagaucuacgcuuguuuaguugguauuuuggcuucaaacugauuuuuuuuuuucuuuucagaagccucaguuaaagaaugacuuaaauauacuucuuccccauuauaggugauacaggcucguugaauaaaauuuggaaaguaaaguucaaaaauaucuuggcauauuaccuuucauacuucuaugcagguauacacacaaauugaauuagaucagagugaauuuuuaggcuauuugauauuaacaaaacuuuuauagaaauucuauguugcuuuauacuuucccccacuaauggacaagacauuguuuuuccauauccuccccagcauacuucaugcuaacauaauucaaaauauuagccaauuuugucugcaaaaacuagcaucguuauuucacuuggcauauuugccuaucuuugaccaauagucaaagggguguguguguguguauuuuagagacagggucucacucuguugcccaggcuggaguguacuggcucagucacggcucacugcagccuugaccucccagucucccaaguagcugggacuacagaugcauacuaccacacccagcuaauuuuuuuuuuuuuuuuuuuuuuacagaagggaucucgcuauguugcccaggcuggucuugaacucuugaccucaagggauccuccugacuuggucucccaaagugcugguauuaugagcaugagcuaccacacccagccugaccauuuauuuuugacucucaguucuauucauggcuucuuuucuccaacuguauaugucugauauucuucacacuuuuugggcaaacaguuacaguguguugauuaaagauuuaucauccaauuucuuuuucccaucuguguagucuuguaauuuaaaaaaaaaaacaguacugaauauauugcauguaauuuccugcuuuuuucucacuuaaaccuuaagccuuuucacacauuaaacauugggaguuagucggguaugguggcucaccccuguaaaucccagcacuuugggaggcugaggugggcagaucaccaggucacgaguuugagaccagcuuggccaauauggugaaaccccuucucuacuaaaaaauacaaaaauuaggcggguguaguggcgugugccuguaaucccaccuacucaggaggcugaggcaggagaaucacuugaaccugggagauggagguugcagugagccgagauagugccgcugcacuccagccugggcgacagagugagacucugucucaauuaaaaaaaaaaaaaaaagggaauaauucucacuuuuguucugauuuauaacaacuuaaaucguugaauuaguaggucuuuuuaaaaaacagcuuuauugaaguaugauggacauaaacacaucuuuaaagugcacguuuugauaaguuuuaacauacauauacacaugugaaaccauuaagauuuaccuaugaugugugagucaagagccuauucccuuucauagcugaguagugguuuguuguguagauauacuacuauuuacuuguuuaccuguugaacauuugggcuguuuccaguuuuuaacuacuacagguaaaggugcuaugaacauuuauguguaggucucuauguggauguuugcuuuugugaggacccacuuguaacccccagagauaguaugaagauuauuuuaaacuaaagacauuugagauucaacagaugcagaaagaagccuaaucagaaauuccuuacuuuaacuaaaggcagaaacuucugggaaugaggcugcuaaaaaucuccucccuuggggaauguucuuggacuggaaaaaaaaaaaaaaaaaaaaagauggagaagaccacucaucugcauaaacaaacauuacgacaaaauuuaucucuguuccccuugaaaccgauuuauuuucccauagaagccuuuucucccguauccuuuuuccucgguuaauugaguuuguaaacucccuuuuuuagcuguuuagaguacugcuuuugugcacuuccauaugcguaugaaaaaguuuugguuuuuuccuccuguucaucugugcauugucaguugaauacguaggcccucaauuacugaaccuaaguugauaaaggagaaaguuuuucuuccugguauauucauuucucucagguaaauacacagggguggaauaacuggaucauauauuuaauguuuuuaaaaaauucuaggccgggcacaguggcucaagccuguaaucccagcacguugggaggcugaggcagguggaucuugaggucaggagauugagaccauccuggcuaacacggugaaaccccgccucuacuaaaacaaaaaauuagccgggcguggugucgggcaccuguagucccagcuacucgggaggcugaggcaggagaauggcgugaacccgggaggcggagcuugcagugagcugagaucacaccacugcacuucauccagccugggcaacagagcgagacuccaucucaaaaaaaagaaaaaaaaaauucuaaacuuuuccauaguaguugugccacuuuauguucucaccagcagguccaguccuugacaacacuuggugguuuaauauuagccauucuaaaauugcucugcauccuugccauagguguguaguaucucauugugugaguauguguguguguuuauaauaacuuuauugagauauucacauaccaaguggcuucuuucucuuaguauaaugcucucaguguucauggguauuguagcagguuuucagugcuuuguuccuuuuuuaaaaucagauaauuuaaaucagauaauuuaaaacaaauuguagaauaaccauagguuuacagggaaguaguacagauaguguagaguucccacacacccuagacccagucuucucuguuauuaacauuaauacuugaguauggcacauuugucacaauuaaagaaccaaauuauuauuucaugguuuauaguaaaccaaauuccauauuguuacucagauuuccuuaguucuuaccuaauauccuuuaucuguuccaugauccugucugggacacuauuucauugucauguuuccuuaggcuucucuugacugacugugacaguuuccuaaacucuccuucuuauugaugaucuggacaguuuucaggaauauugaucagguauuuugucaaaugacccucaguuggaacuugugugaaguuuuucccauuauuagacuggguuuauggacuuucuaggaggaagacuucagauaaaaugucauucucauuauaucaagggcacauacaagcaauaugacuuaccacugauguugauguuaaccaaccaaccuaccuaccuuccuuccuuccuuuuucuuucuuucuuucuuuuuuuuuuuuuugacagagucuugccguguugcuaggcaggagugcagugacgugaucucugcucacugcaaccuccaccucccagguucaagcaauucuccugccucagccuccccaguagcugggauuacagguacuugccaccaugccuguuuaauuuuuguauuuuuaggagagaugggguuucaccauauuggccaggcuggucucgaacuccugaccucaggugauccaccugccuuggccuccaaagugcugggauuaugggugugagccagcaugcccagcccacugauguuaaccuugaucaccuggaugaaauaguauuuguuaguuugcaccaccaccccucccugccaauacuuugcacaacccguacuuaaguaguggagaauuacgcucuaucuccuugaggguggaccgucuacauaaauuauuuggaauuucucuccuuggagaucuguucaaucuucccuauuuguucagucauuuggcuuguggauauuuauuuuguacucugagcuauagucuaauacuacuuuaacuauuuugcuguucugauguuccagcuuuggcuguugggggcuccugugucccuuuggucacuccaucauuguguguuucuguguguggugguuuuuuguugguugguugcgauugguuuuuucuuuuugaguacguacuuucuggcacuacaagauauuucaggauuaucuuguagaauugcugcuucaguccuugaaauagcuauuugucuaaggagcuuugguuccuuuuauuggagaauggcucaggcacuccaucugccuuggccucccaaagggcugggauuagaggugugagccagcacgccuggccaauauuucacaucuuaaaaacuuuaugaaauggauaauuuuuaagcauuuacaaauguagagagaauaguauaauaaaucuccccauguaccuauccccuaacuucaauuaucagcuuaaggccaaucucauuuucucuauaucuaucccaccucucucuaucagauaauuugaaacaaaucuuagauaaguaauuucauuagaaauuauuucagcauguaucucuaaaagauaugggcuuaaaaaaaucaauaucaucacauauaaaaaauucucauaaaccaugaagucuguucaaauaucuuaguugguucacauuugaaaaauuguauuaggauccaaauaggcuggaugugguggcucaugccuguaaucccagcacuuugggaagcagaggcaagacaacugcuucaucccaggcauuugagaccagcuuugggcaauguggugagacccugucucucuuucuaaaaaaaaaaauaauaaaaaaauaaaaauagaugggcgguagggggaauccaaaugagguuuauauuuugcaguuagucgauuuaagucccuugacuuuuagguucccauuccuuuuuuuaucuuccccccacccccuaccccauugguugaagaaacucuuuuauccugucauguuuagguuggcugacuucauccuugaaguacaguacauguuccucagucuucugaauucuugugaaucggugguuagauuuagagcagugaucucaaccuuaaauuuuaaaaauucuaauguccaggcuaugucucauacuaauuugaauuucuagucuuaggauccaggcaucaguauuuuuagcuccucaggugauuguacugugcugccaagauugagaaccacaguagaucugggcauauucagauucacuuucuuucucccucccuuccacuuccccucuuucucuuuaagcaagaauacuucauagaugguaguacagacuucugucaggaaguacauacuugguuuucucuuuuuguaauguuagcagccauagauuugagagcuccauuauuucauaaagggaggcaaaaaggucauuuuccaauucuauuauucuuucauuuauuaauugaaacacuucuauaaagagaaacucccagauacuauuugguuacugccaaaauuuaauuucuauaagaaaggcauuaauguuugauuuuacagauggcuuaucaacuuauaaugggguuaugguccugauaaucccauuauaaguugaaaauauuguaaguugaaaauucauuuaauacaccuaaccuaccagguaggauauuuuuguuuuguuuuguuuuguuuugagauagucucacucugucacccaggccggaguacaguguuacgauccuggcucacuacaaccuuugccucugaggcucaagugauccucccaccucacccuccugaguagguggaaccacaggcacgcaccaccacacccagcuaauuuuuguauuuuuuguagagacgggguuuugccauguugcccaggcuggucuugaacuccuggguucaaguaaccugccugccucugccuccccaaagugcugggauuacaguaugagccaccucgcccagugccuaccagguuguuuuauaaagauccauuuauggccauucuuuuuaaagggcugcauaauuggaaaagacuaauauaucuuuuguugggguuguauaaauuguuuccagucucauucuuauaaauaggacuuuguuaaacugcuuugagauacaauuuaaauaccauacaauucacccauuuaaaguguacaaaucagugguuuuuaguguauucacaaauacauacuaccacaauuaauuuuagaauauuuuugucaccucaaauucugcacccuucagauauugcucucuuguucuuuccccccacugaaccccuaucaccccaccccacuuaguccuaagcaucugcuaaucuuucuauauuucccuauucugugcauuucauauaaaugcagucauauaauauguggucuuuugugucuggcuucuuucacuuaggaaaguguuuacaagguucuucaauguuguugccuguauccagacuuuuauucuuuuuuuuuuuuuuuuuuuuugagauggagucuugcucugucgcccaggcuggagugcaguggcacaaucucggcucacugcaaccucuuccucccagguucaugccauuguccugccucagccucccgaguagcugggacuacaggcgcccaccaccacgcccgacuaaguuuuuguauuuuuaguagagauggggucucaccguguuagccaggauggucucgaucuccugaccucaugaucugcccgccucggccucccaaagugcuggaauuacaggugugagccaccgcgcccggcuccagacuucacucuuuuuauugcugaguaauacuccacugcauaaauauaccacguuguuuauccguucgucaguccauggacauuuugguuguuuccacuuuuuggcuauaguaaugcuucuauguacauuaauguacgauuucuugugugaacauguguuuucauuuuucuuggguauguuucuaggaguucacuugcagagucacauaguaacuuuauguuuuaacauuuugagaaauugccagacuguuauccaaaguggcugcaccauuuuacauucuugccagcgguauaagaugguucuaaucucuucauuuucuuugcaaacacuugguaugaucugacuuuuugauuauagccuacuggguguaaagugguauccucuugugguuuucgucugcauuugccugaugacuaaugauaucaagcaucuuuucauguguuuauugagcauuuguaguauaucuucuuagacaaauaaucugaguagacauuuuuccaaucuguuaauggauuauuugucuuuauuacugaguuguaaaaguuacucacauacuugcuuguuagccugcauguaaacaucuaaauccaucagccuacguguccugauuuuugcgcuacacuuccaucacuauucccuguauuuaauaaauaauuagauuauuuugauaaacuagucuuuaauacuauguaguuauauuguuuccacacauggcuuugcuuagguguguuuguuuguuuguuuugagacagagucucgcucugucacccaggcuggagugcaauggcgccaucauagcucaccucuauuuccugggcucaaaugauccuccugccucagccucccaagaagcugcaucuguaggugcaagccacugcaccuagcugauugauuuuuuuuuuuuuuuuuuuuuuuuugguagagcuagguuuuucuguauugcccaggauggucucaaacuccuaggcuccagcaaaucucuacccucccuuaccccuccaccccugcguuggccucucaaagcacugggauuuacagacaugagcuaccacacccagccuugcuuaaguauugaguuuguuaugggcuucuagaauuuugaucuuuauacuuacuugucugaggugucacuaaugggcaaggccauuuuuguuuuaccauaagguguauagcaauuggauaaaaauuaaugguaggaggauaguuauugagauggcagaugaggcacugauugugauauaagugaauuuguauuuagcugaacuuuuggucaugauuaaaauccugacagauguagugcuugaauuuguuuuuagcaauuuuacugcuucugucuauaaaauauguuaaacaaugagagaauauuucucuuacgauacaguugaaauccuaggaaacuuuaucuuggaaaaaaaaaaaccugguaagaucaaauuucauuuuacucaaacuacaguguuuucugaaagaugcaggaguugcuauccugccaaccuguuuuguuguauucagagauaauaaccuguguagugcccauuacauagugaaguuuuuuguuuuuuguuuuuuuaaaacagcaucucuguugcccaggcaggaguacagugcugcaaccacggcucacugcagccucaaccuccugggcucaagugauccucccaccucggccuccugaauagcugggaccacaggggugugucaccacaccuggcuaauuuauuuuuuguaaagauggggucuuccuauguugcccaggcuagucuccugagcuugagugauucucccgccucagccucccaaggugcugggauuacaggugugagccacugcaccaggucacauaguggcauuuuaaugaacagugcaaauguuacaucuuugcccagugauuacuguuaauuuuaaacuuuggacuuugacguuaaaaauuaaguuuuaaggccgggugcauuggcucaagccuguaaucccagcacuuugggaggccgaccgagguggguggaucauuugaagucuggaguucgagaccagcccugccaacauggcaaaaccccaucucuacuaaaaauacaaaaauuagcugggcguggugguacgugccuguaauuccagcuacucaggagaccgaggcaggagaauugcuugaaccugggagguggagguugcagugagaugaggucaugccacugcacugcagccugggugacacagugagacuccaucuaaaaaaaaaauuaaaauuuaacuuaaaauuuuaaaaucagccaucacuuuaaugaacauauaagcauauacaaguagagaguauauaauaaauccucauguaccugucaaccagcuucaaaauuuaucaacuuucugugcuugcugguaugaagagcuuuugaagaaucauuuuccuuacaagguggugacuuuuugagaaacggguguagccuauugagcacugacuuuagagucacguaguguggguucacauccugacucuucucguauuuccugucccgcugggcauguggccuuuccucuuugaaacucaauuuuugcaucuugaaaacaggguuaauaucugccuuugaagauuguucagaugacuaaguggaauaaugugugugaagaauccaguguguuugguggcugauuacuguguggauauagagacuucugggaggagggauuucuccauugcugugugggagucccaaagucuauagcucugugcuagggccuguucuagauacagcugugaaguugagucugauuuagacauggacaagugaauggccuuccacaguaaaaacaagccccuggguuagguuggaggugggugcuuacuauggaagaugggagagagguguauuaauuuaucagggcugcuguaacuaauuuccacaaacugggaagcuuaaaaccuaguucuggaaaccagaagucugccaucgggugcuggcaagacuuccuccuagccucuaguggcugugcccaaucuuugcuguuccuuggcuuguagcugcaucaucccagucucugccuuuguagucacguuguguucucccuguguguguccguccaaauuucccucuuaaaaggauauuagucauuggauuagagcuauauucagagguacuggugaauuuuuaaagggcgcuauucaucccaguacagggaguuaaccaagacuggggugaucagggauuguguccuagaaguaagaagacauaguguguucuaguuuaaagguaguuaguagggaaucaguugggaguggaugagaguaauguaugacagucuugaaccauauuaaauugcauggaugccacucaucggccaagaagcauggugggcaguaggccgggcacgguggcucaugccuguaaccccagcacuuugggaggccgaagcggauggaucacgaggucaggagaucgagaccauccuggcuagcacagugaaaccccgucucuacuaaaaaauacaaaaaauuagcugggcacgguggcaggcacuuguaguccuaguacucgggaggcugaggcaggagaauggcgugaacccgggaggcggagguugcagugagcugagaucgugccacugcucuccagccugggcaacagagcgagacuccaucucaaaaaaaaaaaaaaaaaaaaaaaagaggcauagugggcagucuccacgguuuuuaccucaaaauucacagugcaguggguauucuuuuguauucacggcugaacauuaauuuugaaauagccuuuuuauauuuaaagacauuaccaaguuacgacuuucccaacccaucuuagaaguugacauucaaauucucugcauccccugaccucucaccaguuagcugaccauggcuugaccucucaagugcaccuguguaagacuucacucguuaacaauaagagaugcauggaauugccccguguauagccagugcauggauguauauuuuguagggaccaaauauaagcuauaagagcauauagguuccaaaccaaguauggacugggaguggcgaguugcagacacaacucuggaauccugcuguugaggacagaagcaggcacauggggaggagcaguuugaagacuagaaaauugagauuuuguuuuguaguaucuuuaaacuccaggugaacuugguuggugaauagagcuucugugagggcaauuuacuguuuuauagaauugauuuccuaaaagauuugccauuaacugaacugucuucugcuaaccauaacuucuccuugauuauuaauggaccccuguuacucauuaaaaccuuuaaaauuacuugagaaugccugcuucuagucccaguucauucgcaauaggugcuauccaaauugguacccaaauauuuucuaaacaacaugaaguggaaucacaucugagggguaggaucugagugaaaaguuggauuaauagaauucuggaccaaaagcaguacuuguggacuuaagcaguuuuuuaacuacagcagauauaagagaacauggcugggaucaaaaaaugccuuuaucuugaauacacacuagcugagacagagcaacaguggguguggggaaaccuugguuugccuuguagaacuaccugcuccaccccaccaauaaauuucaaaaggaaaaaauuucaaagacauuuguaacacugauaauuuguccacccauuguucaaaagcagcugaacuuauuaugaaacacauguccaucauaggaaacaaaugcuaauggagggagggacuccacuaguccgcuuucuuccauagaacucugaccuuguccuagcaguguguucaauaugccacaaugaguuggugugguaagcaucuuuuuuuccucugcuuggucuccaaauaauucauacauuugguucugcucauucaauuguguuucuccaguacucuuccgggggagccuuacgaauagaagagaaggccaggcacgguggcucacaccuguaaucccagcacuuugggaggccauggugggugaaucacgaggucaagagauugagaccauccuggccaacauggugaaaccccgucucuacuaaaaauacaaaaauuagcugggcaugguggcgugcaccuguagucccagcuacucgggaggcugaggcaggagaauggcuugaaccugggaggcggagguggcaguaagccaagaucaugccacugcacuccagccuggcgacagagcgagacucugucucaaaaaaaaaaaaaaaaaaaaaaacaagcaaaaauuagccuggcaugguggugcacgcccauaaucccagcuacuuaggaggcugaaacaggagaauugcuugaaccugggaggcagagguuacagugagccaagaucauaccacuacacuccagccugggagacagagcgagacucugucucaaaaaaaaaccaagaagagaaaugucuauuuuccuggcauuuuuuuuuuuuugaaaacuaucuaaaggccaguguaauucagauuugauauuuguuuucauuuucuuccugauucuaaaauuauauacuccuuguagaaaacuugaaaagugaaaagaaaaagucuuucucccaauggcaacauuauuccgugacuaauaguucaguuuaaugauuaggcauuuuucaacaucguugggucuugcauguauaauuuuauauccuguuuuaaacauuuuuaauuuuuuuaaaaaucgaacuauauuugaugucauaaaauucaccuuucugaagcauacaauucagugguuuuuaguauagucuaaagguuuggaaguaucaccacuaaucuuaagacauuuuaauuacucccaaaaguaacccuauagccauuaacagucacuugccccuccuaucuuccagucuccucccaggcccuagaaaccacuaaucuacuuucugagucucuagcuuugccuauuguggacauuuaauauaaaaggaaucauauauauguggccuuuuaugucuggcuuccuucacuuagcauaauauuuucaaggugcagccagauuuuaguagguacuucauuccuuuuuauggcuggguaauaauuauugugugaauauaccacuuacuguuuauccauccagcagcugauggacauuuagguuguuuccauugaaugaugcugcucugaacacugguguacauguuuuuguguaaacauagauuuucaguucuuuuggguguauacccaggaauggaauugcuagaucauaugguaacuuuuugaagaacaaccagacaguuuuccaaagaggcuguaccauuuuacauucccaccaacgaugucugaggguuccaguuucccuauauccuuugccuaaacacuuguuauuauuugucuuuucaauuauagccauccuagugggugugaagcgauaagucacuuuaguuugauuucuguuacccuacugacuaaugaugucgagcauuguuucaugugcuuauuagucaucuguauaucuucuuugaggaaaugucuauucacuuccucugcauaaaaaaauggguuauuuggccuuuuaguguugaguuuuaagaguucuuuguauaugcuagauguaagucccuuaucagauauaugauuugcaaauauuuucucccauuaucuaugucuuugcacuuucuugauaguguucuuugaagcacaaagguuuuauuuuuuuguucuuuucuuuuuagcacaguuuuuuuuuuaaauuuugucauaaacauuauguaauuggacuccuuaaguuuauaauggauguuuuuucuguucuauguguaacugguaauuuacuuaaccauuccucauguuuaaccauuaccacaguugugaacauaucuguggaugaauuuacacccacauuccugcugauuucuuuagugacaauugaacagaaauaaaauuagcaggucaaagauuagcaaucuuucaagguuuuuuuauuuaguuaguuaauuuuggucuuugagacagguuucgcuguguugcccacgcugaucuuggcucauugcagccuccgccuucugggccaagccaaccuccugccucagccugucguguagcugggacuacaggcaugcaccaccauucccagguaauuuuuuguauuuuuuguagagauggggucuugccauguugcccaaaauggucuugaauugcuggacucaagcgauccgccugccucgggccucccaaaguguugggauuauaggugugagccaccgugcccagccucaaggcuuuuucuuucuuucuuucuuuuuuuuuuuuuuuuuucuuugggagauggagccuuacucuguugcccaggcuaaagugcaguggugugaucuuggcucacugcaaguuuugcuuucccgguucaagccauucuccugccucagccacccgaguagcugggauuacaggugcccgccaccaugcccggcuaauuuuuguauuuuuaguagagauagggucuccaaacuccggaccucaggugauccgccugccuuggccucucaaagugcugggauuacaggcgugagccaccgcgccuggccucaaggcuuuuuuuaauugcuaaauuuauuuugagaaauaucucaaguaacacuccucccagcagaguuuaagacuucuuccagugaucccuuguuagugcuguauguugauguuagcaucuguuagcugugauuccuuugcccuuuugcaaguggagcugcuguguuuucccaaaauuauuuguguauuuuaaagucaguuuuaccaaaucauguguuuucauguagugugguauucuuaacugcaccuauugaugggauguugagaacugcucaugcuaaauucaauucuauagcauaagucgguagugagagauugaguuuucuuuuuucccuuuauugaacuaguuuaggaauuuuauuauaaggccccauagagccagaaggauaacugcugcacaccugaaggacuaauucuuguaggaaacauuccuaucauuauugacuuuggaaucuaccucuucuccuccuccaguugcuuuuauucuuacuuuuaaacuaagcuuuaaauagggguaguggguaaaaugccagcaucugggauggucugcuacugcuuuuggagaccauacaaucguggacauuuaucaccucauuuagaaaauucacuucuuauucugugauuuuaccagaauuauguuuggaguuguaaucaggcuuuguucugaacugcugucuuucccuuuuucucuaguaauuuauagcuguuuggagugguauuccugccuuucugcuaaaggaguaagcuaguuacuaaaacugguguuugcuucuaggauucucuagccuuugcauuuuguuuuagcggcgaaaagccuagaagggggccugggcagucagugcuguccuaguucuuugcuugacucccccagacuguguggcauguugggggacccuaugccugaaggggguggaaugaaagaaagauagcagaucaauagcugggacucccaccuauugaauuccauguggcaguuccaaagguuugcauuuaccaacacggauggaucaccaagaugacagauugggguggugggggaggguagcaagauaaggaaugucauacuuaagcaaguuacuuaaaaucgaccucaguuuauucauauaugaaauggggauaauugcuacauucugaggcauaaauaagauggauuauauaaaauguuuaaaacaguauuugacacucuagugugaaaauuuaaaacucaacaaauauugcucuuuggguauauaugugaauauaugagcauauacacauaccuuuuuaaaaauugagaaauucacauaauauaaaauuguugcgggaagucagggacccugaacggggggaccggcugaagccuuggcagaagaacauaaacugugaagauuucauggacauuuaucacggaaccugccgacaugugaugucucccccagacaccuagcuuuaaaauuucucucuuuuguacucugucccuuuauuucucagaccggccgacacuuagggaauauagaaaagaaccuaugugaaauaucgggggugaauuucccccgauaucaaaucauuuucuuuuuauacuuuuacuuauuuaucaucaucaucaucgucacuauuggagacagagucucacucugucacccaggguggagugcaguggcgucaucauagcucacugcauccuccuaacucuggguucaagcaguccuaccaccccagccucccgaguagcugggaguacaggcacucaccaccacaucuggcuaauuauuuuuauuuuuguagagauggggucuuuccuauguugcccaggcuggucucaaacucuuggccucaauugaucccuugcuucaagugauaacuuggccucccaaagagcugggauuauggauuugagccaccaugcccagccucuacuauacuauuuuuauauaagggacuugagcaucugugaauuuugguauccaagguaggggguugcugaaaccaaucccucacagauaccgagggaugacuguuuauauguaccauguuuuguuuuauccauucauuagucagaggaugcuuggguugcuuucaccuuucaauuauuggcuauuuugaauaaugcucccaugaacauggguguagaaguacuucuuugagucccuguguucaguucuuuuggacguauacucgguuagugcauuuguguugcuguaaaggaauaccugaggcuggguaccuuguaaagaaaauagguuuauuuggcucacaguuccucaggcuauaccagcauggcuccagcaucugcucagcuucuggcaaggcccagaaagcauuuacucauggugaaagguagaggggagugggcaugucacauggcaugagagggagcaagagagaaaaggaaguuccagccucuuuuaaaacaaccagaucucaugugagcucacagagcaauaaaucacuuguuaccucaaggauggcaccaagccauuuaugaagggucugcccccaugacccuaacaccucccaccuggccccauccccaacacuggggaucgcauuucagcaugagauucgaagaagacacaauguucaaaccauaucaauacccagaaguggaauugcuggaucauaugguaggucuauuuuuaauuuuuuuugaggaacugcuguacuguuuuucauagcagcugcaccauuuuauccagcaauguaugaggguuuugauuuuuccacaucugugucaacacucauuauuuuccuuuguuuuucuuuuuaugaugccccuugaaucauauuuuccuucuuuuuaaaaaauuauggccauucuaauggaggugaagugguaucuccuugugguuuugauuuacauuucccuaaugacuaauggugcagagcgucuuuucgugugacacacacacuucuaaaaacaccuggagagaccccaccaaagcgacagugguuucuucuagggguugggggaagucccuguuuugaaagcaggugguucaaaaaccaccuaacauugaacuauuuugaauguuuuuaugagcauuucugugaguaaaauguagcacaaguuaaugcuggcuaguaccuucuucugacuaagauguauagaaguaucguauuuaguacuuggaacaugagcaaggggauacaugggaguuaauaaagcucuuaaccugccuauggacagauuugauuuucuagugcagguaauggccgaguaaggauugaacugguuuccgucgguguauuuauauuuuauuuaaauugcauagggaaaugaggcaacuuauuagaccaagugauuaagaguaugggcucuggaaucugugagcuggaguuugaaucauuucuccagcauuuaucuguccaaguucugacacugugaacuuuucugugcugcagcuugcccaucuauaacauggaauaauguugccucaugggauuguguggauuugaguuaaaguagauaaagcauuugggacaaugcugcugccagaaagcacucaaauguuagcagcccugauucaugacugaacgaaggcuggugugguuggagagaagagaauggccuuaaaggaugaguggaacacggccuucagggcacuuguuagggaucucuuagaguuuauaguagggugugacuuguucugcucggcuuuuaaaaucagucuaguuccguauuauucuaagugaaguaacucaggaauggaaaaaccaaacgucguaugcucucacucauaagugggaguuaaguuaugaggaugugaaggcauaagaaugauacaauggacuuuggguacucggcggaaagggugggaggagggugagguauaaaagaguacauguuggguacaguauacacuaccugggugaugggugcaccaaaaucucagaaaucaccacuaaagaacuuauucacguaagccagacacaguggcucacaccuguaaucccagcacuuugggaggccagggggggcagaucacgaggucaggaguuugaggccagccuggccaacauagugaaaccccaucucuacuaaaaauacaaaaaucagccggggguggaggcacgugccuguagucccagcuacuugggaggcugaggcagaagaaucgcuugaaccccggguggcggagguugcggugagccaagaucgugccacugcacuccagccugggugacagagugagacuccaucucaaaaaagaaaaaaaaaaaacuuauucauguaaccaaauaccaccuauucuccaaaaaccuauugaaauaaaaaauaaauuaaaaauaaaaaucagucuagcucagcauugccaaagagaaacauaacguaagccccuuaagcucuggauucgguuuuuccacugugacuucaguguggcuggauuguuggacuguucucucucagagaguccaguguggccggauaacuuggacuguucucucucagaggcucugaucacaugacuccuaggaguccuaaagcaucaucuccuccccauguuagaggaucuaacuugugaacauugaaaguggcuagaaaguugggacgcuuugcuccgugugguaugauggaggcugagcuucccucuggggcuuuucgaugauaaaggggauaugcagcaugguuuacaaucuuauuaauggucuggucuguggugcuggcuuucuuaacuugacagucauuuucacaccagugugaggaaugguuugaguguuauccaaguaauuacggugcuaacauuuuagagaaauauacauuaagguggauauuucuuuauuuuguuuuagaauuauauaucaauauuuaacuggaaaugauuauuuggaaccugcaauacagauuguucuucauuuuguaauauagccauuucucacaaauagauguaaaagaacaguuccugagaugaucuugcccaugacagauaaguaguuccuguuuguauaaacugugcugagcuguuugaaggauguucccuucaucuccauaucccuagcgcuaagggugauucuguggagacuuuuugccucucuuguugcaaugaguaguagucaaggugacuccuuucuagaaaccccuccccaaugacugacauuggcuuuggugcuuggaaggguguguguguguguguguguguguuggcaagguguuuguuggggcaaguaagcauuaaauaucccgcuuugcauuuuauuaauacuuuaaucucacugugauuuuuguaaugcuuguuccacuucuauaucuuuuguauaaauuccugacaaauaccuguuugcuuauauuauuauggacuuuuaaagacaccuagaacuggcugggcgcagugacucacgccuguaaucccagcauuuugggaggccgaggugggcacaucacuugaggucaggaguucgagaccagccuggccaacauggcaaaacucugucucuacuaaaaauacaaaaaauuagcugggcgugguggcacacgccuguaaucccagcuucucgggaggcugaggugguagaauggcuugagcccaggaaguggagguugcagugagcugagaucacacugcugcacaccagccugggugacagagcaagacucugucuuaaaaaaaaaaaacaaaaaaaccaaaaaaccuagaacuagcuuccuuugcccuguagaacaaaaaaauagugugacuccuuuuuaaccuuuuauuguucaucacagauccugagcagugaguucaaagguaagacauggccccuucccuuaugagguuuaugggauagugcagcucuguguuagagccacauugaaggaguaacccauuuccagagagauuuucaggauauauauugguacacagacuauaaugcccgacauuguuguuccaucuucugaaacacauaaggcaaauguaacagucaaauaaaaaagauuuggaaucuaagaucguauguaugauaaauuaccugccagcuuaagcauggaagucagugugacucugaaaacuagauuacugugacacaccugacaaucacaucacuaugguuaauaaucacuagucuagugggaaaauaaagaucaggaaagagauuauaaagugacauugcuuucauuuccaagaauggguauuagggagaugacgagagagguacuuuacccaguuuugagggcgugacuagagcauaggugugggaaguauguuggauauauggaagagagaaguaguaccagguaacugacaaccucuuaugccauguugaaguuuggacaaguuauacuggcaauuugaaaccacagaaggguaguaacugcuggcaggaggauauagucauggaguguuaggcuacaggcaagcaugcuaaucagacuugguucagauagcccaggagugaugggacuugagcaguggguaugcagaauaagcagucagcagaaggcuuaucugcagaacauaaauuaucuaccucacgcccauagugguaucaacuaaaauacagccaguuuugugagggagguggggauauaucugguauguggcugagaaaaucugaucacguugcaggucaaagacaguuuuuuaaacugucuuuauugcagugaucucuauaugugucaauaaacuaggcuacuagauugaagagaagcaugaagaaacuugucaugauggugauaguuuagugaguguauacauaaugucaaagugaaucaaauuucuugcaguuuauucuguauuucaaugauacuguuacugaaccaaacugguucuguuuguccaugugcaauggaaagcaaacaccaaagcauagguucuuuuguaaagagaaaaguucgugguaagacugucaagcaaggagacagucagguucaaaucugucucccccagcugggggcugggacauauuuuauagacagaggguaaugagguaugaucugauugaaucuuacaaugaugugaugccaggaggugugaucugacuggaucauaccaggaggugacaccagggcucaaucugauuggaucauggaucaugucaugugguguccacuucuuaauuugguccugucucgguccaggcacuuagguucugcuugugguugcaugcgugguucaucuggacaggcucagguuacagaacuugcaaccuggggauccauggcaacugaagaacaaaucaccauuuugucacacaaagcugaaccagacuaggccgguucuguggaugaugcuuggccaaaaggccaagaagugaucaauaauacuucagaguuuaaaaggcaaaacuaggccauuaccugguaaaguugcuuuuaguauuuuuuuaacagcuuuauugagauauaauucacauacuaugcaauucaccauuuaaaguguacaauuauuuuuuuuuaaguuuuuuuuucuuuuuuuuuugagacaaaguuuugcucucguggcccaggcuggagugcaauggcgccaucucagcucaccacaaccucugccuccuggguucaagugauucuccugccucagcgucccgaguagcugggauuacaggcaagcgcgaccacgcccggcuaauuuuguauuuuuaguaggugcgagguuucuccauguuggucaggcuggucucaaacuccugaccucaggugauccgcccgcuuuggccuuccaaagugcugggauuacaggugugagccaccgcgcccggccuaguauguuaauagauacgugcaaccaucaccacauuuuuaggacaccuucaucaccucaaaaagaaacauuuaacugucacccuccacuuucacuuuccucagcccauagaaaccacuaaucuacuuucugucuaucguagaguucccuauucuggacauuucauacaaacaaaaaucauauaauaaguaguuuuuugugacuguuuucauuuagcauaaugccuucuuuucuuucuuucuuucuuucuuucuuucuuucuuucuuucuuuuuuucuuucuuucuuuucuuucucucucucuuucucucuuucugucuucgcuauacuaacaagguaaccauaauacuuucaaggucugucuguugcagcauguauaaguaccucccuuuuaugguugaauaauauuccauuguacaaauauaccacauuuuguuuccauucaucagucaguaagcauucauucggguuguuucuacuucagacuauuaugagugaucuuaauuuuguaccauuacauucaggaagugauaaucuuugcauuuuucaugugauucuuucuguacuguuuauacauuugaaugaacuuuguuuuuuuguuuuuuuuuguuuuuaaauagauggagucucuaucuguugcccaggcuggagugcaguggugcaaucucagcucacugcaaccucugccucccggguucaaggauucuucugccucagccucccgaguagcugggacuacaggugcgugccaccauguccagcuaauuuuuguauauuuaguagagaugggguuucaccauguuggcccggcuggucucaaacuccugaccucaagugauccacccaccucggccacccaaagugcugggauuacaggcgugagccaccgcgcccagccguggaugaacuuuuuuuuuuuaaaaaggcugaacauuugaggguuucacguccuaaauacauaacgggggaauucuagaaagacauuuucuaugaggcuuuacuuugcauuuauaccccuuccucccuccccugucguuggaauuuaaacuuaccuaagcauagagaaauguuuccuuucugguuuaagauuuuauuuagguaugggaacuugugaaaguguuggaaauauagaguggaaagcuuuuuguuuuuuuucgugguuuuuuuuuuggccuuuaagacuguuuaaaagaaguauuuguggcugacauagaaugauuagcaguacugagaggggacaagaaucuaggagacaaaaacaggugcauaaguagcuuaugugacagguaacaggaacacugucuuaucuuccuguuuaaugcagaauuaagcaaaaugcggccggacacuguggcucacacuuauaaucccagcauuugggaaggcugaggcaggcagaucacuugagcucaggaauucgggacuagccuggccaacauggcaaaacuuugucucuacuauaauacaaaaaguagccaggcgugguggcacaugcauguaaucccagcuacucaggaagcugaggcacaagaauggcuugagccugggaggcggagguugcagugagccaagaucaugucacugcacuccaguaagacucugucuuuaaaaaaaaaaaaaaaaaaaaagcaaaaugugagaacuuaccaaguguaaguuguauuuauucuuugagaguucagugggcuggaguggcaugauaccauuugauaggccuugauauaaaagagcauauucaaauaauggccugccuuaagauugaugggauuacuauaguacaguucaagucauuuggggguuggaaauccuuuugagauuugggaaucuuauuaggcuauugacagcccuuucccuauucuguugucauuacuuccaagccuuguacaugaaacuuugaguaagacaucaaagauccacugaaauccaucuauggggcuauguaaaaucuccuaaguuguguuguuaaauuuuuuccacagcuagguaccaagauugauucugcaccuauuucuucuaaggauuagagggguuuuuuugcuugugguuuuuuuuuuuuuuucuuuuuuacuuuguuuuaaagccaugcuuguugaaguauuauucacagacaauaaaacucaccauuuaaaaaaagugcacaggauuguaguuucuaguuaucuuucuaaagacuuuacauggccaggugugguggcucacaccuguaaucccaucacuaugggagaccaagguggguggaucacuugaggucaggaguucgagaccagccugggcaacauggugaaaccccgucucuacuaaaaauacgaaaauuagcuggguguaguggugugugccuguaaucccagcuacuugggaggcugaggcaggagaaucgcuugaaccugggaggcagacguugcagugagccaagauugcaccauuguacuccagccugggugauagagugagacucugucuaaaaaaaaaaaaagauuuacacggaaguugacaaccaauagcauuuaucuauucuuaggaauagaauauuuaacuauacaggcaauuuuguuuugaauauaugcagugaaaauuuuaauguauauuucuacuugugugugugugugguuuuauaacuuuaacauauuugaugaucgguggcuaguucucauccucauugacugacuauagauuuuugaaagugguaacagguacauagguaaucaaaauauggagcucguuuggugaaucuucauuuucauuacauuuccuggacagcuguucacagauugugguauaggacguuccuuauuccuuuggcccagacaacuuuguugagccucaugucagugaacacaucuccuucauaacaaauuuccagaucucuuugaaugcccaggggcagucuucuugaagcccacuccauggauacccuuguaaaugaugaugcauucucaggucaucaccuuguugguggcagagcggcccuucuugucacaacccuucuucguagaagccauucuaccaggccuaacuuggaaaggaagagcaugaaaggauugucccccgauuuuuuuuaaguuaaaaaauuuaccuguaucauuuguauguguguguauauaaauauuuaucacuuuggcacuguagcuuuugaagaacauuuguugccuugacauuauuguagguuuagucgguauuguuuauagaucacagguguuuaacuuuuguaguguuaucucuaagaguaauaaaaguuaagguggcauaagguaaucuguguggagacuaauauacuuaauuacugaacaaauugcuuuucagaagaauuaagaaggauguuuauuuaauuaaacuuauuaaauuggcaauuacuuccuacucccugaaccccuccucuaccccugccuccauccaaguugcuauaaagcucuacuaucaguguggcuuucauuuaaaaacuaaauuuuauuuugagacagaaucuugcucuuuugcccaggcuggagugcaguggugcaaucucugcucacugccaccuccaccucccagguucaagcaauucuccugccucagccuccuggguagcugggauuacaggcaugcgccaccacugcaggcuaauguuuguauguuuaguagguaugggguuucaccauguuggccaggcuggucucaaacuccugaccucuagugauccaccugccucggccucccaaagugcuggauuacaggagugagccaccgugucugguccuaaaagcuauauuuuaaauaacauauuaaacugucaacuaccuccuagucccugaaccccuccgcuacccccaccuccauccaaguugcuguaaagcucuauuauuauuaguguggcuuucauuuaaaagcuaaauuuuaaugguagacauacuuuuccuccugacuucauuacugaagguggaaugaauuuguuagaauucugacuuaaguaugaaguaaaacauuuuucguauugaaaaaauuucauuuuuguuuagaaaauaaguagguugcccacugcaccgccaccccccaccccccaaccucccgcuuuuuuuuuuuuuuuuuuuuuuuugacacaaagucucgcucuguuucccaggcuggaaugcaguggcgugcucucagcucacugcaaucuccaccucccagguucaaguaauucucuugccucggccucccaaguagcugguauuacaggcacccgccaccacucccagcuaauuuuguuguuuuuucuuuuuuuuuuuagauggagucuugcucuguugcccaggcuagacugcaguggcacgaucucagcccacugcaaccuccgccuccuggguucaagcaguucuccugccucagccuccugaguagcugggacuacaagcgcgcaccaccgugcccaacuaauuuuucuauuuuuaguagagacggggcuucaccauguugaugaggcugcucucgaucuccucaccucgugauccaccugccucggccucccaaagugcugggauuacaggcgugagccaccgcgcccugcgaauauuuuuguauuuuuaauagagacaagguuuugccauguuggccaggcuggucucgaacuccugaccucaggugauacacccgccauggcuucccaaagugcugggauuacaggcaugagccacugugcccggccacccuuguuuuuaauuuaaggaauuauguguuguauauuuuaucuuugaauggcaacgugagagguuucuuaauuuuuggcguuuauaaaaugugucugugaucaacaucacauggcaaauucaccuauaaaacagacaagcacuuuuacagaguacucuuccuauaagauauaccaggauuuccuccuaugaaguauucacuucacucaugaaauauuugaaugucuuuuugugauuuaagaauagcuauaaucagagacaaagauuaaugugcuucuguguguauaccucaugcaaaagaaauuuaccaaauaaaaauuaaauuuaccucaugcaaaggaaauuuaccaaauaaaaauaaagggcauuucacucauaaauagguauuaaccuuauuuaaaagaaaaaccaggccaggugcugggucacgccuguaaucucagcacuuggggaggcccagcugggaugaucccuugaaucugggaguuugagaccagccugggcaacauaccgagacccucaucucuacgaaaaacuuaaaaauuagccaggugugguggcaugcaccuguagugccagcuacucagaaagcuggggugggaggguugcuugagcccagugguugaggcuacagugaucuauggucgugccacugcacuccagcauaggugacagugagacccugucccaaaacuaaaaacagaagcucaccccagacaaaccuuguuauauguuucaaacuggaaacaguagacaaaagccuaaaauauaccacauaagauaaaccuuccuuuagaagaaauugcuuaaguuuaguaguaaauuaccauaaaauuuguuuucuauuuccuggcaccugaaaaacauuuucaaggaaccgcccuuuuaacuuugcaguuaggcuagggcuaaguggcucacgucuguaauccuggcacuuugggaggccagggcaggaggaucccuugagcucaggaguuugagaccagccugggcaacguaguaagaccucaucucuacaaaaaauuuuaaaaauuagcugaggguggcggcgugcaccuguagugccagcugcuuggauggcugaggugagaagaucacuuaaacucagaagguugaggcugcagugagcugugaucaugccacugcacuccagccugggugacauagcaagacccugucucauaaauaaauaaauaaauaaauaagaaaauuuguaguuaaacugaugaguaaguaauuugcuauaauuuacagaaacuuacuuuguuuugcuauagcucuuagaagcuaaggacaccugaauuugguuuauauugaugagacguacaucugcaguugauauuauaauaaacuuacaguuacuguucuaacagccucuccauuuggauaacaugcauaguauaauaauacagcuacaggaaagaugguaaaaacauagacagcuucaaauuguacauuucccaaccccguguagacuuagaaauguuugcuucauuucacacuuuugcugucuauguauuuauguugggcuuuaaauuccacuccagguagaguaugcacugugcugucuucauuuuucuagccugccuugagcaaucuguuuuguaagaaccauucgagcuguaaaagaaguccuuuggaaaagaacaucuuauagauaaaacuuuaguuuuuuuuuucucuuuuuauuuuacuuuauuuuuuagagauggggggucucacuauguugaccaggcuggucucgaacuccuggccucaagcuaugcucccaucuuggccucccaaaguacuaggauuacaggugcgagccaccgcgcccuguuaaacuuuaguuuguaacuugguuccuugucuagugacuuuguuuacaaggagaaaguaugaugauguguuuguguauguaugagaaauauaugcucuuucuccuucagccucaggaaccaggcggcuguggcuuugcauacuuuucugagccaguucuugguuagccauaggaaaugagauuaaugucagggaucuaggagagggcagaagagacaagucugagugugauauuugugguauccaucccuuaguucugcaguccaaagccccagauaauuuuuuggcucuuuuccaucacaauuacuuagugauuuuaagacauauuccugcccuugauaauaacuugggaaacucaaaauuuauaauuuucucucccccuccugauaggugcuggauaguuuacuaguccaguauggagugguggagagcugugagcaagguacaugucuucugaauugcuuucaaauuuguaaaaggaaggaaguagaaagaaaacuaacuuuuauucucuucguuuuucucuuccucuagugaacacugacucggaaacugcaguuguaaauguaaccuauuccaguaaggaccaagcuagacaguaagcagcuugaagcuuuuaaucuauauauaauaacuaaguuaaguacaguaacauauuuugcggauuucucaacugagaagggcugguagguggcagagagaaacuuuauuuuacaaaauuugacccuguaaucgugccuuucuuuuuaaguuugaaugucuaguaaaaaucuacauugguuaaaguuguauuacauuuucaauauaucuuuaaugccaauaauagaguggucuaguaugaaacugaaucacacccuauuugcagaagcucugggccuugguauuguugccaaauaacauaaagucucuccccgucucccccucuuguaugacacauauauuauggcuauuuuaucugaagcugguaaguuggaucauguguuaaacaacaguguuaaaugauaagucuucuuacucacugguuaccugauuaccauugucauuuaggagcgugcagacauuggauuaauguaauuugcucuuagauuuauggaaaaaaauauauuccagugcaguaaacaggcaauacuugacagaucaaacagucuccccuaggaaaagauaauucuauaggcuggaaaagaucuaauaaacugagcacuagagagagaaaugggggucccacaaauauggccuuuaacagaucugcccagaauaugaacaugaaagaauggcauacaaagugcucaguagcacagcacuggguguuagcuaacuauggaagccugaacuaccuaccuccagauaccauacuggcaggagcaggcugacuguccucugugucagaaaggugaaagaaaagaccacacuggcugacucugagcccugaaggggaaaaguaaaacgagcugcaagaguaggagcucagcuagguuacuauaggcaguacucacucaggagggacuaugaaagaaaagacugagaagaagauggaaauguguauaagguaaauggaacuuuauuuguaaaaucaauaacacucacaugguucaaaauauaaaagauuugaagaugcacauaguacaaaucuuccucccaguauuauucccuaacuaccuuaucucuugggagauaaccauguggaaaacaaaugcuacauguauguauuccuccuuuuacacaaaugauaccauaacauuugaauguuuuguguauauaaauauauuuuuuauaguuacauaguauuugauuguacagauauggcaugacuuugauuaaucgcaguuuggauauuuagguuguuuccagucucuugcaguuaugaacaauauuguagugaaucuguuuuugcaugucguguguauguaagcauguauccacaugauaaauucccagaaguagaacugcacuuuaaauuguguuguagagcuggagcuaguuuaaauuuccaucagcauugugggggagucuuucuccaauucucccuaacacaggacuuuaucaaacuuugccaaucuaguaugugaaagugauaucuuguguuuuucacuucucccauaagugagacuggaggcuuuuaauauguuuaaacacauucuguauuucuucuguugguauccuuuguucauguaaaauuuuuuggcaauuuauauaaggucucggacauuauagaaauugugguaugagucauaaaacaaauuuauuuuucuuucucuucuuuuuuugacuaauuuuguucuuuaguuguaucauguaagaagaccaggaaaauuuuaccuuuuauacccucaguagaacuggggauaaaagugagggcagggagaaagcagaggcuccauauuguuuuaauuuuuauuuauuuugaggcuggguuaugagacuggcagucuuuuuuuuuguauuuuuuuuguagacaugggguuucaccauguugcccaggcuggucuugaacucgugggcucaagcgaucugcccaucucagccucccaaaaugcugggauuacaggcaugagccgcugcacccggccauguuuuacuuuacaaagauuuauacugaauacuugguagagccaagucccuguuggaaaauauaggaugaugugauaaacccaaggauauuuggagauugucagagaccuguuguuguggccuuauuugaaaacuuaaauuagcuaaagggaaacaaaaugcuuauuuaauaguuaauuaguugaaugggagaacauaaguuggagacauaagcuauguagauuugaagaggcauaagaugaacuuugguagggauaaaguaauugacauuuuagccuuccuccuuuaaaaacaaaaaaacaaagcauuaagacugcaagcacaggaaagguagacuggcuagucaaggcagaauuauugcugaaaagaauccuaaccacgacagcaaacugaauguagacacacugguguucucaaaauucuuuagcguaguuguuaagagauugguaggcuucuguugaucccaaggaggaaggaaaaggcuguuaagaauuguauaauuuaguaauuagguaacuuaaauaaauuaggcauuuugauuagggaaguagucuucauguccuuuguucuaauauucagucaguuaacauuuauuaaauacuaaauacugaccaaaaguugccaauaagaauauuuggagagggacuaccuaauuuuaguuccucccugucaagcggccuuauaagaguauuguucucacucccucugcaagaauucaaagauugagaaaauuagaaagcaaugagguauuuuuaaaaguuaaucuaaggaguggaaaacucaguuuuguguuacagugguaaaaaaauuaucaguuuucuaauaagcuuuuaaaagggauauggaauauguuuucauucugugaggagaauuaauuuuauuugagaggcauuggguguagcagagaaagcguaaacaccaaagucagguagcccugacuuaguaaccuugacuucugagcuuugguuuucucagcuacaaagugaagauuaaagagaaacaaauauuugugcauauaugcauguauuuauaguuuaacccacugguucugggcugcuuggagcaguuugaaguggcuugagccuggacuuccaaugaaccccauaggccugcuccauggguuccaaacaugacagccugcugccuaaaccaaccuggugucauuucuccauguuucucgguagccacccaaagcucaaucuuuaggugaaagggcuaugcugguaauucucaguuuucucuuuguaacaucuguuguuuggaaggcuaugugaccuugauguacuugugaaaguaugagugagcuuggagguuaagaguucaauuccagagcccaguugcauggaacagacugugugccaccacuuuucuagcugacuuuggucaaguuaaucuguuaugguucagccccauuucuaaaaugggaauaacuguagucuuuagcuaaugaggcuacugagaaaaacuaagauaaugccuccaaaacauguuucauaauaccuguaagguagagcucaaaaguuagcagcuauuauguauuuuuccaacauguuugauugcugcuucugcuccccuguuauuguuugguauacuucauuuccagugauggcuggucacugaugcugaggagccaggcagcuaguuuuaacgugguuguagcugccucuguuaguuaaagcucuaugaaugucacuuaagaagaguccucaaauacggcuguaucuuuaagacagaacuuaacguggaaauuccugccaccuuguggcuaaaauaaaucaaagguuaauaguacacauauuuuagaaaauauuaauacauguguucauuuuaggcuuaagucuugaauuauuaaaauaaaaauuugacaaguuuaaauuucauuucauuaguuucauuaaaaauggaaguauguguuuagugaaugcaccuuuucuuguuccucagagcgagagaggcucaccuauuuccuucccucuuccagagauguugagauaagccagucaaggacagacauuacucaugagaggauuugucaugugugacaaagaaauaacccccuagaaaauguguagacauugaguucuuauacuuucuuuuguuugggguuauccugauguuuauuuuuguuagggaauaggaauguuuauucauacuuugaaacuucaaucauucugaggcaggagaauugcuugaaccugggagguggagguugcagugagccaagauugcgccauugcacuccagccugggcaacaagagcaaaacuccgucucaaaaaaaaaaaaaagaaagaaacuaucauugcaguuccuuuguaucauugugaagaucuguauaagguaaauaugguuauguuuagaaguguuugaagcaacuuggccaguggcuaaagguaagaaaauucccauuuaaacuuuaacaauuauguaaauaaaagauuuauuuuggaaaaagaaauaaagcagugagacaaagggauuuuuugccauucagggauaaccacuguuaaauuugccauagaguuuuguagacuuugucccaugcauuauaacuuucagaauuacaaagaucauucugcagaguuuuguggguuuuucauucaguguauuuauacugauucuaaucucugcauaguguuggauccucaccacaguuuccuaucccgucuucuguugugugucaucuaggguauuugcccauaccguuuuguuuuguuuuguuuuuagaaccaauuuagucaugaagccuuacauuugggcuucauccauauuuauugcauuacgguacauccuuaaaaucauauuacccaggcuuucaauaaugauugccaaauugucaaccucuuauucuugauacaaggagauaauugaauuuaugacuuuucaauaauggguuaaaccucauuuugugaggacccuguauuauauacagggugauaucugggaauaaaaaagaagagauuuuuagacauggaauuuuauuuauuuuaguauuauuuuuugagacagguucucauucuguugcccaggcagacuugggagugcaguggcacaaucauggcuuaauguagccucaaccuccugggcucaaccaguccucccaccucagccucccaaguagcugggacuacaggcaugugccacuacacccagcuaauuuuuuuuuuuuuguagaggcagggucucacuguguugccgaggcugaucucaaacugcggggcucaagugauccucccuccuuggccucccagagugcuagaauuagaggugugagcuccugcacccagccaggcaugaaauuuuagagcugaaagggaccaugaaucuaaucuuuuaguuuuauagggagauggcuaaugccaaaaaggaaaaugaccuuuggaggauaacgugguuauuuaauguucaagcuggacuagaauucuggucucuaguccguauucuuuuuccacuauucagaucuguauguguggacuccuggguacguuuaacuugucugggucucauuucuucuccuuuuuucuuucucuuucccccucuuccucaaguugaacuauuuauugucucuauugaggcccauucagcucuaaauugugaucuaccccaaugaacaauuuuuuuuuuuuuuuuuggagacaaagucucauuucaucaccuaggcuggggugcaguggggcaaucuuggcucacugcaaccuccgccucccagauucaagcaauucucaugccucagccuuccaaguagcuggaauuauaggcucacgccaccaugccuggcuaauuuuuguacuuuuaguagagacagaguuuugucauauuguccaagcuggucuugaacuccugaccucaagugauccacccaucuuggucucccgaaguguugggauuacaggcaugagccacugcaccuggccccaguaaacuucuuaucaauacauuuaaauucuaccaacuggcaaaauuacucaucaucuucucagcgacccuuaaaauagcaccaagagcaaagaguuaaguaaugaugacaggauccuggucuggcgcuguggcucacacuuguaauccaagcacuuugggaggcugaggcagguagaucacuugaggucaggaguucgagaccagccugaccaacauggugaaaccccgucucuaguuaaaagaaaaaaaaauacaaaauuagcuggguguggugguacacgccuguaaucccagcuacuugggaggaggaaggagaauugcucaaaccaaggagguggagguugcagcagugagccgagaucgcgucauugcgcuccagccugggcaaaaaagugagacucugucucaaaaaaaaaaaaaauaaaaauaaaaagacaaaaccaggcuccugaguaauauacauguuggauaaacaucuuuaaguucuguuuaacugaauacauaugugucaaauaauuaugacagucguucaucucaugucuugcaucuacgguggguuuggugaaaauacuaaaauuuuuuuuccucgugaacucagcagaucaccauaugacauagaugaauaacaaacuuugugccuagaaagauucuaguaguugacuuaaauucaguaauuuaggagcugcaaucaugagaaagccgccauucugcauguuagguuccuccuguaccuuuucagcugugucugacuguggauggagcacugugguuugagggguuaggaacucugcuuagauggcaauuagacagucagguacacacaguaguggcugucugcauucugccuggaacagccugaguuuggagccauuggggcccagaagguacacuggggacuagagccccgggccaccugaccucuucagugagagaaucuuuucuuuuccccacaaagaaaaaucuuuuuaaagcagcacaauaaaaguuagaaguuaguuuuugccaaguuauaaaguuguuucuugugauacaugugacuauuuagaugguucuagaauauagaagcaucugguaacugacguguguaccuuuuaccccagggagaaugauaucuguaugugucuaucucacucaagaagagaguuaucuaccauuuuuguaacauuaaugacuuaauuuacuagucaaaauauacuuacucucuucugaagcuggcaauacgccauuuauaaugaaaaagccuagauuaccuuuuaugccuagauguaauugaugccuucaguggguucaaguuuccugauuuuuugaaagaaccuucagugaucuguuuauucccgacuuuaaaaacauuuaaggucaggugugguggcucacuccuguaaucccagcacuuugggaggccgagguggguggaucaccugaggucaagaguucaagaccagccuggccaacauagcaaaacccaucucuacuaaaaauacaaaaauuagcugagggugguggcgugcgccuguaaucccagcuacucaggaggccgaggcaggagaauugcuugaaaccaggagguggagguugcagugagccaagaucgcaccacugugcuccagccugggcaacaagaacgaaaguccauuucaaaaaaaauaaauaaauaaagcuguuuugaaagaaucuguaguugguugacucuucugcaucuccaacuuuuuauaacaaauauacaccauaaauauuaaaauauaucagcugucgucuuccuuuagaaauaaccaaaauauuuuaggucccuuaauccacauucccuuaagaaaaaaaggggacaggaggaaaguacagcguuaacuuaacguucugucaucaaggcauuggcaaaauaaguguggcaugugucagcuaucauccucugaagcuuaugaaaagaaugcccucugacauagaaaucacauggaaauaucgcaagacauuguauuuaaaaacaagccacagagcaguguacaucacaaccccaauuaugcuuuuaaugaaggaaccgaauaugaauacauguguuuguaaacauauagaaaggacugguccauuuguagaaguacugcagugagcagcaguucugggaagggccuuggaggguuggugacggugccagagcaaccucuugcuacuuucugcaugacugaucuuuuacaauaagaguucauucaugugccagagaagguaggacagugauagaagacugaagugagaaaccgagaaucauucugggccggagaaugucagcgagcccucugucugcuugcccaggucugccuuccagguccuagcccucagugaccuuuuugguacuagaacugucacccacuccacccccuuuuuucuauuuaagaauugagaguagauuugcaaauaaagcaguguauaagccggaaaugaccacaccaagcaacuagaaagagaccauuuuaugccuguuuuucuuucccaccuggggugaacucagggccauuggaacagaaucugagcaaagaaccugagugacacugggaaguguggggacuucuuucuuuuuguuuuucauuuuguugugcacuggggaguuaaaaagggauguauuguuagguguauguuuaugaaaucugggcuauuucgucucuacuaguuuauuauuuucccuucugaaaacauaacacacacacacaaaaugaauacaaaacaaagcaaaacaaacaaacaaaaaaccccagaaaacagaacacaacaauuuggaugaauauuacaauaaauuaaaaguuuccagauaugagaaaauacauaucauguauacucauauauauuuacauaaaauuuuuaaauaggcagaauuaaucuaugguauuagaagucugcaagggguaggggggcagugacuaccggaagcagguacuguuggggcuuccggggcccugguguguucuaguucuggaucuggauguguguguucaccuugugaaaauucacugaaauuuaugcucaagauuugggcacuuuuccuugcauguuaaaauaaagaucaagaaugaaaaagaggcuggguacaguagcucaugccuguaaucccagcacuuugggaggccaaugcagcagaucacuugaggucaggaguugaaaaccagccuggccaacauggugaaaccccaucucuacuaaaaauacaaaaauuagccaagcaugauggugcaugccuauaaucccaguuacuugggaggcugaggcacaagaaucucuugaaccccggaggcagagguugcagugagccaagauggcucuauugcgcuccagccuggguaacagagcaagacucugucuccaaaaaaaaaaaaaaaaaaaaaaaaaaaugaaaaagagagaaacucucccccaaauagugugguagaaugggcacacucuuuuuuuugguuuaucaccaccccugccucuuugcuccaaaucagaucguaaaccacaaagucagggacuggcucauaauagguacugagugugauugguagaauuuaauacucagaauagucucuuguaaaugguuuagagauauuuguccacugguucuuaaaaugguuuuaaauacuucauauuuuagaggcugaagugaaggaaguauauauuucugaugucucuuccacugugguuuggaaacauuagccaaggcaagaagcccacuugcuucucucuugcugcuuagcuauuccuaaaccguuaguaaccuuauggguuaaacuuaaccaagaguuugacaaaauguuuuuuguuuuucuauuuuucauuaggagauggcacauagguucccuuuggaaacuuguggucuuuuuccccacugugccugucucaaaggaaaauguguguggguggugguggugcggggugggagaggggaggauuauguguguugcggguuugcugcuugugcuggggcuucacucagaaguuuagagcuaguaaugcugaguagaagagauggguguugcuuugcuaaaagaugugucauauagccugauuccuuuucccaccccugccccuuuucaacuuucagagcacuagacaaacugaauggauuucaguuagagaauuucaccuugaaaguagccuauaucccugaugaaauggccgcccagcaaaaccccuugcagcagccccgaggucgccgggggcuugggcagaggggcuccucaaggcaggggucuccaggauccguauccaagcagaaaccaugugauuugccucugcgccugcugguucccacccaauuuguuggagccaucauaggaaaagaaggugccaccauucggaacaucaccaaacagacccagucuaagugaguaugcugagugugugguggguguucaugagaauuccccuuggaaucuuaguaacagugugucguucugguacuuggugcccuucugaacacagccaugaggacuccuuguacaguacuugggaauguguaaaaaucuugcaguaucuugguguucauuucauauaaaucuggagcuaauccucauucucaaagggaacgucagauuuucacacaugaauggaaaacaaaugauaccuaauccucuucugguuggggaagcucuggaagacagaaaggcagcuuccagguuguccucugucccaccccuuaccccccaccugcccucauuguuuuuggaaguaauuuucuggguccaauccauuuuauuuguggccucaauacagaggugguuuuucagucuugccuuacucgaauaaagaaucgcucaucuuauuuguccgaauuuuuccucugauuaagccauguaauuagaauggcuuuuucuucuggauauuuuuugaugguuuuaauuggugggauuuaagggauuggaauauucccauucaaauguuggagcuaauuaucaggagcagaaagcgggaacuauuuguuuuauucacuacuguagccccagggccaaggccagggcccugcuacauagaaggaucuuuuauuugucaaaugacuaaaaugacuguaugugaauuauguuugaagccuuucauguguaucuaagauacuucucaguucucaugcauuauauguuguuuugcuuuagaaaccauacuguuguacaguauguggauauuuuuugacccaaagaagcuuggugacaaacucuuccccccauaccuagcuccguaacgugcuacgaggcacauccuguuacuacuguauuuccugaagaaccugugagugugcugggaagaagagguuguauccaaaaauaccauugugcaagccuugagccagcuacagaaguggcaagauuauuuuuccuuuuaaauuuagaaaggagaauucuuuuuuuucagugugauccaacgaaauaagcuuaaucuuucucuaaaaguuagaacugcacugcuguguauacuuuauguguuuguuccagcaggccuaagaggacaugcauguucaucauaggcaccaugccugcauuggacuagcugacccauuucucauguagaaccaaaaagaacuguacugaguggugguccauacccaccugcucccugcaguggcaucugauccugccuuccccugcuuugaagcaggagauguugggugcugguuaccugaaugcaaaauuaaucgcccugaccucaucauguaggagugggaaagacaacuggaccauaaccuagucagucggccuggcuuuaaucuuaaaauuuaagggcuucuugcuucccuugauccaccguuaccugcagaaauucauuauauggcuucccuuccuucucauguagcagauuagaauuguuccuuuucgagcuacucauuucccugucagaugaaagagcugugacuuaaauugaacuguuuguuuuacuuaaggcaggaagauggggauaggggaagggaagcaauuuuuguuauauccgaugauucauuugcagagcucugccaguggauuuaauuaacucuugacauugaaauuagucauuaucagaaccucguuucuggaauggucucagagggccauucuaaucuccaaagccacauuccuuucucucaggggaucggagcuuaguaauccuuagcacagugaaagggugaaaauaaacugcaaagagggaugcuaauguguugcuggaagacaggcaucccugaaagugacuggggauugaaacagcagccgggaagaugacuccuaagauugggacuguuaucuaagacacuauuuuuuuauuaguuauuuuuagguagcccuuaauuuguuucaugcccuuauuuuuaguuuuaucuuuuacucuugagguaaaucuucagauuucaaccaaacauuuaggaaaaugaaagccaaaucuugauuuuauuggcaugaucaaguggucacucucauggccaugaguuauuuagcccuuuaaguguuugaauggccaaaggaacucaacaaauacuuaauuuucccaaaaacacauauuuuugaguagcuaauuuucuuucuuguacuuauuaaaaaauggcaggcuuauuuuauauuuaauucaaaacauauaaauauguaaauuaaaaaguuaccauucgucucaccuggguagcuguugguaaguuggggauguaucucuauaggauuuguugccuguaucuacuaacaugugugacuuuaaaaaagaaaucaugucaugaugugaauugcauuauuucacuuaaggacuuuuuacuguguugguacuuguaauuuuaccacauuuucaaaaacaucuguaugauaugaauauacuguuauuuaaccaucucuucccgcaauuagauaauucuaauuuucuaucuguuagaaacggaacuuucccaugccagugguucucaacuacaaaugaucaucucucugccccaacccccguagacauuuggcaaugucuggagacauuuuuagcuguuagaguugagagagaggcaugcuacuagcaucuaguagguacaggccagggaaguuaguaaauuuccuacaaugcacaagacaccccauccacaacaaagaaucuggcccaaaaagucaguagugccaaggguaagaaacaucacucuugacccauguaugagacuauaucuguagauguuaccaggaguagauguuacaagaaauacaguucuugagucacaaggugcucagcauuuugcugaccaguuugcuccuaccaaaaguguugagugugccuuguuacccaucaucuugcccauauuuaauuuuuucuaucucaauuuuugcaagucuagaagaaaaugacauucuuuuagcuggcagacauauaauuacuagugaaauuaaacaucauuuugaguuuauuggccacuugcuuuucuugaaguagaauugccaucuguccagguuccauuccuaucacuguucguugcagacuuuccucuaucaaggaggcaaaaugugggaagaaccuugcaaaggggaagcagauuggugaaaucugcucauccaaugaaugaagaaugauauacugugcagaauaagcaguucaacuuggcuuaugggauuccaacuccucucuuggcaugcccuccaguuccuauuuguuuuagagcagauugaauccaggcucuuugucaugagacauuuguucuguggcaucugaaaggaagcuguaagcacaaacagcuuggguagaaugaaaagauguccccgcuugguuggauugaggaaagagaaaggggaauguuccuagaauuaaaauuugccucuuaaggcauuaauguugacagcuuauugaaaguuuaugcucuugagggaagugagucaucugcuuugcccugaagcccuaugacuuugcauuugguaauuacagacuccacugugaauacacgcuuacugcucucguuuuccucucugcuugcgcccacuaucagaaucgauguccaccguaaagaaaaugcgggggcugcugagaagucgauuacuauccucucuacuccugaaggcaccucugcggcuuguaagucuauucuggagauuaugcauaaggaagcucaagauauaaaauugugaguaaagaagauuguccugugaaagagguugauauuugugcucuuguauuuuugacaucucugacacaauucuugggaauugccaacaaacagagggaaaugauauccugaugagcuacagugguuggcacuguugaucugguugugaaguguaugucuuuuaauauuuaaauauuuucauucacauuugaacauaggcgaguggugauaacggggaagagaaaugcagcuauagaagaaggcaacuuggggaaccuaggaccaggagguauccuggauuaacccaaaacaggagccccaaaucuugacucauccuuuacucggagcucauuggagcucuguucuuguccacugccuggccccaccuuggagcagcagggaguguggagguggggaagugccuaagucucuucuaaggcaaacuggagauuuaucuggguaaugcaggcgggaacucuauuucuuccacaggaacuuugagugaagguuggguucugugccacguuuagcguacagaacagcgcugcacugaaaguagaaucgagaguaaggcacuggaguuaguguggggaccucauuaccaaccuuaauuuguagagaacuuuaaauauguuuuaguaauauuauaugugggugccauaucauaagaauguaauuauuaaaguaaaaauuuuaaagaagaauuauuuuaguauagagaaaaauaggccugguguggcgacucaugccuguaaucccagcacuuugggaggccgaggcggguggaucaugaggucaagagaucaagaccauccuggccaacauggugaaaccccgucucuacugaaaauacaagaauuagaugagcgugguggcaugugccuguagucccagccacuugggaggcugaggcaggagaauggcuugaacccgggaggcggagguugcagugagccgagaucgcgccacugcacgccugccuggcgccagagggagacucugucucaaaaaaaaaaaaagaaagaaaaaggaaaagcccaccaucuauuaaccacaaugacauuuuaaacaguuuuauauauauaugacugggaaauucagaaagcuacaaaaugaaaagugaaagcuccccuuccuguucuuaugcccuucccccaaaguguaaccacuguuguuucuucuguuuccuucuauaaauuaugcacauaucuccagguguauauuuguacuggaugguacuguuuuuuauuuguacguuguguucugguaguagggguuuaggaauaugguuuugaguaagagacuccaucacugaagauauuuccugaagugaauaaaauaagaacuauuuuagaaguuaacuucuguauuuuuucuccccuucuauucaugcauugcuagaaugcuggccaauugucagcaaguuuuaagcuguaccuaacacagugcuucccagaugguagguaggaaguaaauguuuaaugagugaauauugucuuuuuacccacgaauagguuuacuuauucuaauuuuauggccacuuuucuauuuacagcacagaagagauccccuugaagauuuuagcucauaauaacuuuguuggacgucuuauugguaaagaaggaagaaaucuuaaaaaaauugagcaagacacagacacuaaaaucacgauaucuccgugagugcuccuuugcuuuugaauaagaaaacuuuccaacacuguaagcugcauguuguguauugggcuuagcuucccacuuuacagcugcuucagcuagccugugcugccguacuuacacaugguuucucaaauacagcuugcugccuguuagguuucugacccguauugaaagcauuaucugcuucuggcaggaggaaccaaaugcuuuacauucauguuuucuaaagcagucuuaacuauguuuuaugacauuuauucccaaaguuggaauauauaacccaguuuauuauccauugucguguaacgcauuaucccaacauuugacagcuuaacacaaugugaacauuaauugcucagcuaguuuuuguggguuaggaaugcaggagcagcuuagcugggugguucuggcuuggggucucacaaugcugcugacaaguugaugcuggcuguuggcagaaggccucaguuccucccacaugggcuucuccacagagcugcuugaguguucucaagacauggcagcugucaagauggaaacugcaaugucuuuuaugacauagccucagaaguuauacucuaucauuuuucuaauguuguuuacacaagucagcccuauuugguauguaugugugggacuacagauaacugggugacaggaaucaccuuggaggcaggcuaccacacuuagaaucuguggaugcucugaaauuacguggaaagguuuuucugaggguggccauucuuaguuucacucagaguacucaaaaaggugggaaaagauugaugaacugaggaagagugguaggggaaagacugcacgguguuuguguacaaggaguuuucaaaggagguaguaaggaagcaggaaacuucuguuugguuguaaagaaagggggaaaaaaaccccacaaagugguaaauucaauaaguaauacuacuuugucuuaaauuuacccccagaaaggggagaguuuuaaaagaaaaaaaucucaaaaguuauucuagaagcagcuauuuuuaaaacuguaauacaaaaugcuuggcagggccagguugagacugaauuagaauuauagacuucuuuuuaaaguagucuaagagaaauagucuucauuauacaaauguuuacauuuuuaacaaguuugaggaaaauguuaaggaauaacuucccauucaucuggcucaagguuagccugugacauuauacuaguagugaaaaugagaacuucaggaagaugaaggagauuuguaccaauaauccauauccucucaauuuauguacuuaguucuguuuuccauggcacaugucucccauugcuuuuccucucaaggcuguugaccagcauaggcuuagguguuuucagguaugauauucaguggcuuuugaagguucagcaggaccuaggucccgcagggaguuucugaauauuucugccacuaucuaacguuuuuguuaucuaaauggcaucggugaaccauuuuaaauuuuagucaagauggauugauauuccuccagccuacuucaaucuaaauucuaaagaaacugguaaaaacuaaguuuagacacaggaauucuggcuuguguuuuuggaauauuuccaugcuuucuccuugcuuggugacccagaaaaugcaauugcacgagaaugccaauuaugccuagaauugguuaauacagacuaggaacauacuuaugaaagguuauguacuuaggguauuugguuuccucaaaaacuauacaucuuuccagucauuuuuuaauucacuguucaauugugaaaaugguucaacuuuaagcgguugagaaguaagcuuuauuuaaaauauggacuugauugaacuauauguauccaguaaucguuaguugagaaaaugggagggcaaauauuuucuucucucuugcagcuuuacaguuucggauuuacgucuuuuggggcuuacucauuucccaucauguuuuaccacccacuuuuacauauuaccaggcuccacaguuuguuuuuaauugccgucuguggcugaauuauuagcugucuuccuccaauuuucauucuuuuucuuucccuucuuuuucauucugcagauugcaggaauugacgcuguauaauccagaacgcacuauuacaguuaaaggcaauguugagacaugugccaaagcugaggaggagaucaugaagaaaaucagggagucuuaugaaaaugauauugcuucuaugaauguuaguuuuguuaugaagggcaugucuuuauuuuaacaaauaguuaaaacaauguuuuuaacugcauuaauauugaauucuuuuguggcauuaucacuagaaguaguucuaguugauuuuuagcaccucagcaaguacccugggauaguagggaagauacuggcuuugacauuaagcuuugcugucucugugacuuuagcaaauuauucagucuuugagccuuagcuuccuucugucugaaguaaggcuagugucuaccuacaaagguuaauauaguaccucucuuacaauguuaauuugagagaguuuaauauagaagaaauguuacaugaacuggauuugaaucacagcugaaccauuuaugagcugcagcucucuucucuuauaugauuuacucagucucucugaggcucaguuuacucaucuguaaaaugggacuacugccuaccuugcauucuuauuaggauuacaauagauauaaugcauauaaaaguuaauguuaagauuacagguuuaaaacuugguuagccauauaaaccuuggagauacaagaauuucaauugauaaaacaaucuguguagugcaucugaggcuauuaaagcaaauugcugacauuccuuaaucagugaaauggugcugaaaauggaauacuucaaaagccugucuuaaauuuuaaaguaaaugacuuuaaaaaauaauuuuuuuucaauugggccagucaucugaaacacaaaaccugagacgagggaaaugugcaaauacugcguuugugagaagagccuagaaugcuagccauuuuacaccccacgugacuucuugccaaccugcuucaauucucacugcuuggcuccaaauguucuggaaucaacugggauuaaaucuaacccccuuaggccuuuuaaaaagauuuucaaguacacucaaaucucccuuccaccgucuacauuacguccucaacccuuauaaaauuaaacaaauuaaaauacccuuucuggcuccuauuuccauuccagugauauguuuacuugcaguaguuacauggggauggguccugauuuccagagggcucaacuuugaggccucuagacccaugguugcuaaguuuuacccagcaaguaaagaucucuuaauagcugguuugcuuuucaaugaaccaaucuuacuugauuaccucuucaacucugauacauugcuuuuugucuauauuuaguuugcccacagcaugcagaauacgguuuugucuaaguccugugggcuagucauaagggaaaggaaagcuucccuugagauaucuuaaugcagcuguggaccaaggagggggcaaaccagcacacagauuuuaaaauaccaagggauauaaacagauguaaacgauguacucaaguagagucccauggaacaucugcuuugaguuauacaaucauuucuuuauuagacaagagaucaguuugaauacugucacuuaaaaaugcucacuuucccuugauucuuuuaauugucaaauuaaggggccuuuuuacuguugcagcuucaagcacauuuaauuccuggauuaaaucugaacgccuugggucuguucccacccacuucagggaugccaccucccaccucagggcccccuucagccaugacuccucccuacccgcaguuugagguaagauaacuggccuuggcuuucuuugugauugggcaaaaucuuaauguaaaccuaguccccgcgugaucaucuguuuagaugccaacauaugcucuccaguucuugcuaauggagccuucuuauuuggcccuuuguggaguagacaugggauuauuuugcaguuuuuggauagcgggguugucaacauguguuuucaaauaucacaacaaaaguuugggacuuugagguggcaggggaagaaacuuaguaauuguuuuucuuauuuaaaaaaauuuuuuuucuuuuuucuuuuuucuuuuuuuuuuauucuaaguucucggauacaugugcagaaugugcagguuuguuacauagguauacaugugccauggugguuauuuaaaaguuuuuggagacacagucccacucuuucgcccaggcuggaaugcaguggcacaaucuugacucacugcaaccuucaccucccggguucaaaugauucucaugccucagccuccugaguaacugggauuacaggugugugccacaccacacccggcuacuuuuuuuguauuuuuaguagagacaggguuucgccauguuguucaggcugaucucaaacuccuggccuccaguggucugccugccucggccucucaaagugcugggguuauaggcgugagcuauuaccuggccaguaauuauuaaauacuaaaggaaaagauuuuuuaaaggcuucuuucaucuuugucaccugaagucaauggcuuugaaaggucaggagugacucuguguguuuuccauguugaguguacuuuuuuaaaccaaagagauaagauaguuuugugcacaauuauauugugugugugcgugcauacauuaagcagauguuuauuuuguaaagagguagguuauauaagaaauaaaucuuaggccaagugccauggcucacaccuguaaucccagcacuuugggaggccgaggcgggaggaucacccgaggucaggaguucaagaccagccuggccaacauggugaaaccccaucucuacuaaaaauacaaaaaauuagccggagugguggcaggugccuguaaucccagcuacuugggaggcugaggcaggagaaucgcuugaacccaggaggcagaggugguagugagcugagauugcgccauugcacuccagccugggcgacagagcgaaacucugucugggaaaaaaaaaaaaaaaagaaaaagaaaaagaaagaaauauuuuauacuugcuuuuuaagaauagcaguuuccuugaggucagaaauaggagacuagugaugguaugaaaauaaucgcagcacagcagacaccugauggaauaaauuauuuugaaaguaguuaauaauucaguugcauuaucgauaaucggagguauucaugugacauucuaggaucuuccuucaugaauuuguuuugacaucucucccuuuuuguuuggcucacuuacuuaauauuaauauuuugagugauaccucuuacaccaauuuggggaaauguccagguggaauagguuggugauuccacuguauuacuaccuagaauaaauauguagaguaaaaugacauugaaauuguacagaaaauacagauggcucagauugucccccuuuuauccuuuuaaaaaugaaaauuuccuuuuccuguccuugaacccaccaaacugauugggguucuaagcaguugcccuccugccguguguguuucugccuuuacugucagcagcaucuugucuccccugcaauucaccugccguuucuaguauguuuuggccuggaaaucauguaacagaaugauagccaucaaaauuucagcuacaagugaagugugcauagauucauuacgugcccccugaaguggcuggcauguuuuuacuuugaugcuaaaggggacugguagaaagaacccuggagucagagcccaggucuggcccacugccucugacacaauuuugugucacugaaggucagacuccuuggcucuggauuuguuuucucaccuguauaauaaaaaaaaccugaacuauaagaauugugucuaaagccuuuaaggucacacauuucuaguuucuacagaauuaaauaauaugaaagguuuaaggaggaauaggggagaaugagccuaaaauaggaaucugagaguacaucuagggacuuaacuuugaacauguccacuaguuuaugugugugucauaggauugguuuagggcagguguguccccaacacuucuguauaaaaugacacuuacuaaaagguacaaugagcugaucaugugacguaacucugugcuaggaaagcucgcaucuaacccacauuucugcugguuccccuaaauuagcuuucucucuggguggguugcuuaaccucucuguuucauucccaguuuguaaacugaggugucccuuuaacucuuuuuuucucucuauacuggugacauguuccaaucaacaaagcuuuucacauuacaagugaucacagaauagaacauucuuggacaucagucuuuuacacuuacauggaugcuucaguagccaaaauuccuagagugaacuuguagguaacuauuuuuaaaauauguagauaagacugcauauucucuggauuuagucauuuuucugacuuaugguauaguucuguguaucagguuccuauguuagaaaaauuaagaaugcuuugagagaagugagaucauauuaagaacuuauauuucuccagcacuucuacagucuuaaaugucugaaugacuuaaaucaguggcaguuuuguuuuaagaaugggaggaggaggucggugauguuuacuuaaauaaaaguugagccaagaguaaauguaaggaagaugucacuggaauaggucaucuugcuucuccugucauuuaagcuaaaucaaauaggugcaauuagaaggagcaaaugagaacagaaguugcagaagcugccaacaguaaaaacacugccacagggcaagagcugcaaagauguaacagucuggugguuucaaggacaggcaaaggaaauucgcauucuuaaaggaauacaacaacauggacagucuuaacaaucuguguucuuugcagaauuccaguggauauuuuauucuacauguguuccaggcagugauacaauggaguucucaacuuuauaacugaauauuuuccuaaaucauuuauccaaaucauauauuucccuaaaucauauauuacuguuuuuauuucuuauuuuacauugauugacaaucuguaaaguucagcauuaauuauucccugccuuaaggggaaaaaaauguuuuucccauacuuaaauuauaauuaucccagacaauuugaaugaaaaucccuggggguaggggugaggcaaagguaucaauuuugaaagcucccgagaugacuccaauguguagccaaggcuaacaacaacuguuugauuaguuaagaacuugugucccacuuaaauaaauaaaaaucucagugggagcagguggaagcucaaaaauguguaguuucauaaaggucaucaggaguuuuaugcuacccguuuauugucaggaacuguucuuuucaagagauggggacucacuauguugcccaggcuggaauugaacuccugggugcaagugauccucccaccucugacucccaaguagcugggacuacaggcacacaccaucacgcccagcuaagaacuucuguucuacaaagaauguuuacuagucuuuggaggggcgcuucaauguugaaaagaacaguuucuaucaguaccaauugcaagggagaaaaaguucaggauaagcacaaauacauacuaguuguguauaucccuuuuucuaccuuguucuaugcuuugaagagugaaaaaaaacucaccucuuucucucuggaccaccugccaucccaacucguaggaaauaucaugccaaaaaccucugugggauguugccguuaugucuguuuuuacccuucuaacucuauuuuggcauacuacauguaucaggauuagguuuggguauguauuguuacuagaaaaaaaaauggcuuaaauucguuuuccuuuuucaugagaagaguucaaggguagacaauccaaggcuggaagugguuccaccauauccuucaggacuggugcuucuaucugccuugugugccauucccuggcccaggauaacugcucaagcuccaacuauugggucuguuuccagccaacaagaaggauaaaggauugcuggauguggugacagacaccuguagucccagcuacuggggaggcggaggugggaggauugcuugagcccaggaauuucaguccagccugggcaauguggugagaccucauuucaaacugaaaaaaggauaaaggaucaaaauuggcagcauccuuauuuaaggacacugccugaggauagcuuuucauacuucuguuugccucauguuggccagaacauaccacuggcugugucuagcugcaagagaagcugggagacaaucccugugugagggcagcaaugugcccauuaaacacaggaucuguuacuaaaggaaaauacauguuggggacagcuauuugucugcuucacuggauuuggcacuauugccuguuaaaggagccucccagagccuggaagagaggaagcaagcuuuuaaguucucucaaaaagcagaaucuaaauucuggaggagaaaauuccauauuccagauucccauuccugugguuauuuucaucuaaauaaagagaaaacaccauuauucagaaaaucauauugucccuggauacaauuagaguaaauucuacuuucaaacagcugcuaggcaauuuucuggcuuaauguucaggggaacaauucuuuaacaaguguuguuugaguauauaacuucaaguugcaggggguggggggugguugcaaguacucaguuggaauagcuuugccuucacuauuuuuagacuuuguucuuuuucuaaaccgaaaucacuaauacuuaacuauuuuguguaccuaguggucaccacuuuuugaaauacaaauaaacuauuguuuuuaaaggcaguaaauuucccaaagcuuuaccaguuucuuugcuuaucauugcuucuuuuuuuuuuuucuuuuggagacagagucuugcccugucacccaggguggagugugguggcgcaaucucgguucacugcaaacuccgcauccuggguucaagugauucucauaccucagccucccgaguagcugggauuacaagugcgcagcaccaugccugguuaauuuuuguauuuuuauuagagacaggguuuuaccauguuugccaggcuggucucgaauuccugaccucaagugauccacccaucucggccucccaaagugcugggauuacagacgugagccacugcagccggccuauucuuuagcaagaaaaaugaagccaaaaagaagcaaugauaacaaccaggcguugcgaugagccgaggagguggagguugcaaugagccgagaucgugccacugcacucccgccugggugacuaagcaagacucugucucaaaaaaaaagaagagaaaaaaagaacauacuguuuuauguuugugagggucuaugauguuauuuaaaaaaaaaaaaaaaugguuuagaaaguuaaagauggacgggcauuuugcucucagcacuuuuaaacuguuccugaacugcauucugguaucuauacuugcugaugagaagcuugcuguuccuuugaagcuaucacagauuacguacuaagaucguguuuauccuugaugucuuguagguuaacagugaacuucugcuuuuauuuuaaauguauauugccugucaagaaguagguuuugauggcuaaauguuucaaauaauuuuuuuuuuuuaauauauacuacuuccuuuuucuuuuagaauuguugcauuucucuacucauguuuucucauuccugcuuuguagcaugaaaguagaaaugaugcaucucuucuuuggauaaaucccuugccucuauuccauucuagaacuuugccuacuaguucccccacaauauucucuucuucccagaacuugccagguugagucuccccagagccaaagaguugguucuuccaacagacaaaaagucucuaguuccugccuagcagcuggcucguacaguacuuaacuggcaaacuucgaguuuauaaaugacaggaaacgcgccuuucagaaaugcucaaacaguagggaagaaggaauuggcagcuagugaagcagagcaagagcuggaauuggcauagugcgugucgccuuagcuggauggucuuggcagcauacaguuggauuggcagaaguaaucccaagggcugcuggcuucaguuuugauagccucuuuggagucuucucagaagucuccaaaaugauaguguaaucuuaaaauggcuagcuuucugcuuaugaaagaggcaagagagauuagcacuuuuuuaggcuuaagguacucuuuaagaaacaaagggccaggcgcggugguuuaugccuguaaucccagcacuuugggaggccaagguaagaggauugcuugagaucaggcugggcaacauagggagaacucugucucuacaaaaaaaaaaaaacuuuuuuagauuagccgggggugguggccuuugccuaucccagcuacuuggaaggcuaaaguaggaagaucaccugagcccagggaggucaaggcugcagugauccgugauugagccacugcacuccagccugggugacagagugagaccuuguccaaaaaaaaaaaaauuaugaguuggaaggaauuuuuuaaaucagaugaguguuucagggagucucuuagucuuccuccuuaagauuucucacagugggugcaacucuuuuguugguaaacaauuucuaaguaaguaacucacugugcacauuuauuaucucugagaagccuugguuaucuaguuauggugaaaaacuuucuuugccuuuuuuuuuuuuuuuuuuuuuuuaauguuaaagacuucaauauuuuguucaggucauggaguugaguaaacuuaguuucaguuccagaccaaaauccauuuaaaaacaacaacaaaaaaacccaggaguaucuauuuuacaagccaaagggaaaccguggcauccuuccagguaccuggaggcugaucauguuggcugacaugcaugucuccaugccuuugugaugucuuagauuuugucccccacaaaguaaauacacuuaaccuuacuguuugcucauacuuguaugucuucacgauagaugauuaggaauuacucauuggcagacuucaccaguuaugcaaacuuucaguugagcagcuuuguucuucuguuauuucaagccguaguugagagucugccaagaaguccaaaggaaguuuugccgauaggcaucuggcacaaauccauugggaagcagcuuauguccugugaacauccuucagucccaaagaauguauccaagaaaagguucagacaaugcaacuagaccuuaacuuaaauggaaggaauguguaacaagacuggguaacgcuaaugggccuuuuccaaccuaggucucauagacuuaaauucaggugaaaaaggcuuauaacuuuugcucugccugcugaguuuugcaaguaaaaauuuaaauuaucugccuauuugggguguccaaauccugacacaggcuuguucuagcauaggcuuauuuuagucucgauuucuuuucuuuuuuauuuuuugagacagagucucgcucuguugcccaggcucuggagugcagugucaugaucuuggcucacuguaaccuccaccucccagauucgagcgauucuccugccucagccuccugaguagcuggaauuacagucacgugcccagcuaauuuuuguacuuuuaguagagaugggguuucaucauaucagcccagcuggucucgaacuccugaccucaagggauccgcccgccucagccuuccaaagugcugggaguacaggcgugaaccacagcacccggcucauggcuuauucugaaucccauauaagaaugaaguguaccagagagccaauuuaaugauuggcaaaaguugacagcauauuuaugugagcugccuuacauucccagaggaaaauuuucuugaaaaguaaucuuugguuaagaagaugcuucauggauaggaaauuggagcaaagggaauuggacgacguucagaaaugucuucaccaagccucagacaucugaugagucaacuuuucuucaagacaugauugccaacagcacacaucauugucugucauucuagggcagcaucuccugguguggaaaaacacuuaguuugcuucuaacucugcugcuucuauuugacaaguucuguugcuucuguuuucauuccaggauaggacauuuuaaagucuacacauugauucuucauguaugugcccuuuuuuucuguuacauuuugguccuuuugacccuuaucuacuggccacuauuccuuuuccaaagcuucacacaacauuucucuuaaguuuaugcuuaagcuucauuuuggguuuguuauuucucaucagcaaaacaagaacauggacagcccuucaucacuaugucagaaagauaacuuuguuuuuguuucucacaacagcagccuuggacguguuccaggcuaagacacaugcauguucgggccaggcuuucacucugaggaggaugcugcuacauuaguguucucuggggauauuuaggaauugcucucugaaaccaguaccaggaauagucauuuuuuaauaaguaaaugaauaguuuuucucucauagucaugggaaaucaugcaacuaacuuuuuaaaaaauuagcugcgaggaagcuuaaagccagauuuguauaacagcauuuuuggcuucaucuuaucuugaguguucaguucccuaugcucuuauuucuucaccuccuuuguuuuaucuuuacagauuauguguauuuuauaagcagcauaaaauucuuuuuggaacaaagcccaggaaacaaauaauuacacagucaugacaaaauacugugggguaaaucugggaaaguuacacauuagguuuaguuugaccauugaaaaggucuuuaucaccaccagcuucccccaaguauauuguucagaagaacauaauacggacauucuuagugagauaaaauauuuagaucccacccuuaauuuuuuuuaaaauggucaagauuaacuuaauggucuugauacaaggaccagaaugaugaaguaaugcuaacauugagcacaguugauagucaguguuggcauuaauucacuuggucuauccaguuauaaaauaaaaaaggccauaaagggauaaaugacacaugguaauugugugacacacugggggcugugaguuauauaguaucuuccaaagagagaugcuguucuucugacuuaaauagugaagaaugaaauaauuuuauuuuguguucuuuguuggugaagagaaacagaagugaucuggccaagcugugcaggacaggccccuaacacaaaucuccacauaauaguuuaguaggaaggcaagucuucuucugauguauguguucuaaaaaugcugaauagccagaagggagauuucauuuagcuaacagcuauauuaauacuugcaguguguuacauuauccuagaaaacauggaguaugccagagaacuuugccaaguuguaaacaauaugguacaaauuuaguacaucuguuuauacaggugcugaagaaacaaaugauuagagaugggugggugauuagagaugaugaauugaauuuuggguuaacucuuacauaaauaagagguacaugauggggauugaagauauaaaggaagagacaauagaguuuaagugauuuucauuuguaggaaacuaguugauaugguuuggcuguguccccacccaaaucucaucuugaauuguaauucccacuugucagugggaggugauuggaucaugggggcggauuucccccuugcuguucuugugauagugaguucucaugaaaucuaaggguuuaaaggugugacacuugccccaucccuuacucucucucucucccuccugccgccaaguaagacguaccuuguuacccauuugucuuccgccacgauuguaaguuuuuugaggccugcccagccaacugagucaauuaaacuccuuuuuuuuuucuuuuuuuuuuuuuucugagacaguuucgcucugucacccaggcuggagugcaguggcacaaucucagcucacugcaaccucugccucccagguucaagcaguucuccugccucagccucccgaguagcugggacuacaggcacacgccaccacgcccagcuaauuuuuguauuuucaguagagacgggguuucaccauguugcccagguuggucucgaacuccugaccucaggugauccacccaccuuggccuuccaaaguguuaggauuacaggggugagucuaaacuccuuuucuuuauaaauuacccauucuuggguaguucuuuuuuuguuuguuuuuuguuuuuguuuuugagacagagucucacucugucucaucuguacacacccaucuuaugcacguuuaagauacuuugcaacuuaaaaguuucaauuccuuuaucuucaccugacaguuauuuagcuauaucugaaggugcuuuauaaagauuuucagaaaguucaguuuuccauuuuucacuaauucauguaaugaugcaaucaaauuuuuaaacauaaacuucugugccuugguacaaauacuucuaagaauuuauguaauagaacuucuaagucaaagagcacaaacuuuuaaaauugacagacaguuccaaaucaucauggucccaaaucaucaugguaguacauguauuuuauggucaauaaauuuauuaaagaaaggaagaaaucaucuuaguauaaaucaugccuuucacuuuuaugaaaaauaaagcagccgggcgcaguggcucaugccuguaaucccaacacuuugggaggcugaggugggcggaucacuugaggucaggcauuugagaccagccuggccaacaugguaaaaccccaucucuacuaaaaaauacaaaaauuagccgggcaugguggugugcaccuguaauuccagcuauucgggaggcugaggcaggagaauagcuugaacuuggaaggcggagguugcaguugcagugagccgagauugugccacugcacuccagccugggcaaaagagcaagacuccgucucagaaaaaacaagaaaaagcaauguaugauucuagaccguaugucuaguauauauuagucuguuuucacaccgcuauaaagaacuaccugaguaauuccagcacucugggaggccaaggcgggcggaucaccugaggucaggaguucaagaccagcccggccaacauugcuugcuuucaguuguugcuuucaguucuuaaucuucaguccaccccuauuuuucaaaauaaaaauaacugacugucucuggaugcccuuuuuagcauuuugaugaucauagguuuaagcuuuugccaacuacgcaaaagaaauuucuuuugacucacaggaagucauaccaaggccaaucaagggacuugugagaggagaggggaaggcagccccucgagugacaguucuagugggcacuuuucuuuaaagcuuucauguauauuuuugacagcucuagagaaauauauauauaauauaaauauuauauaaauauauauuguauaaauauuauacauuauuuuauuuuauuuuuuugagacagagucuuguacugucacccgggcuggagugcaauggugugaucucugcucacuguagccuccgccucccagguucaagccauucuccugccucagccucucgaguagcugggauuacaggugccugccaccaugccuggcuuauuuuuuguauuuucaguggagaugggguuuuacuauguuggccaggcuggugucgaacuccugaccuugugaucugcccaccucggccuucccaaagugcugggauuacaggcgugagccaccgugccuggcagcucuggcuguauuuuaaagcauaucuauacccauugagagcuucauacugguuuaugaaucuggcuuaggagauagagaaacccagguuugaaucguggcuccaccagguggugugugacuucaggcaaauaacuuaaccucucuggcucaguuuuuucaauucuaaaaugagaauguuguuaguuucuagaaauuggaucuguugugggguacaaaugaggucaugcacagcaccucacacagaggagacccaaacugaucuugccacauggcugcugcauacacucacccuugucaaaguuauuuuugccucaaccugaauuuuuaucucagcaugcuuuuuacccaucuccacuacucuuaugugaaaacaaaggcaguauucaaagguaucauaaauguauuaacuggaguccuacuggaauggaauaacuagaauuccauagacugagcaggggccuuuuuguaugggaauuuaauauuuaccaauuuuaaauguucaggcccuuuugacucagcaguucuacuucuaagaacguguugcaguagagguauucaaacagggcacaaauuuuauguacaaagauuuuauugaaacauugaaguuggaaacuaugcacacacacuguaggugagguaaaucaacugugguauaucuauuugagggaauacucuugucaaaaugcaguagggacguuugagugaaaaaagauauccaaguuaagguaaaaaagcaaauuaggauguuauuuauuguauccauuccuuguuuuaauuuuuuuuuuuuuugagacggagucuugcucugucgcccaggcuggagugcaauggcgugaucucugcucacugcaagcuccaccuuccggguucaugccauucuccugccucagccucccgaguagcugggacuacaggugcccgccaccacacccagcuaauuuuuguauuucuuuuuuagcagagacgggguuucacgguguuagccaggauggucucgaucuccggaccucgugauccuccugccucagccugccaaagugcugggauuacaggcaugagccaccgcgcccggcucuuguuuuaaauuuuuacuacauuuuuuuuacucauagaauaugucugccugaccuuucugguuuuccaugucugucuuuucacugggcuucugucauucuucuugagcauuuggcuugaaagaacgaaguacugaagcuguuuggguauagcacuuacuuuagguuagguagguaguugauuguagaggucuaaauuacuuggucauguauaaguuuuugugauuaaccuugguaauuccuagacaaauucuugcuauuuucagauuuguuagcacauuguuguacuuuaauuuuucucuuguccaguuauccuuucccauuucaauuuuauuggaaaauaggcaaaaguuauuccuuauauucaaagaaccagcccuuuuguuauuucuggaguguuuuuguuaaaaauauuuucuucagaggaaaccaaaggcuuaaaguuguuuaaaaaaaguaguuaagggccaggcgcaguggaucaccugaggucaggaguuggagaccagccugaccaguauggugaaacccaauuuuacuaaaaagacaaaaguuagcugggcaugguggcacacgccuguaaucccagcuacucaggaggcugaagcagaagaaucgcuugaacccaggagguggagguugcagugagccaagauugugccacuacacuccagccugggagacagagcaagacucugucucaaaaaaagaaaaaaaggaaacaauuaacugaauuuuuccuuuaaagauuuaagaugauaguaguugagauuuuucuugaaaaauguaaacaaaugagguagcagaaaggauacagcccaacuacuuuugagugggauugauuuuucaccugugucauaggugggcgucuagagagacaaagagacucucagauuuaaauaaacacgauuaaaauuccuaccaaacagggugaguaaacugugaccuacggaauggccuccugguaagucugcauugggggacaagcgaguggcacggccugugugucugaugugggguucugccguuggugaucaguaucucuccauggauuuauggugcuuagugcucugcucuuugccucugcucugggcucacaggaaaaagguggaaccauuagugccacuagugaucuccaugugggaagagugaugucauuugguaguccgacauuaaauggcacaaauugguuucuacaucuaguaaagcugucagagcccaguguuacuguuuucuuuggcugauuuuugaaaacggcuuaaaauuuuaaagauuucuaccuaguuccugagauuuuugaaagcaaaacuguugcucugcgguuguuugagacuuuuuaagaauuucaggacgggugcgguggcucacgccuguaaucccagcacuuugggaggccgaggcgggcggaucacgaggucaggagaucgagaccauccuggcuaacacggugaaaccccgucucuacuaaaaauacaaaaaaauuagccgggcgugauggugggcgccuguagucccagcuacucgggaggcugaggcaggagaauggcgugaacccgggaggcggagcuugcagugagccgagauugcgccacugcacuccagccugggccacagagcgagacuccgucucaaaaaaaaaaaaaaaaaaaauuagaaauuaggaucugucuuauggcuguguguauacauacuacaguacugauggguuaacuugaguacuugggagcugaauuuauaguauuaugcaauaggaaucuaagauucaagagaaucccaugaaaguguuuaucaaguaguucaugucuaaguuguguaagacaaaauaucuucuuuuuuaauuaauuaauuaauuaauuuauuuauuauacuuuaaguuuuaggguacaugugcacaaugugcagguuaguuacauauguauacaugugccaugcuggugcccugcacccacuaacucgucaucuagcauuagguauaucucccagugcuaucccuccccccuccccccaccccacaacaguccccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauaguagcaugauuuauaguccuuuggguauauacccagugauuggauggcugggucaaaugguauuucuaguuccagaucccugaggaauugccacacugacuuccacaaugguugaacuaguuuacagucccaccaacaguguaaaaguguuccuauuucuccacauccucuccagcaccuguuguuuccugacuuuuuaaugauugccauucuagcuggugugagaugguaucucacugugguuuugcuuuguauuucucugauggccagugauggugagcauuuuuucauguguguuuuggcugcauaaaugucuucuuuugagaagugucuguucauguccuuggcccacuuuuugaugggguuauuuguuuuuuuccuguaaauuuguuugaguucauuguagauucuggauauuaacccuuugucagaugaguagguugcgaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuaggguuuuuaugguuuuaggucuaacguuuaagucuuuaguccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagauuagauaguuguagauacgcgguguuauuucugagggcucuguucuguucuguuccauugaucuauaucucuguuuugguaccagucccaugcuguuuugguuacuguagccuuguaguauaguuugaagucagguagugugaugccuccagcuuuguucuuuuggcuuaggauugacuuggcaaugcgggcucuuuuuugguucuguaugaacuuugaaguaguuuuuuccaguucugugaagaaagucauugguagcuugaugaggauggcauugaaucuguaaauuaccuugggcacuauggccauuuucacgauauugauucuuccuacccaugagcauggaauguucuuccauuuguuuguauccucuuuuauuucauugagcagugguuuguaguucuccuugaagagguccgucacaucccuuguaaguuggauuccuagguauuuuauucucuuugaagcaauugugaaugggaguucacucaugauuuggcucucuguuugucuguuauugauguauaagaaugcuugugauuuuuguacauugauuuuguauccugagacuuugcugaaguugcuuaucagcuuaaggagauuuugggcugagacaauggggcuuucuagauauacaaucaugucaucugcaaacagggacaauuggacuuccucuuuuccuaauugaauacccuuuauuuccuucuccugccugauugcccuggccagaacuuccaacacuauguugaguaggaguggugagagaggucaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauugauuuguguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagcuccuguuauuggucuauucagagauucaacuucuuccuggcuuagucuugggaggguguaugugucgaggaauuuauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuugauuagucuugcuagcagucuaucaauuuuguugauccuuucaaaaaaccagcuccuggauucguuaauuuuuucaaggguuuuuugugucucuauuuccuucaguucugcucugauuuuaguuauuucuugccuucugcuagcuuuugaauguguuuucucuugcuuuucuaggucuuuuaauugugauguuagggugucaauuuuggaucuuuccugcuuucucuugugggcauuuagugcuauaaauuucccucuacacacugcuuugaaugcaucccagagauucugguauguugugucuuuguucucguugguuucaaagaacaucuuuauuucugccuuaauuucguuauguacccaguagucauucaggagcagguuguucaguuuccauguaguugagcaguuuugagugaguuucuuaauccugaguucuaguuugauugcacuguggucagagagauaguuuguuuuaauuucuguuauuuuacauuugcugaggagagcuuuacuuccaaguauguggucaguuuuggaauaggugugguguggugcugaaaaaaauguauauucuguugauuugggguagagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacugggauugcaaccccugccuuuuuuuguuuuccauuugcuugguagaucuuccuccauccuuuuauuuugagccuaugugugugucugcacgugauggguuuccugaauacagcacacugaugggucuugacucuuuauccaauuugccagucugugucuuuuaauuggagcauuuaguccauuuacauuuaaaguuaauauuguuaugugugaauuugaucaugucauuaugauguuagcugguuauuuugcucguuaguucaugcaguuucuuccuagucuugauggucuuuacguuuuggcaugauuuugcaguggcugguaccgguuguuccuuuccauguuuagcgcuuccuucaggagcucuuuuagggcaggccugguggugacaaaaucucucggcauuugcuugccuguaaaggauuuuauuucuccuuuacuuaugaagcuuaguuuggcuggauaugaaauucuggguugaaaauucuuuucuuuaagaauguugaauaucggcccccacucucuucuggcuuguagaguuucugcugagagaucugcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcguuuucuguauuuccugaaucugaauguuggccugccuugcuagauuggggaaguucuccugcauaauauccugcagaguguuuuccaacuugguuccauucuccccgucacuuucagguacaccagucagacguagauuuggucuuuucacauagucccauauuucuuggaggcuuugcucguuucuuuuuauucuuuuuucucuaaacuucccuucuugcuucauuucauucacuucaucuuccaucgcugauacccuuucuuccaguugaucacaucggcuccugaggcuucugcauucuucacguaguucucgagccuugguuuucagcuccaucagcuccuuuaagcacuucuguguauugguuauucuaguuauacauucuucuaaacuuuuuucaaaguuuucaacuucuuugccuuugguuugaauuuccucccguagcucacaguaauuggauugucugaagccuucucucagcucaucaaagucacucuccguccagcuuugcucuguugcuggugaggaacuguguuccuuuggagaaggagaggcacucugcuuuuuaagaguuuccaguuuuuuugcucuguuuuuuccccgucuuugugguuuuaucuacuuuuggucuuugaugacggugauguacagauggguuuuugguguggaugucccuucuguuuguuaguuuuccuucuaacagacaggacccucagcugcaggucuguuggaguacccggcccugugaggugucagugugccccugcuggggggugccucccaguuaggcugcuugggggucaggggucagggacccacuugaggaggcagucugcccguucucagagcucuagcugugugcugggagaaccacugcucucuucaaagcugucacacagggacauuuaagucugcagagguuacugcugucuuuuugucugucugugcccugcccccagagguggagccuacagaggcaggcaggccuccuugagcuguggugggcuccacccaguucgagcguccuggcugcuuuguuuaccuaagcaagccugggcaauggcgggcaccccucccccagccucgcugccgccuugcaguuugaucucagacugcugugcuagcaaucagcgagacuccgugggcguacgacccuccgagccaggugcgggauauaaucuccuggugugccguuuuuuaagcccgucggaaaagcgcaguauucaugugggagugacccgauuuuccaggugccgucugucaccccuuucuuugacuaggaaagggaacucccugaccccuugcgcuucccgagugaggcaaugccucgcccugcuucggcucacccauggugcaugcacccacugaccugcgcccacugucuggcacucccuagugagaugaacccaguaccucagauggaaaugcagaaaucacccgucuucugcaucgcucacgcugggagcuguagacuggagcuguuccuauuuggccaucuuggcuccucccucccgacaaaauaucuucuaauauuucuagaaacauuugcugauuggguauacauacuggguuuuuccuuucuuuucuuuuuuguuuuuucuuuuuuuuuuuuuuuuuuuuuugagacagaguuucacucucacccagguuggagagcaguggugugaucucagcucacugcauccugaaccaccugggcucaagugauccucccaucucagccuccccugaguaucugggaccacaggcaagcgcuaccaugccuggcuaauuuuuguaauuuuugaagagaugggguuuugccauguugcccaggcuggucucaaacuccugggcucaagcaguccacccaccuuggccucccaaagugcugggauuacaggcaugaacuacugugccuggcuuuuuuuuuuuuuuuuuuuuuuaaacaaaagcauauuacuggcuucuucaguuguggcucauuucaauaacuauuucuuguaauaugugucuuggaacuagcuuauccuuggaaguguuuuucucacuauauuguuagaagguaaacaaaguggaaaaugcauaaauuaugugcacugcuucuguacuuuagaacuguuaguugacugguagcauuacugaaccuugaaccuugaauuggccuuuuuaggagcccagucacugugaacucuugagcaaauguguccuuuaucccugcaaggacuauuugaaaagagacccaggaagggcacaacuggcuugaagugggaaguagugaaggaaugagguacauagauaaaaucuauuuaugaaugaccuuucaggaguuagccuacaaaauauuuucuaauuuuuucauguauaaaaugcaaagggggcugggcgcaguggcucacgccuguaaucccagcacuuugggaggccaaggcggguggaucauuugaggucaggaguucaagaccagccuggccaacauggugaaacccuaucucuacaaaaaaaaaaaaaaauuagccggguguggugacaagugccuguaaucucagcuccuugggaagcugaggcaggagaguagcuugaauccgggagguggagguugcagugagccgagaucgugccauugcacucuagucugggcaacaagagugagauuccaucucaaaaaaaaagcaaagggaaggcacagauggaaggaauaaggaauucugugggaaagcaucuuagggcaucuuaccacuaaagugaauuagcucucuccuaauccuguccugugcuuggaugugauaacuauugaaugacagugguaagguuucauacaauuuagucauauguaacaaaauucagcuuuucucuuaaacacuucacuguguauguguuuaaggagugaaaccuacauagauaagguguggagcuggcguccuugaguucuguuguguuugauauguagcccagaauuucauuuacuuguuaagaaucuaccuugagagugguagggggcucuuacuuaauuuuuaaugcaagcaugucccgcuauucuaauaugauuaaacuuuacaacaucuacauaucuuuuaaauccauaacucagugacauuuuaaaguuuaaggcaacaguagagaaaagugaaauuuuaaauaccacuguuuucaggaugacuguaugagaucuucuugaccuauuagguaaggucuggucaacuucuuaugguagcuuuuccuuaaacuuuccugguauuccuacugcaugagaagguguccuuccuaaagcuaauguuaacaaaagccugauuuguagcaaauaaacauggguguccuggcuuucuuuucuaacagcaaucagaaacggagacuguucaucuguuuaucccagcucuaucagucggugccaucaucggcaagcagggccagcacaucaagcagcuuucucgcuuugcuggagcuucaauuaagguacuguucuaccagcugugguucucugguucuuuaaguaaguuacagaaauaugaaucuucuugccacuuuauaauuugaauagaauguaaaagacacuguuaggguuacauaaggauaugaagaaacccccaaacaacaguggcuuacaccaaggaggcuaacuucucugugcagaaaacacaguuaggaggugaacauccgggcuggguguuggcucugcccccaccaaguccuuggaccuaaguuccuuccaagccaccuuccccagguacggccuuggucccucuugguuccagauugacaccauucagugcuccaggaaucaggucuguugcccagccaguaggagaggagaacauaauaaagagcuuuucuucuagggagguuucuuguuagcuacugugggauauuucuaccuauauuuccauugcccagaacuuggccagacgaaguugaaggggcaaaauacaggcuaugcacagucagcuaaacauuuuguaacuacagaagguaacauaccagaggacaaauaauggugucugccguaauagauaacuguguguucugaagauucuguauuuugaugccuuauuuaaggaaaauaaagguuggccaggugcgguggcucacaccuguaaucccagcacuuugggaggccaaagcaggcaaauugcuugaccccaggagcugaagaccagacugugcaacauggugagaccccaucucuacaaaaaaaaaaguguaauuagccaggcaugguggcacacaccuguagucccagcugcuugggaggcugaggugggaggaacacuugagcuugggugguugaggcugcagugagcuaugaucacaccacugcacuccagccuaggccacacaguaagacccugccucagacaaacaaaggcauguggugugcaguauccuugaaacuuaggguacagagauuccuagaguguguugcauacacaggaagcccaaggagcccugaugcaagugggccaaggaccauacuuugagcaccacugguguagugaacacaggcaauggagacagacccagcucucccucuagcucuguuagcugugugaucaugguccagauaacucaauuucuccagccuuccauuuccgcauuugugaaguggagguaauacuacuucaucaggacguggugaggauuagcugagagacagcacguggaggucuccauuagggcccggcacagaauaagcauauaguauaugcaggagggaggccuaaauugugaacccacaggaauugcugccucucccuaauuuccuucacgaaggcuuuaauucugcauuucagccagucacaugcaaauguuaggcugguuggcccaagaugccuaucagugauaccugaaaguaucauaacuuguuguugggucuguuacagauugcuccagcggaagcaccagaugcuaaagugaggauggugauuaucacuggaccaccagaggcucaguucaagguaugugcucuagaguaugugcuauguccacagguaacaaaugcacagguaguccauaaccuggcgucucccuuaaauaugucuaaaucucagaaagagucaauggaaauucuuaucuaagagcugaguagaaucacacucaaaauuauauuucgaaauuaaccaaaagucuuuaauuuuaagaguucuguacugguugcuggauuuaccugucucucaaagguuaauuuugcuuaaugguuuguaauccuaugcuaaggugagaccuuaaaauuuacaaaccugccagguuaauaugccuuggaaacuuguuuucagauguuuucccuccugucccugagauugccuagacuugaauuaaaaugcccccuuuuuccuuacccuuggauuaucucuguuagacccugcccauagacucuacaaaucucucuaaucccugggaucuuagagauaggaauggcaggagcucuuguagcauuuguucugguaugaaccauugcacguuuagugggauuugaggucuuuggggcugcagugugccuuucaaugucuacugagagaugguagagcugagacuuggcagccaggcugcuaguucaaauccuagcucugccauuugccuuguaugacauugggcaaguuacuuaaccuuuuucuguaaaaccagggauaagagcaccuacauccuaagguaguuuaagguuuacacaauauaugaaauguuuagaaaagugccuaacacaugggcagcacaaaauuagcgugcuggggguauucaacagacuauggaugaaucagacuaagaccaugccaaauucauaaauauauuccuuuuaguguaugauuucucccacaaaauuuaguaugggugucuugucuuagaacauuuaguggcuguguaagaagacaacuauuuaaccuuaagcuguaguuuuuuuuuucucuuuuuuuuuuuuuuuuuuuugagacagagucucacucugucgcccaggcuggacugcaguggcgugaucucagcucacugcaaacuccaccuccuggguucaagcgauucuccugccuccgccucccgaguagcugggauuacaggcaugugccgccacgcccagccaauuuauuuuuaguagagaugggguuucaccauguuggccacacacucaaacuccugaccucaagugauccgcccaccuuagccucccaaagugcugggauuacaggcaucagccacugugcuccuggccaagccuuaguuuuuuuagccuuaaaguguaacaguaacuaguaacagugcauacaguucucuccccaccccaccucucucccuuaaaucaaacaaaaaaaaucacuuucuuugacuucuauuuucucugggccauuuuuucacuaaaaacccaaagcugcuuucacuuaugugaagaaugggaaacgaaggaggugcuuugagaugugggugguuaggugaagaaagaaaaucaugugaagaaauuuauuccuucacagcagccuugugauccaggcaguucaaaucuuaacucagaauuguugaaaacugcuuccuaucccaaacucucagggucacuuuuaguuugaaaucuuaaaagauaaauacaaacaugucuuuccuuggugcugagcuuuuagucuuauaaguagaauuacuguccugcaacuccuaugauguuuguaugauaggaacuucaaaguucuuucccuguauucacuaauaaaacucauguuuuauaguuaacuuaaauguaacacuuaagccauaguaguuaaauuuuauuuaugugauuggugacaaugcuaaaugaauguuuuacuuuagagaucuaaggaaugguaaaccaccuaccccguauuuuuccuuacaaauucaagagcuucaguuuuggaggauaguguauaucccuagugucuuuuugacugucuuaaguaauaguaauaucuacgucauuggccugaggcauuaaggaucauuggaauauaggguaucaagaugaauuuuguuuugucgguagugcccuaaaaugagcucagcuuucugaaucagugaacgcguguuggguacuauuguuuuuugugguuuacccuggcagcuugucaaaccaacucucaggcuccuuucugcuuugcuguauguaauagguuguuuauauauaauagguuguuuauauaguugcaugcaguaggugauaggauguauugacucuaaauaucagaagugucuuggccaggcgcgguggcccacgcuugcuaucccagcacuuugagaggccuagguggguagaucacuugaguccaggaguuccagaccagccuggccuacauggcaaaacuccaucucuacuaaaaauacaaaaauuagccaggcauggugguggaugccuguaaucccagcuacuuaggaggcugaggcaggagagucacuugaacccaggagacagagguugcagugugcugagaucgcaccacagagaaagagacucugucucuaaaaaaaauaaaauaaaaaaauaaaaaaaaauaaaaggcagggcacagugaguggcucaugcccauaaucccaacacuuugggaagccaagguggguggaucaccugaggucaggaguucaagaccagccuggccaacauggugaauccccgucucaacuaaaauaacaacaaaaaauuagcugggugugguggcgggcaccuguaaucccagcuaguuugggaggcugaggcaggagaauggcuugaacccgggggucggagguugcaguaagccgaaaccaugccauugcacuucagccugcaugacagggugagacucugucucaaaaaagaaaaaagugucuuaccuugauguuguagccucuuuaaaauauucaaaggaaaaaccaccuuucuaagaguaugaaacacauuuaaauugaaaacauuuuucucagcagguuucuaacuggcccauguagaugugagcuugacuuuuagugagcuuggcauagcugacucugcaguucugucucuuuugcucaaaaaaaaugugaccaggugugguggcuugcacugguaauaccaacacuuugggaggccaaggcaggacucuugagcccaggaguuugugaugagcguggcaacauagcaagacccccaucucuauaaaaauuaguggcgcaguggcucacaccuguaauucuagcacuuuuggaaggcugaggugggcacaucacuugaagucaggaguucgagaccagccugaccaacauggugaaaccccaugccuacuaaaaaugcaaaaauaauuagccaggugugguggcuagugccuguagucccagcuacucaggaggcugaggcaggagaaucacuugaaccugggaggcggggguugcagugacccaagaucgugccacugcacuccagccugggcaacaaaguaagacuccgucucaaaaaaaaaaaaaaaauaagucaggugugguguugcaugccuguagucugcuacucaggaggcugagguaggaggaucgcuugagcccaggagguugaagcugcagugagcuaugauuguaccauugcacuccagccuggacaacaggaggacccugacuccaacaaaaaggaaagaaaaaugcaacugaugucucauggccagcaugagaaguuuuaccuaucacaauuuuaguacgaauggccauuugcccacaaaaauucguuuuuauuagguuauuaauugccuuuaacuguuuucaucagaagaauaugguuuauccuucuuucaccaagcauucaguugccucuacugugaugggcaguaguuauugucaaccuuuuaggacuucuaacugcucucuucuauguuauuuucaacaaucuaugaaauguagauguaucacugcaaagggcuaucccacuuggauuugggccaucuuucaaguuaacugaccuuuuccauuucauacaugaaugacacuaauaggauguguuuucaucugcaggcucagggaagaauuuauggaaaaauuaaagaagaaaacuuuguuaguccuaaagaagaggugaaacuugaagcucauaucagagugccauccuuugcugcuggcagaguuauuggaaaaggaggcaaaacggcaaguacuucagcaaaaccugugcagugguaugaaagggaaagcguugaaagguacuuaggaguuccaaguccccgaauuuuggcuaauuuauaaaaagcaggaccaucuugaccaagguuuggagaagauugccuuuuguuuccugucugaguguuggugccagcuauuagugaaaguaaugcaucucuuucagaucacuuugugugagaggauuguccuauauuuauaaagggcauuuaacguucuccugauaaaacuuuagcuuuuuauggaacagacacuuaacaggaauuuuaaaaauuucaucuacagcuuguuacaucuguaauggaaaaaaagcaaacuguuucuagucucuaauacauauaacuuguaaguggguuucaaagcuauuuauaauuuugaagugauugaguacauacacuuuggaaucagacucaggauuugaaucugguuuugccauucacuuguauaacuggacaaaucaguuucuuuggaugagccuuaaucaucuugaaguggggauaauucuaauaaccucauggaauuaccacuggauuaaaugaaauuuguaaagccauacauagcucacugucuggcgcacaguaagugcuuaggaaguaagguuuuaaaacugccacuuaaugugauuuauauuuaucucuuucaggugaaugaacuucagaauuugucaagugcagaaguuguugucccucgugaccagacaccugaugagaaugaccaagugguugucaaaauaacuggucacuucuaugcuugccaggcaagugggcucuaaaauaagcuauuguaucuuucucacguggaagcaauucucccacaggugcuccuaccugauagaauuaguuaagguuguuugaugcuuaagacuuuucaucucccuuuuagcgggugauuucagagacuacuagcaaacugacuaguauguaucuuuaaucaucaaauggauuucuauuugaaauuguugaaaugaaggaguacaauaacuuuuaguagcuuuugaucaaguggaauuucaaagcucuguccuuuucuagguugcccagagaaaaauucaggaaauucugacucagguaaagcagcaccaacaacagaaggcucugcaaaguggaccaccucagucaagacggaaguaaaggcucaggaaacagcccaccacagaggcagaugccaaaccaaagacagauugcuuaaccaacagaugggcgcugacccccuauccagaaucacaugcacaaguuuuuaccuagccaguuguuucugaggaccaggcaacuuuugaacuccugucucugugagaauguauacuuuaugcucucugaaauguaugacacccagcuuuaaaacaaacaaacaaacaaacaaaaaaagggugggggagggagggaaagagaagagcucugcacuucccuuuguuguagucucacaguauaacagauauucuaauucuucuuaauauucccccauaaugccagaaauuggcuuaaugaugcuuucacuaaauucaucaaauagauugcuccuaaauccaauuguuaaaauuggaucagaauaauuaucacaggaacuuaaauguuaagccauuagcauagaaaaacuguucucaguuuuauuuuuaccuaacacuaacaugaguaaccuaagggaagugcugaaugguguuggcagggguauuaaacgugcauuuuuacucaacuaccucagguauucaguaauacaaugaaaagcaaaauuguuccuuuuuuuugaaaauuuuauauacuuuauaaugauagaaguccaaccguuuuuuaaaaaauaaauuuaaaauuuaacagcaaucagcuaacaggcaaauuaagauuuuuacuucuggcuggugacaguaaagcuggaaaauuaauuucaggguuuuuugaggcuuuugacacaguuauuaguuaaaucaaauguucaaaaauacggagcagugccuaguaucuggagagcagcacuaccauuuauucuuucauuuauaguugggaaaguuuuugacgguacuaacaaaguggucgcaggagauuuuggaacggcugguuuaaauggcuucaggagacuucaguuuuuuguuuagcuacaugauugaaugcauaauaaaugcuuugugcuucugacuaucaauaccuaaagaaagugcaucagugaagagaugcaagacuuucaacugacuggcaaaaagcaagcuuuagcuugucuuauaggaugcuuaguuugccacuacacuucagaccaaugggacagucauagauggugugacaguguuuaaacgcaacaaaaggcuacauuuccauggggccagcacugucaugagccucacuaagcuauuuugaagauuuuuaagcacugauaaauuaaaaaaaaaaaauuagacuccaccuuaaguaguaaaguauaacaggauuucuguauacugugcaaucaguucuuugaaaaaaaagucaaaagauagagaauacaagaaaaguuuuugggauauaauuugaaugacugugaaaacauaugaccuuugauaacgaacucauuugcucacuccuugacagcaaagcccaguacguacaauuguguuggguguggguggucuccaaggccacgcugcucucugaauugauuuuuugaguuuuguuuguaagaugaucacagucauguuacacugaucuaaaggacauauauauaacccuuuaaaaaaaaaaucacugccucauucuuauuucaagaugaauuucuauacagacuagauguuuuucugaagaucaauuagacauuuugaaaaugauuuaaaguguuuuccuuaauguucucugaaaacaaguuucuuuuguaguuuuaaccaaaaaagugcccuuuuugucacuggauucuccuagcauucaugauuuuuuuuucauacaaugaauuaaaauugcuaaaaucauggacuggcuuucugguuggauuucagguaagauguguuuaaggccagagcuuuucucaguauuugauuuuuuuccccaauauuugauuuuuuaaaaauauacacauaggugcugcauuuauaucugcugguuuaaauucugucauauuucacuucuagccuuuuaguauggcaaaucauauuuuacuuuuacuuaagcauuuguaauuuggaguaucugguacuagcuaagaaauaauucuauaauugaguuuuguacucaccauauauggaucauuccucauguauaaugugccccaaaugcagcuucauuuuccagauaccuugacgcagaauaaauuuuuucaucauuuaggugca

SEQ ID NO: 191611 - RNA, 27256 nt, Homo sapiens
uucaaagaaauuagcuuuuauuugagacuacuuuuccccacauguaucuuuuaagaauucuaugcuaugugauaaccugcuuauccacugucccaauaccaaaauuucuaacagcgaauuauacaacugcucuagguaauaaauaaggguuguccuucacugauuaagggaauaaacuucaauaaacuuaacaacaacaaaaaaaaucacacuuuaguuuuuaaguuuuaacagauguauuucaaauacagcauguuuuacaggaguucacaagcuuuucaucucuaaaaaaaaacuuucaacuaccugacuguuccauuccaccccagacaaaccugacaugacugaacuacuucauguguuacuuucccaaaaauaaaguuaaaaaaaaaaaggaacucaugauaaaugcagaucucuaauacaguaucuaacacaaaagaagcuuuaaaaagacaguuucuuuccuuauuugauuagcuagaaguuuaucuagguaaaagcaaaaaaaaaaauuuacaaagcauaacauaacauugggguucuuuuuauacucaagauguuuaacuguucaaaaugacaacaauuacaucuuuuaagaguauaauaaaauggguggaaaacagcaacacaacugacaaaaguguagaugcuaaauaaaccaaaguuuuuuucuuaaggaguaggaagaauccacagcuuggggaaaucucagaauuaaaaaaaaaaaaaaaaaaaagaggaaaaaaaauguccuuaauugcaaccauuccguuaucaauagcguccuaaaagagaaaaagcaaaaaaaaaaaaaaaaaaaaaaaguuaacaauuauaguuuaauuugccucauauuuuuccaacuauuaacugccaccuuccaccuuauacucuaauauucuaaaguaagccauuaauuagaaaugagguuuuuuaugcuacaaaaguaaaguucacauacuugggcuguaggaacgagaucuugaucgugaucuauaucgacuauaauaaggagaaggugaucgucuucuguaagaaaugaaagauuacuuagcauacuauauaaucacuccacugaggcagaugaaaauaaaaauuccucaucauucaaaauaauaauguaccuaaggugauaacuacuuaauauuaaguucucuuucugccaaugagaccagaaaaguauauagcacaacaaaauacugacauauacagacugcuaacuucugcucccaaaggcgucauauaugaucuauuuuaaaaaucaaguuuuuauucauauguauccaacauaaaagugccaaguaacacuacuaucaucuaauuuagaacagaaagcucaaguuaaaacauuaccuguaucgguaaucauagucuucauaucugucauacccacgaucauauccucuaucauaguaagaaucucgacgucugccaccaccuccaccuccaccgccgccgccuccuccaccacccccaccacuacugcagaaaaauguaaaaauucuccauuagugugaaugacuauuuuccaggacacuuuaauacaaauugaauggcuuaaaaaagagaaaagugaggaagaacaucccuuucaugagaaauugccuccguaucucauuuuacugacucccaugguauucugguuugccuuauucccuacauacauaaucaagaagggcuucacaaaacucucaaaacuauuaacugcuuuucuacuaaugcacugcccaaauuaaaaucuuuucaacaaauugaaacgaugaagcacuguguugagcagcaguauaaaaaugcuaagaugcauuccuacugcuaaaugagacugguaaauaaauaaauaaaugaauaaaagguguaucccugugacuaaaaggcaauaaacaccaagaauuuuuaaguaacucuggacaccaaagagaauaccaaggaaugacuauauuccuucuuuuauucccaagaaauaccucugugaauacugccuuugguuguauauuuuauuuuuauuuuuugagacggagucuugcucugucgcccaggcuggagugcaguggugcgaucucggcucacugcaagcccugccuccgggguucaugccauucuccugccucagccuccugaguagcugggacuacaggugccugccaccaugcccagccaauuuuuuguauuuuuaguagagacgggguuucaccguggucccgaucucgugaucucgugauccacccgccucggccucccaaagugcugggauuacagguguaagccacugcgcccggcaaaugaacaucgugagccagccaggaggguuguauauuuaaaaacauuaucaaaaccccuacuuauguuuuuuuucuuuuuugagaaagagucucacucuguugcccaggcucacugcaaccucugccucccaaguucaagugauuccugugccucagcucccgagcagcugggauuacaggcaugugccaccacaccuggcugauuuuuuauuuuuuuuuaguagaagcaggguuuugccauguugccccuugccagaaucaauucuaauuauaggaaaaaaguuucugaguaaucaaaauuuugcacauauuucugguggauuucauaguuuagcuuaggaaacuugaacucuuacugaguuggucugcccauguagaugccugguguuggugugugcgcucucuugguuauagaauaauccacccgaauucuucuaccauccagcuccauuccauuugcccuuuccauagccuauaaagaacaggcacaaaaagucacguauaauucaccagucuugaaguaaucauuacuuaaaauuaagcacaaaguauauguaauccaaauaaacuccugauuuugaaaaugacagcaauguagcuuguacagggcauuguauagacaauucuagaccucaacaauguccagaacacauuuaaauuuacucagcagaaagaguaguuaauaaacuuucccaaauaauuuuccaguucugguucaauucccauuccccacuccaugagaucaacaaagaguaguuaacaaacuuuccuaaauaauuuuccaguucugguucaauucccauuccccacuccaugagaucaacaggggagcggagacugaagucuuuucaagcuaaauuuuuuguagguugcccagguagacugccauuucauacuuucuagucuccagcgauuucacuuacaaagacugacuucagaacauuaaaaaggguuugcuaagcuuuauacauguucuuuuuauaaccugcccccaaucuuauucuuuaguuugcagucuaguacacugauuaagacucagugagcagccaagaagaaaugauauaaacagacaagaacaaauuuaucguaaugccuuucaaccuuuuauugagacugaacuaauaaaaguauaauaaacuaauaaaaacuacacaauuuuuauguauccacaaauauuucuccguaagagugucccauaaacuaaaggucauuaaaaaaaaaaaaaaaaaaaaaaggaggucucacuccauugcccaggcuggcaguggaucauaguucacuguggccucaaacuucuuggcuuaugcaauccuccagccuuagucuccuaaguagcuaggaccacagguuugugccaccaugcucggcuaauuaaaacaaaaauucuugguagagaaggggucuaaacaguauuccauucaauggaaugcauuuuauuauuuauuuaugagaccaaguuucgcucuuguugcacaggcuggagugcaauggcgugaccucgguucacugcagccucugccucccagguucaagugauucuccugccucagccucccaaguagcugggacuacaggcaugcgccaccaugcccagcuaauuuuuuguauuuuuaguagagaugggguuucaccauguuggccaggauggucucgaucucuugaccuugugauccuccugccuuggccucccaaagugcugggauuacaggcguaagccaccacgccuggccugcaugcauuuauuuuuguagagacaagaucuguugcccaggcuggucucuuaacucguggccucaaguggccuucccaccucagccucccaaauagcaugagccgccuugcacagccuaauucuugaagauaagaguugucucuuuggucucuuugaaaagaacucugagaguauuauuuguuucugggacaauuuuuuuuuccuauucucucacacacauauauauauuuguagagaccaagucucccuauguuuccccaggcuggucucaaacuccugggcucaaguaaauccucuugccaaagugcugggauuagaggcaugagccaccacacccgguccaauuuuuaaaaagaacuuuacaucacauaaaugucugcaaaagcaaagcugcaacaaauuuaacacaucuuccauuugaaguuccaaaaaucaaaauucucuaaguugaucucccugcaccccauccuaagcaccccccaaaaaaacacacacaaaaucucuaaguacuucuuacuaaaacagggugaggagcuuauauuauuaucuucaccauaugcacacuaauaacuuugaaacuucagugaaauuuucagaaucagggagaaguuagucaaaaaggaauacaaauuuuaaaaagauuuuaaaaaucacuuuaggcugggcgcgauggcucacaccuguacucccagcacuuugggaggccaagauggggggaucaugagguaucaagagaucaagaccauccuggccaacauggugaaaccccaucucuacuaaaaauacaaaaauuagcugggugugguggcaugcaccuauaguccuagcuacucgggaggcagaggcagaauugcuugaacccgggaggcagagguugcagugagccgagauugugccacugcccuccagccuggcaacagagcaagacuccgucucaaaaaaaaaaaaucacuuuagccaagugaaguggcucaugccuguaauccuggcacuuuggggaggccaaaucacuugagguccagaguuugaggcuagccugggcaauggggcaaaaccccgucucuaccaaaaaauacaaaaauuagccgggcaugguggugcgcaccuguugucccagcuacucgggaggcuaaggugggaagaucacuugagccugggaggcggaaguugcagugagcugagaucgugccaccacacuccagccuaggcgacagggcaaagagcaagaccucaucuccaaacaaacaaagaaacaacaaacaaacaacaaaaaaagaaaaaaaucaaaucacuucagauugccugucccuaaagacuggagacagucucagccauacagaagaaaccauacaacaugccuguguuagcugagaauucagccugggcaacugaaaagagaaacugugauuuagcugacaagccucgucaccccgcuccuuaaguaacauauugucaccuagugaacuaaaaggaacuucuaauccugccacuaaguaacugcuccugucuuuaaaguugccaguuaagcuuuuuuuucuuuucuuuuugagaugaaguggagucucacucuguugcccaggcuggagugaaguggcacaaacuuagcucacugcaaccuccgccuccuagguucaagcaauucuccugccucagccucccgaguagcuugggguuacaggcgcuugccacaaugcccggcuaauuuuuguauuuuagcagaugggguuucacccuguuggccaggcuggucuugaacuccugaccucaggugaucugcccgccucagccucccgaagugcugggauuacaaggugcgagccacugugcccggccugccauuuuaguuuuauccagaaguggaaggggacagguggaaucaagagauaaacacguuucacauuaaaaaauauuaauaauaaaaaaauuacacuguucuggcuugcauuuugcaacuuuuacuucagcucagauauccuaguauuucuaaauugauaacauguaucucuuaauugagaaaaggaauauauaaaucacaaauacguaacaguaaaaaaaaaaaucauaagacugacaaauuaaggcauuaaacugccugugacauaaaugacuuaaaaacuaaaguacuaguuuguuagaguuauccgggguuucucaaccuuagcacuauugacauuuugagacugauucuauguuauggggugccagcuuguguacuguaugguuauuuagcaguguuccuggcuucuacccaccagaugccaagaacuuacuguuuuuaaaagauagccuuauuuggccaggcgcgguggcucacaccuguaauuccaacaccuugggaggcugaggcggguggaucacgaggucaggagauugagaucauccuggcuaacacagugaaacccugccucuacuaaaaauacaaaaaauuagcuggacaugguggcgggcgucuguagucccagcuacucgggaggcugaggcaggagaauggcaugaacccgggagguagagcuugcagugagcugagaucgcgccacugcacuccagccugggcgacagagcgagacuccaucucaaaaaaaaaaaaaaaaaaaaaaaaaaaaaaaaaaaaaaaagaaaagaaaagaaaagaaaaacacccugauuauuaaggucuaauaaaacuuccagauauauacaaauauauauauauuaauuuaaaagacagaaggucuaacaaaacuaaaaguauugagcuucaaauucuuuaaaaugcaauuuucuaaaucaauuacuaucaacuuuuaguaaagaguaagcgagccuaggccagguauggugguucacaucaguaauucuagcaccuugggaagccaaggcaggaggaacaguugaggccaggaguuguuccgagaccagccuaagcaacacagcaagacucccugcaaaaacuuaaagcaagccuaccacuuccuuuauaauaccgaacauguuagaauagcacuauuucaagucauugacauugauuaguucauuguguuaggcaaguuaagaauagcacuaaaaaauuaucaauucuuuccauguacuauuuuucaauuauugaacacacugauaaaugaacauuuagagaauagaaaaacaaguuccuuccucauuauagacacaaaauuaaacauaucaaacccacacaucagaauuauuuuuuaaaaguuaauguaaucaucuguuuggagcaucauuauggcuuauucaaaagagaacacuuacacauauacuuuuuccauuaauuuaaacacauauagcucacuuuacacagccagauuucaauuaggauaugccuauagcagagagcauaaccaaaaaaagugaaacuguagucacuccaauuguuaacacugagaggcagaguuugaaucaggucaaaauuagaaaggacacaacaggccauguaugauggcucaugccuguaaacccagcauucugggaggaucacuugaggccaggaguucgagaucagccugggcaacauagugagaccucaucucuacaacaaaaaauuaucugggcaugguggcccacacuuguagugucugcuacucaggaggcugagguaggaggacugcuugagcccaggaggucgaggcugcacuccagccugggcaacagagcaaaaucagcaagauccuaucuuuuuuuuuugagacggagucucacugugucgcccaggcuggaguacaguggcgcaaucucggcucacuguaagcucugccucccggguucgcgccauucuccugccucagacucccgaguagcugggacuacaagcgccggccaccacgccuggcuaauuguuuguauuuuuaguagagacgggguuucaccguguuagccaggauagucucgaucuccugaccucgugauccaccugccucggccucccaaagugcugggauuacagacaugagccaccgcgccuggacgcaagauccuaucuuuaaaaaaaaaaaaaagaaaaaaaggaagaaaaaaggaugcaauguuuacagaaauaagucuauuaaucaacuuuucacacuaauucaguacuauaaucaggcauauaaaagacaaauuuaccuccuuugagucaucuauucucucaaaauacacaaaagcaaauccucgagaucgcccaguucgcugaucauaaaccacauugacaccacucaaugguccauaucgagaaaauacuucacgaagaucccucucuguuguguacaaacugaggccaaacacuccaaggcaaguguugggaucuggauuugccuauugaauggaaauauuauuuaaaacuccaaauuaaaaucaaaaucaaagaaacacagaaauacuuuguuuagaacaccucaucuaauacacaauaaauauauuguuucuaauaauuuggagauaagauuuuaagagaacuagagcagaugagccauauuuuacaauucacaguacacccaaggccuucuuugggauaugcuuucugucuauagccugaauuaaaauguucuuacucuccagcccagcaauguucauaauguauccugaaaaucuuguaaucccagcauuuugggaggcugagguggguggaucaccugagguuaggaguucgagaccagccuggccaacauggugaaaccccaucucuacuaaaaauacaaaaauuagcugggcaugguggccggcgccuguaaucccagcuacuccagaggcugaggcaggagaaucgcuugaauccagaagguggagguugcagugagccaagaucgagccauugcacuccagccuaggcgacaagaguguuagaaauguuuguuucucgguguuguaaagaaauagcacuugaacauacauuuuuuuaguaaggccauuuuuauuuucuguagaaaggguacgcuugucagcaguuuugucacaagaguacacugaacaaaggagacagggucauuuauaaucugacgugucuaccuuacuguugugucuguuuuuuauuggcuggaaugggacuucacauucugauuugucuugauuggcuaguaacuucaaacuuuuuaaaagaggcaaaggcggaggagaacaaaggaaggaggaaguaauuuguggaauguugagaaagguaaaaacaccuuuaaauaaggaagaggaacaggcuaugaccuaaugcuuguuuggaccaguauaagcauguuagggcaaauacuuaggcuaaauugugggagcuaagaacauaaaguacauugauuuuuuuacuacggcuaguagauuuuuuuuuuuuuuuuugagacggaguuucacucuuguugcccaggcuggagggcaauggugcgaucuuggcucaccgcaaccuccaccucccgagguccagccauucuccugcuucagccucccaaguagacgggauuacaggcaugcaccaccacccccagcuaauuuuguauuuuuaaguagagaugggguuucuccauguuggucagccuggucuccaacucccaaccucaggugauccaccccacccggccuagcagauauuuaagaauguuagcacagcucuuugaauaaauuuugcuucuaagagaaauuauuaucuauuucuaauuagauggggaggaaaaucucuuugaacaaccuuuacuuuuuauaagagugaaacuccgucucacuuauaaaaaaaaaguauccucaguuuaauaccaucuuucuaguuaauucaaaugcuuuacaucccuuacagauuuguacuuaaucugacuucaucuguaauuguugauuuagaccuccucuccuccauuuucuuucuuuuuuuuuucugagacagggccucacucucuugcccaagcuggaguuuacuggccugaucauggcucacugcagccuuggccuccuugggcucagggaauccucccaucucagccucccaaguagucgggauuacaagcgugagccaauaugccuggcccauuuucauucuuuagcgaggauauucuuucaguguucccacaauccagauuuuagaaauaaauuuacagauuucaaaacauuaaauaaugacaugcuccaccacaguuuaaguuaguauccugugggagaagcauaguacagcaugcaaacauguucuaagaacuuuagagcccggcugccugguugaaaccuagacugcuaguuagcaaaaacuaaaccaaaaccaaaacuaaaacuccuucaaugucauacauccaagacucaauuuuuuuuauauauaacauaacuugccucacagaaauguuaaaagcuuuaaguguacugaauaaaaguguuagcuaugauuacuacaaaguuuuuaauauuucuuugacccccuuaccccaucaaaaaacuuugaauauaacccaguauucccaacucaauuuaugcuuuucacuugaauucguggaacauauuucuuuuuuuuuuuuuuuuuuuuuuuugagacggagucucgcucugucgcccaggcuggagugcaguggcgccaucucggcucacugcaagcucugccucccggguucacaccauucuccugccucagccuccggaguagcugggacuacaggcgucugcaaccgugcccagcuaauuuuuuguauuuuuaguagagacaggguuucaccguggucucgaucuccugaccucgugauccgcccaccucggccucccaaagugcugggauuacaagugugagccaccacgcccggccggaacauauuucuucccaaauuucaucuccuuuucuuuuuuugagacagagucucgcucugucucccaggccagucuggaaugcaguggcacaaucucggcucacugcaaccuccaccuccuggguucaagggauucuccagccucagccucucaaguaguugagauuacaggcguaagccaccacgccuggcuaauuuuuguauuuuuagcagagaugggguuucaccauguuggccaggcuggucucgaacuccugaccuuaggugacccacacccuuuggccucccaaagugcugggauuacaggugugagccaccacgcccagccuucauguccuuuuuacucaaacgucaugaaaagaaaaauauacucccggccaggcaugguagcucacgccuguaaccccagcacuuugggaggccaaggcagguggaucaccugaggucaggaguuugagaccagaggggucaacauggugaaaccccauuucuaaaaacacaaaaauuagcugggugugguggugcacaccugcaaccccagcuauucaggaggcuaaggccgcagugagucgaaauugcaccccugcacuccagccugggagacagaguaagacuuugucuaaaaaaaagaaaauauacuuccuuugcauucuuugucauaaaacaugguaagcuuacgaaagaugguggcauuuccuuuacuuugaaagcuaaagcagcuuauuaaggauguuuccagaguaucacuucuaaacaauggccaagcuccccuaaaagcaagauaugccaugacuaaacacauaaaagagaaaauaagucuucauuaacuuuuauaaaccacguacccugcugccaguaugucuucuccgguuagacauuggagaauggcuucggcuccuucgccgccgguauucugguguauaugaucuacuucgagaucgucuccuaugagagugagagugggaucuggaucgaguguaacgucuaugagaaugucuccuugaccucgaccuuugagagaaauacauuuagguaaaaauacugaaacaaaauggcuaaaguccuucccucuuccaagaagguauacauauaucccuaacuauucucagguccuuccuccuugcuucugaggaaaggguauucuuccuuugguucacuuaagucacuacaucuuccacucuucucagucaagccccucuacauucacccuuuucaccuaaccuuacaaaaauguuaaggccccaucuucuuuuaaaaaacaaaaaaaaaacaaaaaacaaaaacccacuauugcuauaaaauaaaaucguggccgggugcgguggcucaugccuguaaucccagcacuuugggaggccgacgcgagcagaucgcgagaucaagagaucaagaccauccuggccaacauguugaaaccucgucucuacuaaaaauacaaaaauuagccaggugugguggcaggcaccuguaauuccagcuacuugggaggcugaggcaggagaaucgcuugaacccaggaggcagagguugcaagccgagauugcgccaccgcacuccagcaugguaacagaacgagacucugucucaaauaaauaaauaaauccuuugauucuuagcuaagugcagugaugugugcuuauguucccagcuacauggaaagaugaagcaagaaaaaucacuuggggccgggcacgguggcucaugccuguaaucccagcaacuugugaggccgaggcgggcggaucacgaggucaggagaucgagaccauccuggcuaacauggugaaaccccucuacuaaaaauacaaaaaauuagcugggcaugguggcgggcaccuguagucccagcuacuugggaggcugaggcaggaaauggcgcgaacccagaaggcggagcuugcagugggcugagauugugccaccguacuccagccugggcgacagagcaagacuacgucucaaaaaaaaaaaaaaaaaaaaaaaaaaagagagaaagaaagaaaaaucacuugggcccaggaggacaagucuagcccaggcaacauagcaagacuccacacuucuauuuuaaaaaaaaaaacagaaacaaagacaaaacaaaacaaaaaaaaucaggcugggcgcaguggcucaugccuguaaucccaguacuuugggaggccgaggcaggcagauuacgaggucaagagaucgagaccauccucgccaacaugguaaaacccugucucuacuaaaaauacaaaaauuagcugggcgugguggcgcacaccugucaucccagcuacuugggaggcugaggcacgagaaucacuugaacccgggagguggaggcugcagugagcugagaucgugccacugcacuccagccugggaacaagcacaaaacucugucucaacaaacaaacaaacaaacaaaauccuuuuugauuuucugcuacuuucuccauauaguucuuugucgcccaggcuggagugcaguggcaugaucucagcucacugcaaccucucucucccaggcucaagaaauucuuccaccucagcuucccagacagcuaggacuacaggcaugcaccaccaugccuggcuaauuuuuauauuuucuguagugacaggguuucgccauguugcccaggcuggucuugaaguccuguucaagcaauuugcccaccucgaccuccccaauuaagccagugugccuggcccauaaaguucuacauuccccucucugcuaaguaucauuuccauuuccaauucuucuuuagccugcugcaaucuaguaucugcuaaacuaauucaacaaccaccuaaaugcccaucaaaacugguaacauuucuuuuuuuggagacagagucucacuucuucacccaggcuggagugcaauggcacaaucucagcucacugcaaccuccgccuucuggguucaagugauucuccugccucagccucccaaguagcugggauuacaggcacuugccagcaugcccagcuaauuuuuguguuuuuaguagagacgggguuuccaccauguuggccagguuggucucgaacuccugaccuugugauccacccaccucagccucccaaagcacugggauuacaggcaugagccaccgugcccagcccaaaacugguaacauuucugagucuucauuucuuguuuuuuuuuuuuuuucccccuucuugagacagaaucucacucugucacccagacuggagugugcaguggccugaucuuggcucacugcaaccuccacuuccuggguucaagcgauucuccugccucagccucccgaguuccugggaacuacgggccugugccaccacaccuggcaaauuuuuuguauuuuuaguagagacggggucucaacauguuggccaggauggucuagaacuccugaccucaagugauccaccccuccuugugcucccaaagugcugggguuauaggcaugagccaccacacucagccuaagccuuuacuuauugaugcuuucuauaacauuucacuugucuacugcugcuuuucuaguucccaguugcucuaauucccaguugcuugcaguccuuucuuugccuguaagacuaauccgacaggccgggcacgguggcucacgccuguaaucccagcccuuugggaggccgaggcaggcagaucacaaggucaggagaucgagaccaucguggcuaacaugauaaaaccccgucucuauuaaaaauacaaaaaauuagcuggguguugguggcgugugccuguaaucccagcuacucgggaggcugaggcaagagaaucacuugaaccagagaggcagacauugcagugaggccacuguacuccagccuggcgacagagugagacuccgucuucaaaaaaaagacuaaugacccacccuuaacuaaacugacacagaccagcagugaugacagucauauaaaauaccuucuauacgguacucaaugaacccaggagguggagguugcagugagccaagaucacaccacugcacuccagccugggcaagagagcaagacuccaucucaaaaaacaaacaaacaaacaaacucuucaacagucucuacuuuuuuucagcucaauaauaacccauuguugauacugcuaacuguccucaguaauucccuacuugaaccagaucacccauuuucuguuaacuaaguaaucaagcaaaauuuuuuugcacgauuuuacaaagugaggauauggaauacaggaauaaaacuaaugaggaaagaccuuaugaaacacaauaggugaacaauaacgcuagaagaguugauauuucccauuuuagcuagcaccaauuuacaguuccaauuuuuaaaaugaagaaaaaaaaguaagaaaauccuuaauuuaaaacaucaauuauuacuuuuaaacagcaaugaaagugagacaauaaaauucuuccagcugggcgcaguggcucacgccuguaaucccaacacuuugggaggccgaggugggcggaucaccugaggcaggaguacaagaccagccuggccaacauggugaaaccucguuucuacuaaaaauacaaaaaauuagccaggugccugugaucccagcuacucgggaggcugaggcaggagaacugcuugaacccgggagguggagguugcagugagccaagaucgugccacugcacugcaggcugggcaacagagcgagacuccaucucaaaacaaaaacaaaaacaaacaagaaacucuucaggagucucuauuuuuuuuaaaucagacagugacaacauaaaaaaauuaagaguaagggaauaauggauaugugaauaacaauguucucaggugacaaaugaaaugagacaggagaaaaacguucuagguugaagguggcaaaugcaaaggcccuaaggcaaaaacaugcuccuuucuauuucuaagcucaaauucuagccagugcuauucugcacauaauaaauuuaauaacugaguaguaaguaaucaagcaccgggcuagacccuugcuguaacagaaaacaguaugguugcuaaccccaagaaaaggacagccuuuuaacugauuuuucugucucaugccccuuugcaaguagacuauucaaagacauaaaaucuaucccuccacccaagaaaugacaaggacguaagcuaacuggucaggcuguuuuaaauuuuuuuuuuuuuuuuuuuuuuuuaaaaagaaagagucucucugucacccaggguggagugcacuggcgccaucucuugguucacugcaaccuccgccuccuggguucaagcgauucuccugccuaagccucccagguagcugggacuacaggugcccgccaccccgcccagcuaauuuuuguauuuguaguagaggcaggguuucaccauguugcccaggcuggucuaaaacuccugaccucaaguuaucuacccaccucggcuucccaaaguguugguauuacaggugugagccacugcacccagccugucuuaaaacuuuuuaucccaccucaguacaccuggggcauuugacagugaacuuugcauugguucacuauugcguuucuguuauccaugguggugggacuccaaaucagcuaaggacuuuuccgcccaauuacaucucaccagagcucuacgcuggacagagucagaaucuucagauaaaaauguagcuggaauguaaauccuaaaaaugcuucucaaucguucugaccaaccagcauagcauacacacaucaacuuucucugcauuaaauuacaugugagacuccaaugcagaaaaccgccuuuuuguugugcaaauauuguuggcauagaaaccagacacuaauuaucaaaugccaaacacauuuaaauugauggcuauauacacauaauuuguacugguugcaacuauccaauauauuaauugggcugggagaugauuuuaguauugauuucuuauuuuuucagagauagggucucccuggcacccaggcuguggugcaguggugcaaucaaugcagccuggaacuccugggcucaagccauacuuccaagucuuugucugggauauaguauucauuuacaaagagcagucugagaaaaacuauaauuuugagucuuucgugaaauuucuacacaaaaugcagccaacaacugcuuuguccucaaaaaccccagaagaauauuuuaaguauuaucuuaaacacacuuaccuggauuuugaucuugaucgagaaugggauucagaguguuuggaaacccuugauggacuacgagauccugaccugcucuccgauuuuacacgagcaggaguucccguuggagauuuugacugagagcgagacuccuaacaaagaagacaguauuacaaauggcacuggucauguagaugccuaacaccuaacauuuaaaguaccguaauuauuuauauugauugcuccugaaaaacaaaugguuagacaacacccuccagaaaaaauuucagcucaauaauaacccacuguuaauacugcuaacuguccucaauaauucccuacuugaaccagaucaccaauucucuauuaacuaaguaaucaugcaaauucaucuacaacuugaucauacagacacuggaacauaaaccauacauuuacuuaaccuaggacccauucauucuuccagauucuuuuaauucuacuucacucuugcuuucuacuucucuucauucuucauugaguuuuucauuuuucauacuucguguauucuuccccaauucaaacaauucaaaauagccuuaaaaaaauauucaagugcuucuaucugaccaaucuucuguucaauuuuuucccccauucaauuuuaauuuucugaucuuuaauacuuuucauuagccuucuuuuaucuugauuuaucuuccacauucuuggaaaaaacucuucaauuucuucacgaacauuaaccuuaauggaaaaagaacauuuaguauauuuaagcacguggggauuauaaaacucugcuggaguucagaauguuaucuaccaaauggaaaagccagcagguaaagugcaaguaacuaguuuauuuaaaaaaaaaaaaaaaaaacaauuuuauagucuuuaaaauuguucaaaacucuaguuucuaacaaagagaauuuacuaaauuucucuaaaugcuuuuuaaaccauacucuucacccuccucccauguuucauucuaguuccuaaaaugugagcaauuuuaauauaauucaaauauaaaucuaacaacuauaauuuccccccaccuaaguguuaaauuuucacuacuuuauaaucugaagauucuuaaaaauaagcuuucacuaagucaugcuaagaaaucaagauauaguuagagcaaggcaucccaggcugaaauauuuguacacaccuaucuaaacucacccauagcacaugucaagguucaaauaagucaaaaagaaaaaaaucaguaaaauuacaccuucucccaacuuugacuacuaucuuugcucauucugacuuaaaauauguucugaagacaaacauaccgaaaaaacuaauaagcaugaaauucuuaaaauuuccccauuagcuuauuaauuccugauauacacauuuuugcaaccagaucacuuuaaaaugcucuauuauccacgacauaccacaaugugcaagaagguacaaaauuuauaucauagucuuuaucuuugauuccaucucuuuagaauuauguucaguuuuuacauaauuuaugcauuuauguauacugguacucccuucagugacuauauucuauauccaaaaagugauggguuucugaaaaaauuggguguaaaucaaagcauuccaaauaaaauaacuuacugaucauaagcuuguuuuuuuuaacugcacagauaugaggcacuuaugaucaaaacaggauggacagcuugguuucuguguccaguuaagccuugauuaucaguguaaauaauuaucucaauuucacagaaguaauuucacaccaauuuauuuaugccuuaagacuaucacacaacucaaacagcuuucugaaaacuuuuccuuugcuucaaguuuaaugucaagacuuauuuaucaagaacuguacaaaugccaccuggucauuuucuuucagauaaaaacaaaacugaaauacacagcuaccuuucagcucaauaccaaccuuucccauuuagcuaccuacaagucuuucacugcaucucagauacucuaaaccacucaacagaugucuggagcaggcauagcaaucugggcuuuuucauucacugaaacuaugaaagcagcauauucaguaucuuauaaaaaaaggcauggcuaauuugcuuguaauuuaaguuucacagacugguucauuaaucaaacucauaagaguaucuuccccucuucucuuuuggcuuuccuuuccacaaaacagacccugugacauaacauucauuuaugcuacuguugaauagcaauagcuggauuauuaucuacgaacgcugcuacaguccuucucaaacauacacaggaggcuuugcucuguaaaacacuacaauucuuuaauuuuacuaggauggaaauaaaaaccuuuuauuaaaguaaacaagauaauucaguaacaucuuaaaauuccaauuuuaaaucccaguuuuggaguagcaacaaagcauuaugguaugauagaaugucuuuuuaagagauguuagcuuauuuauuuuaagaaggaggagucucauucugucacccaggcuggaguguaauggugcgaucuaggcucacugcaaccuccaccuccuggguucaagugauucuccugccucagccuccugagcagcugggauuacaggcaugcaccaccuugccuggcuaauuuuuguauuuuuaauagagaugggguuuucccauguuggccaggcuggucucaaacuccugaccucuagugaucugcccgccucagccucccaaagugcugggauuacaggugugagccaccgcgcccggccaacaucagauuuauuuuaaaagaagcuuugcuuuuuauuaucaaaggugucacaaauaccuaaccuccuuuguugucugcccuucuuucuuuuuaucucagaggaaaucucagucugcacaaauuucuucauggaaacaucuaagcuaaaaacaguccucuuagcugucucuaacuccuagcuacaaaguugucacuaugauuuuaacuauuuuuuuuuuuuuugagauggagucuugcucuguagcucaggcuggaguacaguggcaccugaucucagcucacugcaaccuccgccucccggauucaagcgauucuccugccuuagccuccugaguagcucagcuuacaggugcacgccaucacacccagcuaauuuuuguguuuuuaguagagauaggguuucccuauguuggccaggcuggucuccaucuccugacuccuugaucugcccgccuuggccucccaaagcgcugggauuacaggugugagccaccacacccagcuucauuuuaacuuucaaaaacaacuuacaaacuuauauuaacaaaucaguaacuauuaguaaacuuaacuggaagaauaaacugccaaguauauaauuauuuagaaauaaaguaacauuucucaaaagcuguuaccaaauaaaugucacuuucacugaacucugcauuaggaaucaggcuauaagaaguccuuuauauaaagaggacaaaugcuaggcuaauccuuuucucucugacucgucuucauuaugaaauaauuucaacuuuuucucaaagaaauucauaaaacuauccacaauuuggaaaaugaauugaaauugcaaacaaaaaagauugcugggaaugggugguaucugcccuguuucacuagacuacuuguucuuaaagcuguccagucaaggaauccuaccauuuccucaguaaucuggcuccugcauccaauaaccauuaaaaauacacugcccgguuuaaaugggcagauuaauaacucaacucguaucaugaauuuuaacaaaagucuuaaauaggccuccagucuaucuuauaggcuauaaagcagaagccaggcagaaaaguucuucucacagcacaaccugcuuuaacagguuuuuguuuugauguuuauuugcuuguuugguuuuucugucacccaggcuggagugcaguggcacaaucuucucauugcaaccuccaacuccuggguucaagcaauucugccucagcuuccuggguagcugggauuacaggcacccgccaucgcaccuggcuaacuuuuguauuuuauuuuaguagagacgggguuucaccacauuggccaggcuggccucgaacuccugaccucaagugauccacccgccucagccucgcaaagugcugggauuacaggcaugagccacugcacccggccugcuuguuuaaacuauucuuuauuaucaagaugacccugcuguugguugaaggaaauggccaaaaauuaaaaggagggaacuaacuaaaacacuaagaaaguguuauaguguaaccaauacaagcugguuaagaauugucuuucuguguuaaaauagaguuguauuuuacacacugugaauaaccacaauaaccauguacuauucuuuuaaucaggaaaaggguuauuauauacauguacacaauguugcggaacaugaacaauuccuacagcaagcaauaacugcagucuuuuaauauagccugugucauacuauaaaaagaaauuccaacacaauauauauaugugcuauccauuaaaauaaauaaacuauuaaaugcuauacuguaacuuacucuaacauuaaggccaggcaaauucuaugccauuuaauagggccaaauuuacucaaguccaagucuaugaguauaagcuuguaaaacagacuuacuaaaaauguauuuuccugcuacuuuaugacacuggcgcucuauuuccauagauacacacuagugcauugaggaaaaucacaaguacccaaaaagaagggaaauguaccgaaauuauucaaauaccuuacaauauucauuuuacuacuuacuaaagaacuucuuuaggaguuguaaaaaaccuguauuuacucaaccucagccuauagaaagaacaacaguucugcuuccuuccccuugaguaugggagaauacucuuacagaccccuaugaaguuaaagcaacacuuccauuaucuucuuaaaccguaacugcuauuagaacaaaucccuuaaaaagaagauagcgacugcucauauuaaauugaaauaauaauuucccuucuuuuaaaugcagcaugccuauaugcugcauucugaagucaauguggucuuuaucugcaaagacucaaacauauucuaauucuguauguuuccuuauucucuaaaauuuagaagucuuaucauaaauacaugauuuaguaacugacacccacauauaaucaaauuuaaacucaugccauaauugugaaaucaccuguaaaauuuauaaucuuuuguacaaauuuuaaacgugguucauaagucucauagcuuauauauccugaucaauuguaauguucaaaaaacuaauguauaaguggcaauuucaaagguagaaaaaacaaguuuguaaggacuaaugugauuuaacauuauguucuaaucuucuggaguuauacaguauuuaugaaucuugguaagucagaugauaggguccugguuucaaggaaagaucacaacuuuucuucuacauaucagucaggccuagucacuccaucuuuggugaaagucaugggacaguaaggauuauauauaacuauauauauaaguaacuuaaaaggagggaagggaaaccauauuucccuuuaguauucuccucucaacuuuucuucaguguauacaaucuuucccucaucuaguuguuacuauuuuuuucaccuccaugccugucuugcuaaauuugugaggacauaugaacaaauagcaaucaguuuuaauucauuagcacgugaauacacaucuuuuaguuaucuaaugggugagcacccacugauacuaucaaagaaaguuuucugccagucaaguucuaggaaacuacuaugcugauuauugaugacauuucacacuucuuauaauacacaugcuacaucguagguuagaguuugguugauuuacaaaauuaagcccacagacaaaguguuuuccaaaccacacaucccuaaauauuuaaaucccuggacauucuuucagaucucaagguucuauauuccauuuaaugagugguacaaaguauaagccucuaugacagaucuguaaaauuaguuaugcgcuguggguauaauuacuugcacugcuccuuuucaaaaucuugcccucuacuuauauugagcagaucaacauccuucagugaaagaaccucaaauauaaaaauuugagauuuuaauuuuuuuuaaguuuacaaauucuuugcuuaaauggaaggggagaggagaacaacugaaagcauuaaaaucagauaaaugauaguacuuaaauuuaggaaaauagauuaaacccaagacucucuuagguuaacacuaucccuacuauaagaaagaaagcuuuacccuuauguaaggucaauuugaugauauauggaauuaaauugcuaaagacgcugaauaagcaaaaugcuaugacaucucucacauuuaucuuaaaacuucauacacaaaaaaauuuuaagcccaauuuaaaaguucuguguuuuuuuuuguuuuguuuuugagacgagucucgcucuauugccaggcuggagugcaguggccgaccucggcucacugcaaccuccgccucccggguucaagugauucucugccucacccucccgaguagcugggacuacagacgcgcgccaccacgcccagcuaauuuuuguauuuuuaguagagacuguauuucaccauauuggccaggauggucuccaucucuugaccuugugauccgcccgccucagccucccaaagcgcugggauuacaggcgugagccaccgggccggccuuguuuuguuuuuaaacaagccagucacaggccuggguuuugauagucaucaucccuaucauucucagauuucagaaaaggacccucccccuauuucuucuauuuuuaacaaaaaaucuauacacacaaaucuuuuaauuccaaauugauacagauaaauuuguuugccuuuuuuuuuuucgagacagagucuugcucugucgcccaggcuggagugcagugaugcgaucucggcucacugcaaccucugccucccggguuuaagcaauucucccaccucagccuccuaaguagcuaggauuacaggcaugugccaccccgcagggccuguaggagucucucaaaaauacuccagcuacucaagaagccagaagaaauccugaaaaggaggcaauaagaagcgguauuuuuccucuucaacuguagaaaacauaaauaacucuggaauuacaagauaggucccuaacaauaaagaaucauuaaccuccaugaucaacacugggaugcuguaugaaaauugcacauuuuuauaaaguacaguucuuaaaauuuuagggguagagguguaaaauguuaagaaaagauuuccauuccccuuaauuucuaugaagggcauuaacauuuuuugagcucaaaauccgaauuuuaguugaagcuguauugaggcaaacaacucauuacuuuuaucaagacaugcaaagccaccgcuuaagugcuaccuucacucccagcuccaaaggacaucuccacuuaaaauugcuuuuauggaccuacguauuuacuuauuuuugagacaagagucucauucuguugccuagacuggagugucguggcgcaauuccgccucccagguucaaguaauucuccugccucagccuccuaaguagcugugaucacaggcgcacgccaccacgcccggcuaauuuuguauuuuuaguagagacaggguuucaccacguugggcaggcuagucucgaacuccuaaccucaaguaauccacccgccucagccucccaaaaauuguuggauuacaggcgugagccacugcgcccggccagaaacgauuuuaaaaagggcaucuccagacaagcuucucgcauuguucuaauucuuuaaccaauuacaaauaaagacaauuaucucauccuauaaaaacuaaaagacgaaaaauaaaaagauacaacaggugagccuacaagcacuaguugauuuacacuaaaauacacuuggguaccacuugugaaaaaaauauuuccuaugaccacaaagggccguaagagggcccuuuauuucuauuaaauaaaucuuuaaugccuacauauacuuuagcuuaaaagugggugggaaucuuuuuuuuuuuuuuugagacgggagucucacugucacccaggcugguaggugggaaucuuaacauguuacuuucuuaggagggaaaagugacaauugucggcaacuuacuccuuuccuagacuugaugauaaauuaaaaaaagaaaaaaagcaagcaaacaaggucccuccaguaguccucuucacuccccacaaaccaaaccaaacaucaaucccccaauuuuuuaacaaugaaaguuaauugaaggaauguaugaauggacagcaaaauuucuaucgauaauuacucaacauuuucaaaacaagaagcauuuuacaacuacuaucauauauguuuaucgcaugauuuuagaaaguucuguuggggccaucaauacaccauccuaaaaaauaagcagguucaauuuucauuuguuuccaugcuccaaacuuuguaaaaaaaaauuccaaucaaaagaauuaaaggcaaauuuuuuagucuaccggguaacuauuauagucuauugcuuuaaaucuuuccucaaagagaacuaaagccuaaacugaccuucugauuugacuuuuugguucuagauguuuauaucaugaacuccccaaaaggacaaaauucgcccuucagcacacacaccucagguguuuuuaugugcuuccccuagugacuagaauaaacaucuacacaacagcccggaacguguugcauggggcuuuuguuuucuuuccaggguuucacacgaacucacuucuacuaacucacuucuacaauucccuauguaggguaaacuuuggaaaugaaacucacugacaaacguuccaguacauuuaagcuggggauaucguauucuuugugauguuuguauuucuccgaccccaaauauauuaauaaaaacuuuuuucugagcccucuucggugggggauagagugagaagagaaaugggagagggccuguuaauuuucaggucaucuuuuaaguuacagaacaguauauacugacuaguuaucuuaaaaauacugagccaaugaauucguucagcuauguaagauuaaagaaagacagauuuuuuuuuuuuuaccguaaaaaccuguaaaggaguggucaguuuuuagaugaaaggucauaggaagaagagcauuaaaaguugagauauaaagaagagaaaaaacccaacaucgaggaauuagaaaaauaaggcgugacagcauuuccacauucauuucgaagugaaaggaaagucgaagggacauuaagggaaaagggcuccuugcguaguuuccccucacagcucucgucuuaagaacgcuuaagggucggugcggucguugacuaaccacuucauuaggcucgucccaccuucaaccucaaggcuuucgccuuuuuagacgcaacgccgccgguuccaacagagacgcggccgcucacugaaauagagagccaaggagacacaggccccagcuagucccacgccagcuucuccccgcccggaaagcagccccgcgcacuuucgaucccgagacccucuacgaugcucggggucgccagaaaugccaccgcaggaagcaccuaccacuauccggacggaggggagcucccugccgccuccucccgcccaaccgcgacggggacccacaccucggagcagacauaaggaagccucagggguggggagaagggaggaagcaaugcgggggcggggagggaagaggacccagaaguccagguaucagucagccuccaaaaaagggggagggguguuauccgugguguuuggggaaggaguggaacccagaagccaucuugggaugggaggaaucaaucgcgauggcuccagagguugcuccucgcgggacuacccgcaaccccgcccgaccgcgcuuguucccgugaaaccccgagcauugggccgccgccuagacggcucccgcggcuuuguacucacucugcccucgaaguuguuuuccuccacaucacucaugucgacgaggcgcuccccagaacuaaauaagagacaagucucggcucgagggccgauggccuaauuaacccgcugacuggaccguggggaagaggaaagagucggcaaccacagccgcuccacuccacucccacucggucgcaggcuccagcaaaauggcgccggcgccgccagaaaucuccuggccuccucagagcacgacguaaagggggc

SEQ ID NO: 191612 - RNA, 47330 nt, Homo sapiens
agggaggcggagcggaagccgagugcgagggacgagcggaguaaaaucuccacaagcugggaacaaaccucgucccaacucccacccaccggcguuucuccagcucgaucuggaggcugcuucgccagugugggacgcagcugacgcccgcuuauuagcucucgcugcgucgccccggcucagaagcuccguggcggcggcgaccgugacgagaagcccacggccagguaaugaguaaggggcgaguccgccagccgggcccgcaccucucgcgcgccccucagccuagccggccgcuccucccccgccgcgcccccguccccgguccccgccccgcuagggccgcugcugcggaaacccggcuuaggaacgggccggcagccuccggccgcggccgggaaggcucuuugucccuuccuuugggccgcgucucugccccuccgcgucugacagccgcggcgccucggcucgggcggagagccgagcguggcuggggcugcgcgagucgagcggggcgggcuugguccggagcugcgggauguagaucccgggcggcaccgcacucacuucuuuuucuguuuuugacagcucaguucucuucuacuuugggagagagagaaagucagaugccccuuuuaaacucccucuucaaaacucaucuccugggugacugguaaggaugaacuuaaacugccguguugauuguugacugugacgguaaugagaauggcucagccagcuaggguucgaauccugccuggguuucucucacugccugccuuggugaucuugguuacuuaaaggcucuaagcuugaguuuucucauccaucaaaacacacaccuguaagugguuagaauuaggaauauagaccuauaacgucauuaguucuucauuugaugaaaagauccuuugugauacuuucauuagcuaugacugaagugaccgaaguggccucuggacuugaguuuugugcuuuuguuuguuuaaucauccuggguuguguguucuucacuuuaucuuaaaccuaaccaaaggauucauuaaaauaugccgucuuccuaauuuuugcuguuuuaagauggcugagaauguucuuaggaaauugaugacucugcuuuucuguggaucagcuucagagguacaaguauucaccucuccccucccccucagguguguccuuugggaauccuuagaggcgcuaaguguuuguuucgucagaguaggcauccagguauuuuacaguccugccucugggcuucaccauauuuaaccugggucaacuuuuuucuacaucugucugcaucuucucacugauuaauaauuucucacucuaaaauguguugcaaaaauacuuguuuugaggaaaauguuucuauguugguguuauuuagugcaguguaggacagagaguaauggcuacggaaauaggaguccuuaguuuuguccuugcucugucacuaucuguguaaccugagauuacuuugugguccucaauguccucaucucuaaaauagugaauuggucugauuccaaggacucuucuagcucagacuuucaaugauaaagguuuuuagagguuuuuuuuuaaauguggaaacaaaauuuguguaaacccuuuuagucauuuguguucuuaguguuucuuccugcuucaggucauauaauucuuucaaacuaccuugaaagaaggaauacauuuaagagaacaagaaagcugccagaaauaagaaucucuaccagccaguuaucacucucucaugagcugcacaguuucucugcauuuuugacaugcuuuguucucuuucucccuacucuguaucuuuugcucauagccccuauaccuguugugccugauucuucauaacuuuagcuugucaauccccucauccaacuuuauuauuuauuuucaugacuucuccuucagcuccuucugccaacugccugguuuucccuggggccucuuuguuugaggccagagaugcuagccuaguuggcuuuggaaggggagguggggacauguggcacaaaacaugauuggccacggcugugacaggugaagcucugugauugaaguaucuagugcugcauagugugugucuauguauauguauauauauagguuuuguuguuuuuuuuuuuugagacagagucuuacucugucacccaggcuguagugcaguggugcuggcucacugcaacuucuaccuuuuggguucaagcaauucuuguaccucaugccuggcuaauuuuuguaguuuuaguagagacagggucucaccauguuggucaggcuggucuugaacuucugaccucaagugaucugccuaugucagcuucccaaauggugggauuauaggugugagcccuggagcccggccugcauaguuuauuuuauugcauauuuuaguuuaguuaguuuaguuugagacagccuugcucuuucacucagcuuggagugcaguggugcgaucucugcacacugcauccucuaccucccagguucaagcgauucuuguaccucagccauccaaguaacuggguuuacaggcaugcaccaccaugccuggcuaauuuuuguauuuuuaguagagaugggguuucaccauguugaccagacuggucuugaaugccugaccucaagugauccgcccucuucagccucccaaggugcugggaucacaggcaugagccaccacgccaggccauauuuuaaauuaaacuuuuacuguagcauaaugguuaguuuucuuuuugccuuaacauuuucuguuuuuaucccugccucacuuuaccauuuuucuuuuaucuguuuuuguaauauucagugcuauugucuucuauucugucucccaaaugugccaucuaaaaaugaucugauaucuugacacucauuauuuccguaucuuagcuggaauuuuaguguagcuucucucaaggcagugcauuuuaaaucuuagaccuuauuauggagcgaauggcuguguucuguguuaacccccccccccccaccaccauauuagccucaggcaguguuacauagagaaaauauuuuaggaaugccccuuuuucccugaaauuacauuccggggucaagucuguggaggacuuuuuuuugggucguuuuuggagagaacuauuugaaccucugagcuguggugaacauacugugucuuuuuguaguaaaucuaugccucucuagcugaaauuccuuuggagacuaauaggcaguaguucuucuaguaccuuuggcugagugaaagcuucucugccugcuaguugcugcuauugcuguugauaguuacuuuagcuauaguuauaauggcacaaaauguagagcacugaauagaugcaaaaaugagauuugaaugagagauuuuaagguaugauuagccaucuauuuguguuuuuaauauugcuguugcuauguuugcauaaaauacaaggaaguacuucaugacagaugacagggagugugaaaugcaguauuuuuuaaacuuuuuuguuacaauccguaguaagagaucuuuuuauagcaagacuccauugauggcugaguaugguugugugcaccugcagucaguccuagcuacuagggagguagaggugggagaaucaugugggcccaggaguuugagacuggccugggcaacauaguuagaucucauaucaauaauuaaaaaaaaaaaaaaagacuccauacacguguaacugugugugcauaggcuggacucaguggcucaugccuguaaucccagcgcuuugggaagcugaggcaggaagaucgccugagcucaagaguuugagaccagccugggcaacauagugagaccuugucgcugcuaaaaauaaaauuugucaaguguaguggcacacaccuguagucccagcugcuuaggaggcugaggcaggggcaagggugggggccucuucagucugggagaucaaggcucagugagcuauggccacugcauucuagccugggcaacagagccagaccuuaucucaaacagcaacaacuguguaugcaugcauaugucuguauauguaaaaauaaacuggaaauuuaacaaaacaaaauugguaguguguacggucuacucugaugguuucuauuuuaucuuguguuuugaaaauugcucauugcaaacuguugauuuuguucccugcuuuugaaaaacaguggaguccugugcugaaaguuuggaugccuaacguuucucuguauguuugacuuugaguagucauuaauucucuuugugcuucauuuuccuuaucuuuauaaugaaguuguucuaguuuaaauauuugcugauucuuuguuugauuuaauuaauuaauuaaauuuugagauagagucucugucacccauagcucauugaaaccuggcacuccugggcuuguguaguaguccuccugccucacccuccagaguagcugggacuacaggugcgcaccaccaugcccggcuaauuuuuauuuuuuuuuuguagugacugcgucuugcaguguugcccaggauggucuuguacuucuggcuucaagaaguccucccaccucaaccuuguaaagugcugggauuacaagugugaaccaccaugcccagccuguuuuacuuuucucuggaaauaauguuggacuaaagacaagcacauaucuuuaugucuguggcuagggagaaaccacugaaaaauggcuuaaauauuugguuguuuacauauacauagugugcuguuugucaaguagcauaauggagcuuggaauagcacuuuucuccgaagaucuuguaaaguggaguggacauguuaaugccuguaauaaauauacaaauuuagaaaaaaaauuuauccauguuuuucuacuuuuguguuucuuaacagggaauauuuuggaguuugaaaaauuauauuuaaaaugcuuaauacaaguuuuaaguaaaugcacugacagauugcuaccuagaccuuauuucguaucugaucuugccacugccccuuucagauuagagaacaccaauaagaauauauuuuucuuuguaaacaccaccauaucagaucauuacuauuccuguauauuaccaaauaguggaacugccauuuucuuaagacaggggaacacaaagcuuucuuugcuuguggguuuccuucuguucaguuuguaugauuucuccagaccaggccauuucaugcugugcuuugggagccuucucauucucauuuguuuguacugaggaaaauaggaauaaggaauuuguugacugcucccgagauucugguaaaagaagaauucuaaagguuuuguuggaaggaaauuggaaccagacuuuguacuuccuccucuuucugaaaucagauauuacccccucauuauucuuugaccucacaccucaggcagauguuccaagacacaucaccauuuuuuuuuuuucuucauagcaguuuaucacaaacugagauaacuuguuuguuugcuuguuuguugucccguuccuauuaaaauaguauccagaaaaacaggaauccugucuuucauaucuugcuuuaccuuucacaucuaugguuccuggcacaugguagguacuuugcuauugugaaugaauuagugaacaaaugaaugaguaaaccaaguucuuucaugccuuaaauagaacugcauguaguaaagguuguguuugagccuaggccuuuaugcacugccccccacccuccaccuccaauucuuuuuucuggaaguguguuaucacuauguuuacugaucauggugaaggucucuaccuuuagaagacuuuguguuuaucuuuguuuuacuucauauguuuuuaucuucuaguuuuuugccuguauaaaaacuaacauauaagacuuccgaaauccuucuuguagcaacuuuauaauacuuugauuuaugugaauacaguuuacuugaaacuuuaagagccagcuuaauaauuuagugaauaguucaaauuaggcaucuucaggaucauuguccuaaacugccauuacuauuuucugguuacauucuuuuaaagcaaaaaagaacaaaacuucauuuaauacaguuuauuccguauuuacaaacacaaucuuucuaggggaaguaaggaagguagugugguguagagaaaacccuagacagugagucaggaccuguauucuggaccaguaggauuucugccauuaacuggguuucauuuuuaggcaagacacuuaacaucucugggcuucaguuucuuuaucugaaaugcgagggaaauggauuagguuucuucucagguucuuccagucuagaaaaggauaauugaagguacuuuacccccaaauuucuauccucugguccucuaccccaaaacucauugcagagaggucacauugcugcgugggagaaggugggguuagguucagggauguguuuuaaaguaaacauaaggcauuucucagugacggcugauuguucacuaggcucugugggggauguggcagcaguguaaggcuuguuguucuugcccauaagggaccugggacuuaaucagggagacauggcuuacacacaugcuuggaugugugauauauaaaauuaauugguaugaaguaacaugcugugggaguuagaagaagaucagugugggguagaauaagguaaggagguuuugaaaucauucuauccgagguaagauuuaaacagguauuuuaccucgucuccuuucagacuacuuggaagaugaacuguucucaucagcaacaugcuauuaugucaucuuuuaggacuagguaaugcuccagugacuuaauaccaaugacauuuucauguuguccacaaauucugaguagaaaccuuuucaagccuguagccucucugagagcugacuguuauuaacugaaugagaggaugucagcaaacagguaagacacaugcuggguaaauaaaauuaucauauaaauguaagauauaauuauuacuauuguaugaagcagagagaagacuggcuggauuggaggagauauuuuugugacuaaugagaaauaaacuuggucuuuggagacuggguuguggaggcccaugagagcuaaucaggaguuuuauuugagucuguuaagacauuuccuguauuaccuaauguuacucagauuaccaagaauuaguagcauuguugcauaaaugccugacacuaaugauaaagauuaauauuuauugaguaguaugucaguuauucuuuaccaguauuaaauagguauuguuguccccauuauauaagugaggauaucaggccuuagggagauaaaauaacuuuuacaagguuuuaaagauauacuauaauuucauauagaaaaugauagggccaggugcgguggcucacaccuguaaucccagcacuuugggaggcugaggcggguggaucacaaggucaggagaucgagaccauccuggcuaacauggugaaaccccgucucuacuaaaaaaauacaaaaaauuagccgggugugguggcgggcgccuguagucccagcuacuugggacgcugaggcaggagaauggugugaacccaggagguggagcuugcagugagccgagauugagccacugcacuccagccugggcgacagagcaagacuucgucucaaaaaaaaaaaaaaaaagaaaaugauagagaguaccuuguggcuagagugggauaggaauuggagugcaacuuuuugaaaacauuuugaagcgaugacauuugaacuaaguacuaaaggaugaaaaggaacagguuguagggaaaguacuccaagcuagggaauagcaauuguauagacccugaggucagaaagaauuuaauguguuuucccuagcauggguuuagcauggugagcaagagggaagugguaugagauuaggacaaagagaaauggguagaagucagauuauguagggcuuguggauugcauguuguaaagguugguacugaguuugcauguuagauucuaagugcagugugaaacuguugaaagguuuuuaagcaggagaaugugauaugcuugugugugugugugugugugugugugugugugugugugugugugguaaaaaaauacauaaucuaaaauuuaucauuuuaacauuuaaguguacaguucagugacauuaaguacguucacaucaucaugcaaccaucacuaccauccaucuccagagcuucuucaucaucuccaucugaaacucuguacccauuaaaucauaacuuuccauucucuucuuccaugugguagcauguaucagaacaucuuacuuccuuagggcugaauaauauuccauuguauguagauaccacauuuuauuuaucuguuuaucuguugauggacacuuggguuguuuccaccuuuuggcuguuaugaauaaugcugcaaugaacacuggcauacacauaucccuuuggguuucugcuuucauuucuuuuguguauauauccagaaguucaauuacagauuguaugauaauccuauguuuaaguuuuugaggaaaugccauacugucuuccccagcagccacaccauuuuaugugcccaccagcagagcagaagaguuucgauuuguucacauccuugccaacacuuguuuucuguuuuuuuuugugugugugugugugugauaacuauccuaauggguaugaagugguauuucauagugguuuuauuuauuuauuuauuuauguuuuugagaccgagucuugcucugucgcccaggcuggagugcagucgcgugaucucugcuuacugcaagcuccgccuccuggguucacgccauucuccugccucagccucccaaguagcugggacuacaggugcccgccaccacacccagcuaauuuuuuguauuuuuaguagagacgggguuucaucauguuagccaggauggucucgaucuccugaccucgugaucugccugccuuggccucccaaagugcugggauuacaggugugagccacugugccuggccucauagugguuuuaauauacauuucccuaugauuaaugagguugagcauuuuuuuuuauuggcaaaaugucuucgaauuaugaguuuuguuuuuggaagaauauuugacugcucugagaagaauggauugaaguaggguuggagaggagucuggcaaaccacuugacaagcagcuauaggaauccacuuggagguggugauaguuggaucacacucuguugcccuucuucaggucuaguacuuuacugauacuucauuuuaaguguguccccucuccuuaguuauucuacuuuugugccauauagacuaauuacuuuugugacuucugcaguugguugagcacuuucuccugggaaucuuaaaaauauucaagguuuaucuuaggccaaaauaacaaugaugaugauuauuuuauuuuuugccuuuaaaacuccagaccaggcacaguggcucacaccugccaucccuuuggaaaggcugaggcaggaggaucacgugaggccaggugaucacgugaugaggcaggaggaucacgugagaccagacugggcaacguaaugagaccccucuaaaaaaaaaaaaguacaaaaauuagcuaggccugguggugugcacuuguaguuccaggcuauucagaaagcuaaggugggaggauugcuugagcccggaaggccgaggcugcagugagcugagaucgugcuacuguacugcaagccggggcaacagagcgagacccugucucaaaagcaaaaaacaaaaaacaacucucuaguuguuaauuuggugaauuucaaguuuuguguuuuuuuuaagugauuaauagaaaauuaauauaguggccuagaaauuaagauuuaaaaguuuuuagauuguagacuguuuugauggaagaaguacuccaauaagaacuaugccagaugguagccauaagcccuuggccucaauguuggccuaucagguuucugcuuagugacucuguccuuaucuaaguggccuucugggggcuggaucaguacuugaaacauaaagaaaaauugaggagguucaaagugcaaguucuucuguuauuugcagcuuugaacauugcacagaaagaaaggacauugaaucuuuccuuuccuuuuuuuucuuuccuaaggauggaggcuaauaaucauuuuccuuucuaaucacuaaauuaaaaguacauaaguaaauaccuucaguugcuaaagaagucaaaacuucuuaucuuuuuuuauuuuucuuaugugaaaucacagacaguucucugagaauagaacagugaguguauucauauuggccccggagaauaaaguaauaccaguggaaauuguuuccucuucacuuuacuucuacuuuugccuuauaaauacagggccuagccuacccuggggguaacgacucagguuccagcagaggucaccuauuuucaauccccuucaccccuuccccuucaaggucgucauggugucaucugaagaaugacaagguucauaaauuuggaaaggagagcuuuauuucuuauaaaggguugcaaccugcacgguggucuuucugacaggcugggaagcauagccuccguccagaagccagaaacagacacuuggagagagggacaaagggaacaggaauuuaugcugagcaggguggccgaauauacauauuuaauaaguuuaaggcgucaugaauauuuaugaaaggagaaacgugcaugcacaauugagcuucauacccauuccuagguccugcauauaaaaaaauuguggcguuagcaugauuccaggguggaguuuucagcccucugaugucaaaaggugaagcggaggacacgaaaacccuuacugugcauccucuguagacuggccagaacuacucuguggcugguggucucuuaucaggaagaaaugcuuguagguuguuucguuggaacugcagaauggagaggcagcagucaggcaguugguugagaucagugguggagucuuuugaaaggccugguuucuguuuagcccaagcuuguucaaccugcaacccaugggcugcaugggacggcuuugaauguggcccaacacaaauucauaaacuuucuuaaaacacuaugauuuuuuuugugauuuuuaauuuuuaauuuuuuuuagcucaucagcugucguuaguguuaguauauuuuauguguggucagaacgauucuucuuccaguguggcccagggaagccaagagauuggacaccccuaaguuagcccuuagagaauaaugccuaauggcaugaugauaauggcaguugucaagggagggaaguauaaugaaguguaucugacugcccauccuguuagaacugccuaauggugguucuaauggguucuccuugcccgaugccuagacagaaccaauuuaucaagaugggaauugcaauagagaaagaguuuaauucaugcagagccagcuguaugggaaaccagaauuuuauuauuacucaaacccaucuuacugaaaacucagggauugggguuuuuaaggauaauuugguagguagggggccagaagguggggagugcugauuguucagguuggaggcaaaaucauagaaucaugacucuucaaagcuguccucuugcaccgagucacuuccuaggugggagccacaagaccagaugagccaguucguugaucuggguggugucagcugauccaucuaguucaggguuugcagaauaucucaagcauugaucuucaguuugacaauaaugguauuaccuccaggaacaauuuggggagguuccaaauuuugcagccuccagcugugugacuucuaaaccuuaauuucuaauuuuuuuuuuuugggauggaguuucacucuuguugcccaggcuggagugcaauguugcaaucucagcucacugcaacuucugccuccuggguucaagugauucuccugccucagccucccuaguagcugggauuacaagcaugcgccaccacguccggcuaauuuuguauuuuuaguagagaugggcuuucaccauuuuggugaacuccugaccucaggugauccaccaaccucggccucccaaagugcugggauuacaggugugagccaccaugccuggacaauuucuaauuuuguagcuaauuuauuaguccugcaaagguacucuaguccccagacaggagggggguuuugggaaagguaaacuaaaaacuaaguuaaacuauaagcugaguuccugccagugcuguggcuuaugccucuaaucccagcacuuugggaggcugaggcagguggauagcuugaguucaggaguucgagacuagccuggcaacauggcaaaagcccuucucuacaaaaaaaaauuagccaggugugguggugcaugccuguggucccagcuacucgggaggcugaggccagaggauagcuugagccugggagguggaggcugcagugagcugagauugcaccacuguacuccagccugagugacagagcgagacccugucuuaaaaaauaaauaaauaaauacaauuuuaaaaaaguucuuaaggauuauuuucaguaagcugugaaauaucuuugugaaaugcacuguucugacucgagauacauuucuaucuaaagaauuuugcuccauuugauguagucaaagaguuuuuuuuacuggacacuggugauucacaccuuuuuuacucuccugguuuuucuagauucugugauuaacaccuuucuguguuuuaaaaacuugaaguauaaccuuuuaauuuuuucuuaaauuacauaaaugcauaccuuucucauuuaaaauuuggaauuguaaauuuggaaauauagaaaaauguuccaaccuguuuguuuguuuauuuauuuguuuuugagacaaggucuugcucugucacccaggcuggaguacaguggaaugaucauggcucacuguacccuuaaccucucaggcucaagcagcccugccgccccaccuuccuggguagcugggacuacaggcgcaugccaccaugccuggcuaauuuuuaaaauuuuuguauagagaugaggucuuccuauguugaucagacuggucucaaacuccugggcucuagggauacucccaccuuugccucccaaaguguugggcuuacaaguguaagccacugccccuggucucaaguguuuuaguacuugccguuaaaugaucaucauucuuuaugucuggcauauuuuuguaugauauaaacuuagaaauuauaacuuauuuuuuaucuuagauugcaucuuggauuggaugcuuccuaagguuaccuuaugcccauuaguaauaauuucuggugacauuuucaaauguuggcacacucuguuuauauugugggaauucuuuuuagacaggcauuuugauuuuccgauccuuuuucuuuccuucuuccuaacuuucauuuugauguuuuuucuuuuuuuuuugaggaagaauagcuuuuaggcauuuagguuggugacacguauuugaauagacugagaucuccuauauaucucauuauaauauccaugguuuuaguuacaaaugagaaacaauuugaagaguuuuaugaccaugguugcauuuuuucaguuauuuucaaugaauugacauuuguuucuaguuuaaacuuugaaaagauacguaagugagacugauaaaagacuagaaagcuuacuuagugguggagaaaguugucaaauauaugacacaguuccaaauaaaaauuauagaauauuuucuuuauagucgucuguucuguuacugauacagauuaagacuaauacuguuuuucuucuuaauuuuacagaguuaauagaguggauacaaccuugcugaagaugaagaauauacaauauugaggauauuuuuuucuuuuuuuuuucaagucuugauuuguggcuuaccucaaguuaccauuuuucagucaagucuguuuguuugcuucuucagaaauguuuuuuacaaucucaagaaaaaauaugucccagaaauugaguuuacuguugcuuguauuuggacucauuuggggauugauguuacugcacuauacuuuucaacaaccaagacaucaaagcagugucaaguuacgugagcaaauacuagacuuaagcaaaagauauguuaaagcucuagcagaggaaaauaagaacacaguggaugucgagaacggugcuucuauggcaggauaugguaagauaaccguagaauauuucuaguuuccuccaaucccuguuuaaagaugguuuuggaaauugaacuuauuacuucaugcauaggucuuugcaaaguaauuuuuucuugacuuuuuauuaugaaaauuucaaauguacugaaaaauagagauacuaugauaaauacguacauauucaucauccagacuuaacaguuauuaacauuuggcaacauuuguuuuaucuaauuguugaagaauauuuaaacuauagaaauuaugacauuucgcugcuagauauauaucgcugaaaaaaauguauguuggaggccgggcgugauggcucacgccuguaaucccagcacuuugggaggccgaggcggauggaucacgaggucaggaaaucgagaccauccuggcuaacacgguaaaaccccgucucuacugaaaauacaaaaacaaauuagccagacaugguggcacgugcuuguagucccagcuacuugggagguugaggcaggagaaucauuugaaccugggaggcggagguugcagugagcugagaucgcgccgcugcacuccauccugggugguagagcaagacuccgucucaaaaaaaaaaaaaaaaaaaauguaucuugggcugguguugauggcucacaucuguaaucuuaguacuuuggggggccaaggugggaagauugcuggagcccaggaguuugagacuagccuaguagccuaggcaacauagugagaccgcuacuaaaaauacaaacaaaaaaucagcugggcgugguggcaggugccuguaaucccagcuacucgggagacugaggcaggaugaggcaggagaaucgcuugaacccaggagguggagguuguggugagucgagauugugccacugaauucuagcuugggugacagaguuagacuccaucucaaaaaaaaaaaaaaaaaaaaaaaaaaacaaagaaaaaagaaaaaaaaaauuagccaggcauggugauacacaccuguagucuuagcuagucgggaggcugaggugggaagauggcuugagcccaagaggucaaggauacagugagccaugucugcaccacuguacuccagccuaggcaagagagugagaccucaucucuuaagaaaagucuaaaaaaaugaccuucuuggacauaauacaauaccauuaucacaccuaguuuauauuuaaauuuuccugauuauccuaauauaagccaucaauuguauagcauuuauuauuuccuaagaagcagguuuugccuauauaucuccaguauuguuuauugcuguucucccuuucacauuacuggguccuguuguguuuuaaguuucuuaucaugacauguucuuucuuuccuuuaagacuuaaaaaggagagagaacagauaguaugguucugucuggaacaauguauauacaugaauguguggacauuuucucuauuucaguuuuguuuguuuaauuaaaaguuauggcugggcacaguggcucacaucuguaaccccagcauuuugggaggcugagguagguggauugcuugaguccaggaguuugagaccagccugggcaacauagugaaaccauuucucuacagaaaauacaaaaguuaguggggcgugguggcgcgcacuuguaguuccagcuacuugggagguucaggugggacaacugcuugagccugggagguugaggcugcagcaaggugugaucacacgccacugcacuuaagccugggugacagagugagacccugucucaaaaaaaaaaagugguacaugcauguauuuaaauaaucaaaguguguuaugauuccuguaaugaaaaagggcaguuuuuucuacucccaaaaguccucaaauuuccuguucuuuagagccacccauuuuaaauucuuucaucucauuuuuuuggugauuauuucugcaucuaaauaauaugcucugugagcuccuuuccgauuuuucaguuauagguguuaucuguuaacuucucauuaagcaaggugagaguuuagcuuucuuucucacuuaaaaaugcauuccauccaccccccaggcuguugucacauccauauccuucuuauccuuucauuuucccuucauaauuuuguuuagaauaauauucaguauuuauacuauuaugaccauguugaugguauucauuauugagccauauaaaggcauaccucagagauacuguggauucuguuccaaaccacacaauaaagugaaugucacaauaagcaagucacacagaucuuuugguuucccagugcauauaaaaguuaaguuuacacuauacuguaaucucuuaagugugcaguagcauuaugucuuaaaaaacaauguacauaccuuaauugaaaauacuuuauugcuaaaauaugccaaaaaucaucugagccuucagcaagucauaauccuuuugcugguggaggaucuugccuugaugucaaagguuacugacugaucaguguggugguuacugaagguugggguggcuguggcaauuucauaaaaugagacaauaaugaaguuugccacauugauggacucuucaugaaagauuuuuuuuguagcauggauuauuugauaggauuuuaccuacgguagaacuucuuucaaaauuggagucaguccacacaaauccuacugcugccuugucaauaaaguuuacauaauauucuaaauccuuuguugucauuucaacaguguccacaacaucuucaccaguagauuccaucucaaaaaacuacuuucuuugcucuuccguaagagcagcuccucaucuguucaagucuuaucaugagauugcagcaauucagucucguuuucaggcucuacuucucauucugcaguuacuucuuccacugaagucuugaaccccucaaagucauccaugaggguuggaaucaccuucuaauucauucauucauucuuauaaauguugacauuuuuaccuccuuucaugaaucaugaauauuauuaauggcaucuagaauagugaauccuuuccagaaggcuuucaguuuacuuugucuagacccaucagcucuggccuuauggaauguauuucuuaaauaauaagacuuaaaaguccaaaugacuccuuuaucgaugggcaggagaauggauguuguguuagcagccaugaaaacaugaaucuccuuguacaucuucagagcuguugggugacugggcacauugucaaggagcaguaauauuuugaaaggaauuguuuuuucugaacagugggucucaacaguaggucuuagugggcuuaaaauguucaguaacucauucuguaaacauauguugucacccaggcuuucuuguuccauuuauagagcacaggcagaauagauucagcauaauucauaagggcucuaggauuuucagcaugauaaaugagcauugguuucaacuuuaagucaccagaugcauuacccccuaagaagaaagucagccugucauuugaagcuuugaagucaggcauugacuucucacuagcuaugaaaauccuagauggcaucuucuuccuagagaagaauguuuugucuacacugaaaauuuguuacuuaguauagccaccuucaucaaugaucuuagcuaggucuucuagauaacuugcugcagguucuccauuagcacuugcugcuucaccuugcacuugaaucuuauggaaauggcuuuuuccuuaaaccucaaaagcaaccucugcuagcuuccaacucuucuucugcagguuccuaaccucucuuagccuucauagaauugaagagaguuggggucuugcucuggauuaggcuuuggcuuaagagaauguuguggcugguuugauguuuuauccagaccacucaaacuuucuucauuucagcaguaaagcuguuuuucuuucuuauuguucauguguucccuggaguagcacuuuuaauucucuucaagaacuuuuccuuugcagucacaacuuggcuguuuggcacaaggccuagcuuucagccuaucucagcuuucaacaugccuuccucacuaaauuuaaucauuucuggcuuuuaguuuaaagugagagaagagggacucuuccuuacacuugaacacuuagaagccauuguaggguuauuaauuggccuaauuucaauauuguuaugucuaagggaauagggaggccugaagagagggagagagacagaggaaaggccauuggaugcagcagucagaacacauguaacauuuaugaauuaagucugcugucuuauauagauagaauucaaggugucccaaaacaguuccaaugguagcaucagcaauugcugaucagcucaccauggcagauacaagaauaaugaaaaagucugaaauaugaugagaauuacccaaaugugacagagacacaaagugagcagauauuguuagaaagauggcaccaauagacuugcuccaugcagaguugcugcaaacauucaauuguaaaaacacaauaucuguaaagugaagugcaauaaaacaauguauuccucuauuacauuaugguuacuuuccuauaaacuuuuucacccuagaguuuaauaaguaucgauuuuugcuucuuugccuaguuuucuacugcaucccccuacaguuguuuaaauauucuccuagcauauucagacacauuagguauuuuagcacuuucuuuauauugaagaaaucuuuccugaugccuuccagucaucucuggccuggacuguuugcucucuaggauugcagcagugaauuguuuuaagaucacaauuugucaucaucuuguagauuucuuuuacuccucuauuauauuggaucuccuauuuucuagaauuuuuaagcuuccucuuuauugguuauccccugauuuuaagggaacagaucuucugguagguuccugagaaagaugcagauagguaaaaguuuugaauucuuguauaucuugaaaagaucuuuuuccccucaacccucaugcuucauuguaaguuuggcuggguguagaaauaauuuuccuugagauggaaauaauuuuccuugagauuuuaaaggcucugcucuguucuguuuuacuccucaucccccuagguuccaguguucuuuuugagaagcugaugcucuucuuuauccuuuuuaugugacuuaauuuuuggaaucuuguaaggucugugucccacaccauucuaaaauuucucagugaugugacuggguaugggucucuuucguacauguguugggcccucagugggacauccugcaauuuaugucauucaauucugggauauuuucuuaauuuauuaauuugauuucuauguuuuucauucacucuuucuggcauucuguuaauuccagcauuugggcucucuggacuguuguccuccaguuuucccuuauuuauuuuccauuucugucuuuuuacuucauuuuuugagacgauuuccuuagcuuaauuuccagaucuuuacggaguuuuuaaucucaucuaauauuuuuaauuucuaagagcuaucuuuugggcugggcgcgguggcucaccccuguaauccuagcacuuugggaggcugggcaggugggucacuugacguuaggaguucgagaccagccuggccgacauggugaaaccccaucucuacuaaaaauacgaaaauuaucuggacgugguggcacacaccuguaauccuagcuacucgggaggcugaggcaggagaaucacuugaauccaggagacggagguugcagugagccaagauugcaccacugcucucuaaucuggggaacagagugagaugcugucuccaaaaaaaaaaaaaaaaaaaaaaaaaagaaaaggaaaaaaaaagcugucuuuuguuacaucucugagguuaucaaugguagcuuuucugaagcguuuuuauguuucuuccaaauauaucuggugauccuuauucuuugucuguauuugagaaaugaggcacuaaaagguugauggcaaaugcugagcuuuugugugguauucacuauaggaugaucuggcugggacauuucuuuggguauauccuuaauauuuauaaugacuucucauaccaacuaccugcaguuaagccugcaguaagggcacagugcuccacaagacugcccucacuucagacaccagccacuaguuaggguauucccaggccacuuucacuucugaucaaguggcuacaaauuuguggguuauuaccuccuuauguuugacaauucacuagauugaccuguaaaacucacugaaaaguacugugcgucacuuuugauauaaauacuuuauuuucaaucuguaauugaauuuguggaugcagaacccacagauacagagaucuaacuaagggacaugaaaauccauggauuuugguauccgugguggguccuagaaccaauucccuacagauacagagagccaaguauacuuacuauuacaguuuuaguguagaagaaggauagaugcuagagccagccaaagggagauacgcauaggacaaggucugggaggguacgagaugcaguuucuguuguccucucuucauagaaccaggacacauuacccuccuggcauauccaacacacaucagugugugauaauaugcagaauauugccaacuagggaaucucaccugaacuucaauguacaguuguauuggggucucauuauguaggcaugauugaaucauugcccacgugguugaacuuaaucuccaccccuccuccccucccuggaagucagcugaaaauccccaacucucuaaucacaugguuguccuuucugacauggccagcuccccaaccccccauucugggucuucccauuagcacaaaauaucuagagccccacucugaguugccuccuuaagguaaacuaacagauguggucccaggggccuaccaugacuaauaaagacauucgucacucaggaaauuccaggcacuuaguggcuaccucccaacaacuggagacaaagaucagcuaaauuuuuuuuuuuuuuuuuuuuuuuuaaauuugagacagagucuugcucuguuguucaggccggagugcaguggugcaaucuuggcucacugcaacauccaccuccuggguucaagugacucuccugccucagccucccgagaaccugggacuacaggcaugcaccaccgcgcccagcuaauuuuuauguuuuuuaguagagaugagguuuuaccauguucaaggccagguuggccuugaacuccugaccucaugugauccaccugccuccaccucccagagugcugggauuacaggggugagccaccgcgcuuggccuaaauuuuuuauuacacaguaucaauguauuuuauuccuuugagaugaucucuaauaucaguauauuuaggucucuccuguugagcuggucagauacccuggagaagcacuuccugucuguugcuggagaguauaggccuguaaguguucugggaucugagcgagagaaaaaggcugggcaaggaagagugaucucagcacucacuaccuucauuuacucuuccaguuuccaguguaaacccaggcccucaacugcucuauccccuuaagaaaauacaucucagaucuucugcagugggggagguuuuggaguggugcacagaauuuaaggaugaauugcuucauagaaaauaguuaaugcaugcugggcuuaauaccuaccuaggugauggguugacaggugcagcaaaucaccauggcgcagguuuaccuauguaacaaaccugcacaucugaagaaacaggaguguggcgugaccauagggaagcaaaagaacacaaggaaguaugcaaccaugaagcgcaugcuuaaacucagagaucagaggcuuaaagaaaaggauagauuaaaaccuacaaagaaagaagaaaaggaucccagcgcauuaaaggaaagagaaguuccccaacacccuuccugccuauuuuuccaauguaaugcacagcugggcccaccuuacuacauccuuguugauaccaacuuuauuuauuuuuucuuuuuuuuaagaaaaauauauuuuuauuauacuuuaaguucuaggguacacgugcacaaugugcagguuuguuacauauguauauauguaccauguuggugugcugcacccauuaacuugucauuuacauuagguauaucuccuaaugcuaucccuccccccuccccccaccccacaauaggcccuggugugugauguuccccuuccuguguccuaguguucucauuguucaguucucaccuaugagugagaacaugcgguguuugguuuucuguccuugcgauaguuugcugagaaugaugguuuccagcuucauccaugucccuacaaaggacaugaacucauccuuuuuuauggcugcauaguauuccauggugucuaugugccacauuuucuuaauccagucuaucauuguuggauauuuggguugguuccaagucuuugcuauugugaauagugcugcaauaaacauacgugugcgugugucuuuauagcagcaugauuuauaauccuuuggguacauacccaguaaugggaugguugggucaaaugguauuucuaguucuagaucccugaggaaucgccacacugccuuccacaaugguugaacuaguuuacagucccaccaacaguguaaaaguguuccuauuucuccacauccucuccagcaccuguuguuuccugacuuuuuaaugaucgccauucuaacuggcgugagaugguaucucauugugguuuugauuugcauuucucugauggccagugaugaugagcauuuuuucaugugucuguuggcugcauaaaugucuucuuuugagaagugucuguucauauccuucacccacuuguugaugggguuguuuuuuucuuguaaauuuguuugaguucuuuguggauucuggauauuagcccuuugucagaugaguagauugcaaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacaucuaagucuuuaauccaucuugaauuaauuuuuguauaaaguguaaggaagggauccaguuucagcuuucuacauauggcuagccaguuuucccagcaccauuuauuaaauagggaauccuuuccccauugcuuguuuuugucagguuugucaaagaucagguaguuguagaugugugguauuauuucugagggcucuguucuguucuauugguauguaucucuguuuugguaccagucccaugcuguuuugguuacuguagccuuguaguauaguuugaagucagguagugugaugccuccagcuuuguucuuuuggcuuaggacugacuuggcaaugcgggcucuuuuuugguuccauaugaacuuuaaaguaguuuuuuccaauucugugaagaaagucauugguagcuugauggggauggcauucaaucuauaaauuaccuuggccaguauggccauuuucacgauauugauucuuccuauccaugagcauggaauguucuuccauuuguuuguauccucuuuuauuucguugagcagugguuuguaguucuccuugaagagguccuucacaucccuuguaaguuggauuccuaaguauuuuauucucuuugaagcaauugugaaugggaguucacucaugauuuggcucucuguuuguguguuauugguguauaagaaugcuugugauuuuugcacauugauauuguauccugagacuuugcugaaguugcuuaucaccuuaaggagauuuugggcugagaugaugggguuuucuagauauacaaucaugucaucugcaaacagggacaauuggacuuccucuuuuccuaauugaauacucuuuauuucuuucuccugccugauugcccuggccagaacuuccaacacuauguugaauaggaguggugagagaggucaucccugucuugugccaguuuucaaagggaaugcuuccaguuuuugcccauucaguaugauauuggcuguggguuugucauaaauagcucucauuauuuugagauaacguuccaucaguaccuaguuuauugagaguuuuuagcaugaaggccuguugaauuuugucaagggccuuuucugcaucuauugagauaaucaugugguuuuugucuuugguucuguuuauaugcuggauuauguucauugauuuguguauguugaaccaggcuugcaucccagggaugaagcccacuugaucaagguggauaagcuuuuuggugugcugcuggauucgguuugccaguguuuuacugaggauuuuugcauuguuguucaucagggauauuggucuaaaauucucuuuuuuuguugugucucugccaggcuuugguaucaggaugaugcuggccucauaaaaugaauuagggaggauucccccuuuuucaguugauuggaauaguuucagaaggaaugguaccagcuccuccuuguaccucugguagaauucggcugugacuccaucugguccuggacuguuuuugguugguaagcuauuaauuauugccucaauuucagagccuguuauugguguauucagagauucagcuucuuccugguuagucuugggaggguguaugugucaaggaauuuauccauuucuucuagauuuucuaguuuauuuguguagagguguuuauaguauucucuggugguaguuuguauuucugugggaucaguggugaucucuccuuuaucauuuuuuauugcgucuauuugacucuucucugauaccaacuuuaucaacuuuuccuuaaaagcgaaacuggauuuagugcagucaacgauggacugucuguaugccagguguaucccuuguguaacugauuguguaauggcugaaauugagaaauuggggcagaaguauugaguggcucuaaggauagccaaggauccaagguuuguacuguguacacacaaaggaaccuaugcagaugacugcuuaguacagagaguagcucagcauaaauguuacauuguggccacaguugacccuuaagauuccuggaguuccugucauguacauuucuaaccauagauacaacauugaaugguugccagaugauuacagagccccuccauucuaaaucuuacaagacacaauuccucugccuuucugcaaccaauguucucuuguugcgaguucauuacacaugcaguaacaugaauuauuauucuguugaccuguuugcucugcugugagcugaggaugguuaaauaugcucacucuuuuuuuuuuuuuuuuuuuuuugagaugaaguuuugcucuuguugcccaggcuggagugcaauggcacaaucucagcucacugcagccucugccucccggguucaggcgguucuccugccuuagccucccaacuggcugggauugcaggcucgcgccacuaugcccagcugauuuuuuuuuuuuuuuuugguauuuuuaguagagacaaaaacuuuuguauuuuuacuacagaaaaauaugccucagccucccaaggugcugggauugcaggcaugagccacugugccuggccugcucacuuuuugaugcuguuuuggaauugauauuuugucucauaaaaauuuuagaccaggcaugguggcucaugccugugguacagcacuuugagaggccgaggugggcggaucaccugaggucaggaguuugagaccagccacgacaacauggcgaaaccccaucuguacuaagaauacaaaguuggccagguguggcguugcuugccuauagucccugcugcuguggaggcugaggcaggagagucacuugaacccagaaggcagagguuguggugggccgaaguugugccacugcauuccagccuaggugacagagugagacugucucaaaaaaaaaaaaaaaaaaauuuagugauggucaaaggguacaaaaucucagacaggaagaauauguuuuauacuuuauugaguucuguuguacaguguggugcauauacuuaauaaugggguauuauacauuucaaaauugauguucucaucacagaaauauauuugaaguauuggauauguuaacuagcuugauuuaauuauuccauauuguauccacaauuuaugacaucacuucguaacccauaaauuuauacaauuauaaauugucgcuuuguaguaaaaaauuuuuguuguaucuuuuuaggaauaaaaacccccugcacauccugcacauauaucccagaacuuugcaccuaguccuucuagguuuuuaguccuuucuuuaccucuguuuucaguaguacaugguguaaaauuucugggaccuuucgggguaggauucuguggagaaaacaggauugcuuccuggcuuuucuuacuucucauuaaagauuuagcuuucucaggucugcuaagucaguuaccauucagcccuggaguuuuguuacuguggucuccuuucuuguuuguuaucuuuagccuuguggauuugugcuuaaaaacauaaagagaaaaacaguuuacuguuucuguggguaccuagacuaagcuuauucuaaaugccuguguucacuucaccaucuuuaccugggaaugcccuggacacauauuuuuccuucuucccuucaugaugauuuuccugaaauaaugaugguuagucuggucucaaacuccuggccucaugucguccuuccaccucggccucucaaagugcugggauuacaggcaugagccacccuggccagccagauauuauagaaauagauaacauaaauaagcaaaagcagagcagagguaauuucaguuaauuugguauauaucagcauuuggcuauauauuuucuuaaagggcuaugucauaacuauuuucaguuuuguggguuguauauggugucuguuauaauaaaugagcaugccuauuuccuaauaaaacuguauuuucaaagauagguggccauucagcuguaguuuuccaaccugugguaccuaugcacgcauauuccaacacauugcuuuauuuugaacaaaaauggcaucguacuguacauguugguuuugcaacuuauuuauuuucacuaaguuacuguaaauauacuuccauuuuauacacauaggucuauuuuauccuuuuuaaugacaauauuauuucauuuuauuuuaauuuuugagacaggaucucaugcucuugcccaggcaggaguguaguggagugaucauagcucaguauaaccucaaauuccugggcucaggugauccccccaccuuagccacccaaguagcugagacuacaggugugcuccacccugccgggcuaauuuuuuguuguuguuguugagucagggucucacuguguugcccggcauauucucaaacuucuggaaucaagcgauccucccaccuuggcuucccaaagugcucggauuacagaugugagcuacuaugccuggccuauuaucucauuuuauaaaugucuuucguuuacuucccuaaugaucaauaauuuggugcugaacuuuuuuuguguguuuuauuuagugcugugguguauuuguguguaugaaauauauguguguguauauguauuucauauuugugugaauguuuaagaauagauuaccuaauuguggaauuuuggggucaaggaugugcacacguuaaauuuaauagacauuugucagauugcccuccagaaugguucuaccaauuuacauucuuacuauaccacuuucccgucagugggaaggugaccauuuauaugcagacuuugaccaauucuauuuaauuuuaaauggcauuuaguuguuugcuuuuggauuuauuugcuuucaggggagguuaaaagauuuuuuuaaauguuuguuggcuguuuguauuucuuguacauaugagaaugugaauuauuugagucacgacaauuuuucugcugggaaauuuguuuauuucuuauuugacugauuuuuuuuuuuuuuuuuuuuuuuugaggcagagucuugcucuguugcccaggcuggagugcaauggcgcucucucagcucacugcaagcucugccucccagguucaugccauucuccugccucagccucccgaguagcugggacuacaggcgcccgccaccacgcccagcuaauuuuuuuuguauuuuuaguagagacgggguuucacuguguuagccaggauggucucgaucuccugaccucgugauccacccgccuuggccucccaaagugcugggguuacaggcuugagccaccgcuccuggccuugacugauucuuuauaaagaugcuaaugcugucauguguuacagagguuuuucuuuugauuuucaguugccuaauaacugggugugcuguuuuaaaauuuuauguaguaaaauacauuuuuuaugauuuaguuuugugcugaaaauuuuuuucuccauaacuuauauucuaauguauuaugcuuuuuguuguuuuuuguuuguuuuacauuuauaguuguaauacaguugggacuucugguguaagcaguaagaugcagcuucuuuucuccagaugaguuagccaguuauucuaguuucauuauuugaauuucuuccuuggcuccauuaauuugaaauaggaguacaaauuauaauaagauuagaauucuacaauaacuuaaacauuuagccaucuauagaaaccauuuauccauagccuuucauuacuauacaaauaagcuagucaaucaaaaauauuuauugaauggaccucuuuugagcuguuuauccuauuuuuuccaguugguaaaauaaacauaagcuaauauauuuuuuaauggaaauuaaaaaaaauauuuauuuuagguuuggggguacaugugaagauuuguuauauagauaaacacgugucuugggggguucauuguacauauuauuauaucauccagguacugagcuugguacccaauaguuaucuuuucugcuccucucccuccucccacccuccccacucaaguagacccagugucuguuguuuacuucuuuguguucguaaguucuuaucauuuagcucccacuuagaagugagaacgugcaguauuugguuuucuguuucugcauuagcuaauauuuuuuaaaaaugcuagucuauaauaaauuguuacuguuuugaagacuguggacagauuaauucaacuuuauaaugaccuguacauuuugaacaguuaaugugugcuuucucuuuaaucuauaaucauuuccauccaccuuauaucuuuuccuccacauucuuaguccucugugauggaauuuuguuuucuuccuauguaauauuaucucuguuggauucugugauuugccuagaacaaugaauugggaauacuugcuccagcuucacacugacugcucuggaacacuuugcaguuggugcaugguuuccuacaccugguucugaaucuccagcaacaccaguccuuaaccacaucaggcuuuccgacugacccugcuuucuuuuaaggguuuuggcuuuccucuuuaucaguguagcugaacacuuuaaauaaaaaauagaugccagccaggugcaguggcucacaccuguaaucccaccacucugggggacugaggcaggaagaucacuugaggccaggaguugagaccaacuugggcaacauagugagacccuggcucuaaaaaaaaaaggccaguugcgguggcucaccuguaaucccagcacuuuaggaggcccagguggguggaucacuugagguaggcagcaggcacccguagucccagcuacucgggaggcugaagcacaagaauugcuugaaccgaggagguagagguuacagugagcugagaucgcaccacugcacuccagccugggugacgagagugagacucugucucagaaaaaaaaaaaaagaaagacuguauaaauauuuuaggagaauaauuuuugauagggucuugcucugucacccaggcuggaguacaguggcacgaucauggcucacugcagccucgaccuccugggcucaagugauccuccugcuucacccucccuagaagcugggacugcaggugugcaccaaaacacacagccaauuuuuuuuuuaagagauggggucuugcucuguugcccaggcugaucucaaacuccugggcucaagcaguccuguuucggacucccaaaguucugggauugcagguaugagcuaccacucccagccaggagaauaauuuaauguuaauauuuaaauguucuucagaaaauaauaguuuaaaaauuauugcucuugcacacaaauccagcaaaaauuuuccuuaguaaaaugaccaagauuaaaauuucuuuaauucauuuuaaaaauauauaaauuauuguauaaguaaugaauggaaaacaguguuauaagcauuuucagaagcaggcuauuggagauuaucuuuuauaguuugaagaaaaccaguuuuaaaaauuucucacaccggggacuucuaggaaaauggagaucuauccucaucuauguuaugcaucucuccccuguucuuuccauccaaauacaaccaaaagccuuggacauuuuauauaagacucuggaggagaaaaagucagacagucuagggaccucaggagaccaggagugacacagugguauguucccuguguguauuucagaguuggagcugaagaagucagcaaccuagauacugccaacaggcaaagacagaaaaagccccaacaaaagccuguucucucuagccaagaaaaggcagccuagcaagcuagaaaacuuguagucaauaacagcucuccucuagccaaacaucacagaaaaaaacuguugcugcacuaccagcuaccugaucaaaggccaagugguaagccuagacuuuuauccuuucaaggcuacagugaggcauacaacauuccugccauggagguguuagagaaggcaguaggagccggaaaugucaccccugccagccagccaggagugagaacugcccccacuguacucaugggaccaguggagaccacauggagaaucaggacuuuaccuccacauggcaguaacgaacuguucaucucccuucccucuggugugaugucaggggaagccuguggagagucaggacauucaucauccccagugaguaugaggccauccccaccacacugucaguggagaguacauggggaccuggaacucccuucuccacccagcagagugaggagcccaccacccuugaguauuguggaagcugaauggggcacuuggacuucugccucugccuggcaguaacaagguggcaccccuccccugccagagugguguuagagaaaaccaccuaaaacaggagguuuaaauaagauccagagucucauaauaugaaaauguccaaauuucaaacacaaaucacuuauaccaagaaccaggaaggucucagacugaaugaaaaaugacagugacugcuaugguuugaauguaugugucccuccaaaauucauauguugaaaccuaauuugguaguauuagaagguggcgucuuugggaggugaucaugucacgaggacucuacccuuaugaaugggauuaaugcccuuuauaaacagaggcuucagagagcuaccuugucucuuccaccccucugccaugucaggacaccuagaagacaccaucugugaggaacaggcucucagcagauaccaaaucugccggccccuugauaguguauacuuuccagccuccagaacugugagaaaucaauuucuauuaauuaccuagucugugguguuuugugauggcagccugaauaggcuaagacaaugauauauuagaauuaucugaaaaagauuuuaaagcugcuaugauaaaauuucuccaaagagcauuuaaugaauaugaagcaaaugaaaaagacaccuucaaaaaaaaaaauagaaagucucaggagaaaaauagaucauaugaacaaaaaccaaauggaaauguuagaagugaaaaauacaauuaaauuaacaaguucagcaaauggacucaacaacagaauggaggggacaggaaagaaucgguaaacuggaagauagaacaauguaauuacacaauccaaauaacagggagaaaaacagacaaaaauaaauaaaaagaauagagcuuccagaaccucugggaccauaacuaaaaaucuaacauuugugucaucagaauuucaggagaagagaaugagagcagagcuggaaaagcaauugaagaaaugcuguaaaauuuccauauuuggcaaaagacagaguccucagauuuaagaagcugagcaaaccccaaucgggauaaacccaugcuaagaauuucaugccaagacaacauaauaauuaaaauuuggaaaaaagaaaaaaggaaagagaccagccuuaccuaugaaagacaaguuuuaaaauuuguacauaaaaaguuuacauauugacauaugcagaaugcucuguuuauccaauuuacauauauauauaugacauuccaacaauaguggaaugcacauuuuucaagaguccauggaggcagggugugguggcucucgccuguaaucccagcacuuugggaggccaaggcaggcagaucauuugaggucaggaguucaagaccagccuggccaaaaaggugaaaccccaucucuacuaaaaauacaaaaauuagcugcuugugguugugcacgccuguaauuccagcuacucaggaggcugagguaugagaauugcuugaaccgggagacagagguugcagugagccgagauugugccacugcauuccagccugggugacaaagugagacuguuucagucaaucaaucaaucaaucauccaugaaggcugggugugguggcucacaccuguaaccccagcacuuugggaggccaaggugggcagauugcuugagaacaggagcucuuaacuagggagucugaggugggaggaucccuugagcccaggagguugaggcugcaaugagccaugagcaugcugcugcacucuagccuaggugacagagcaagacccuaucucaaaaaaaaaaaaaaaaaaaaaaaaaaaaaguccauagaauauuuaccaaaguagaccuuguucugggccauaaaacaagccucacaaacuuaaaagaauugaaaucauucugaguauauucucugaccacaguguagaaaucaauaauggaaagaugauaggaaaaucucuaauaguuggaaacuggacaacauacuucuaaauaaugagucaaagaggaaaucucaagggaaaugaauacaaaugaaaaugcaacauaaaaaauugugggacacagcuaaagcagugcugagagggaaauuuagauuuaugcacuaagugcauaaaucagaaaagaggaaaagucucaaauccguaaucuaagcuauuagagaaccuagaaaaagaaaagcaaacuaaauccaaagcaagcagaaaaagggaaauggugaagauaaaagcagaaaucaaugaaauugaaaacaaaaacaguagagaauaucaaugaaacaaagaacuuguccuuuaauagggucaaaaaaaagggacaaacuuaugauaagacugaaaaagaaaaaagacauaaauuaccaacaucaggaaugaaaaaaugaauaucagggcagacccugcagauaucaaaaggauaaugaacagugaacagcucuaagacacauaaauuugauaacuuggaugaaauggaucaauuucucaaaaaacaaauugccgcaauccacccaauaugaaauagauaauuugaauagcccuauuacuguuaaggaaauuuggccaagugcgguggcucacgucuguaaucccagcacuuugggaggccgagguggaucaugaggucaggaguucaagaccagccuuaccaacaugcugaaacccugucucuacuaaaaacaaaaaaauuagccgggcgugguggugugcaccuguaaucccagcuacucaggaggcugaggcaggagaauugcuugaacccuagaggcagagguugcagugagcagagauggagccacugcaccucagccugggugacagagggagacccugucucaaaaaaaaaaagaaauuuaauuuauaauuuaaaaguccccccccacccugaaaaaaaaucuguaggcccagaugguuuugcuggagaauuuucucugcaguuuaaagaagaauuagcauacuuuaaugcaaucuuuuccagaaaauagaaggggaaggagcaauuccuaguucauuuuauaaagcuaguuuuauccuuacacccagcuaggcaaauacaguauaaaaaauaaaaacugcagaucaaaauucccccaaauauagaugugaacauucuuaagaaaauauuagcaaacaauucagcagcauauaagaaaauuaaacaccaaguggguuuuuuuuuuuuuuuuuugagauggaguuucacucuguugcccaggcuggacugcaguggugugaucucagcucacugaaaccucugccucccagguucaagugauucucccaccucagccuuccaaguagcuuggauuacaaggugccugccaccaugccuggcuaauuuuuguauuuuuaguaaagacaggguuucaccauguuggccaggcuggucuuggaacuccugaccucaagugauccgcccgccuuggccuuccaaagugcugggauuacaggcaugagccaccacgccuggccacaaaguggcauuuauuccaaagaugcaaagcuguucaguauuugaagaucaaucauuguaauaccauauaccaaauaaacagauuaaugggaggcaaguggguuuuacuguaaaagggcaacauagggauccuaguggugauagaaauauucugcgucuuaacucuuaucaaugucagcauucuuguugugauauuguauacaguuuugcaagauguuaccauuguagggaaacugggcaaagggaauuggaauuuuuguauuuauuauuucuuacaacucuuuguaaaucuacgguuaucucaaaacaaaaaguuaauuuaacaauuaaggaaaaaacccaaagccaaaccuguaaaaugcgugguccuuguauuccagauacguuaaaggaaagucaaucucagaauuccuauuagauaugauuuugauguagauauuuaagacguagucuauuuauggugauuuguaucauuuaggcaaagccauuauauagcauuucuuaggaaaaauuaggcuuauuuuaggaacugagguauuuguauuuaaugucugaugagaacuuaccuuaguucacucaugugaucuaaacugccuugcaguccuuuuuuuuugagacggaguuucgcucuuguugcccaggcuggagugcaauggcgcgaucucggcucaccauaaccuccacuuccugaguucaagcgauuuuccugacucagccuccugaguagcugggauuacaggcaugggucaccacacucagcuaauuuuguauuuuuaguagggaagggguuucuccauguugaucgggcuggucuggaacucccaaccucaggugauccgccugccucggccucccaaagugcugggauuacaggcgugagccacugugcccggcccugccuugcaaucuuaagaagagaaguaauaaaguaauucuugagugacauaauuuauuaagcacugagugggagaagguagcuauauuaaaaauacaaaagauuaaacaaugaauguacacuuaaucauagaauugaugaggucuuugaaagcacuuuuaccuaugguguucucuuugcuaugauauuuaguuuguauuucuuuggaagcauucuuccuuuacugcuaguagcuucauaguaaaacuuuacacuggguaacucacuuugauaaccaagaagcgacuucuggcuggguguggugacucaugccuguaauccuagcacuuugggaggccaaggagggaggaucacuuaagaucgggaguucgauaccagccuggcaacauggcgaaaccuugucucuacagaaaaguagcugagugugguggugggcaccuguaaucccagcacuugguaggcugaggugggaggaccuccugagccccgaggucgaggcugcaaugagccgagauuguaccacagcacuccagccugggcagggacagagugagacccuguauccaaaaaaaagaaagaaaaaagaaaagaagugauuucuaaauuuucuugcuugcaccauuaagcugauauuuaguggugguaaaguauugauuugaauuugaaaaauauuaauaaggaaaaguguuugacuuguucaauguauaugaaacacuucugugucauuuuacauuuuacaacaguuuuauuccuucuguguguacauacagguuuaucuauuuagaccugccucucuacaaaauagauuugaggcagcugacauuaagaguacaaaccaggaaacaauauuuagguauaaaaagauaaaguacggccaggccugauggcucacgccuguaaucccagcccuuugggaggcugagguggauggauugccugagcccaggaguucaagaguaguccaggcaacauggugaaacccugucucuacaaaaauuagcccagcaugguggugugugccuguagucccagcuauuuggcaggggguggggagggggcacugaggugggaggaaaucacuugaauccaggaggucgaggcugcagugagccaugauugugcuauugcacuccagccugggcgauagagcaaguagagcaagaccaugucucaaaaaacaaacaaacaaacaaaacauaaaagacaugugacauaaguagggggucugcaagagcaugugugcuuauguuugugccaguacuguggcugguugcccucagauuuauuccuuacccuuucucuguucuauuucucaaggaagagugagcgauuccaguagguggcauuuuccaaguucccaaaucagcuggcuucugccuggguucagccagugggagguaugggaggaauuuggaaaguaggaggaagggaagguauuuuuuccccuccgucucuucuucagguggggucucuggcgguacccaugauuguuuuguaguguuaccuucugccagacagccugccuugguucuguuuuuccacgaggugaccuuggacuuggccucugguaaaucacuacauucucccucucuuccacaguuaaagggaugauaguagcuuccugcugugccuuauaaucacugauuauguuuagcauaguuagaaucuuuuuauacccaauaucuuuagcauacuuaauagcaucauauacccuucuuuugauuuuugugugcuaugaaauaaucaggcuaggucuauguuuuuaugugauucuuuucccuucuuaaacuauuugaucuucucccagaauaaggaaguuaaaguagaaacagagcaaccuuaaagugguuuauuuucuaaauuggauccuucauuucuaucucagugaugaugccaccuaccaaacaugugaauuagaccuucagcaaauguucauuucaaacauuugucgagugucuacugugugaugaagcaccaagcugggugagcugagaguaaaaggauagauaggauaggaucucuguuuccaaguugcuuuuagggguucaaggucuaagauagggaagggguucuuacugcuagcaccuucagugacagagcuuuaugggggaaaguauuauggaugcacauauaauauuaauacaagcauagaauucccuuaaagaugucaucucaugacauguaaacauaaaauuguauugugaauauagagaaaggaggauguuugguguauuugaaagaacuccaagaaauaagaguuuuguucugauauucaaugaagugauuuuaugucauggagaaagauagauauaaucucuuagucucuuuuuuuguaauauuaaaacaguugauuuuagaaaauuuaaaagcucuguauuuaauaauaauuuagaacauuguaaaguuaucauauaguuguuucucauuuauccugacuuuuucuuuaauugccaauuucuaacccugacugaaauaagugauuagacugcaccuuuauaauucucacaccucaguuuaaugucaaaccuucuaggcuuuuagcuucauuuuguuaaugaguuaagacuguccccugcucucccucucccucucccucucccucuccccacggucuccuuccacggucucccucugaugccgagccaaagcuggacgguacugcugccaucucggcucacugcaaccucccugccugauucuccugccucagccugccgagugccgccacgccugacugguuuucguuuuuuuuuugguggagacgggguuuugcuguguuggccgggcuggucuccagcuccuaaccgcgagugauccgccagccucggccucccuaggugccgggauugcagacggagucucguucacucagugcucaauggugcccaggcuggagugcaguggcgugaucucggcucgcuacaaccaccucccagccgccugccuuggccccccaaagugccgagauugcagccucugcccagccgccaccccgucugggaagugaggagcgucucugccuggccccccaucgucugggauaugaggagccucucugccuggcugcccagucuggaaagugaggagcgucucugcccggccgccaucccaucuaggaagcgaggagcgccucuucgccgccgccaucccaucuaggaagugaggagcgucucugcccggccgcccaucgucugagauguggggagcaccucugccccgccgcccugucugggaugugaggagcgccucugcugggccgcaacccugucugggaggugaggagcgucucugcccggccgccccgucugagaagugaggaaacucucugccuggcaaccgccccgucugagaagugaggagccccuccguccggcagccaucccgucugggaagugaggagccccuccgccuggcagccaccccgucuggaaagugaggagcgucuccgcccggcagccaccccguccgggagggagguggggggggggucagccccccgcccggccagccgccccguccgggaggugaggggcuccucugcccggccgccccuacuggaaagugaggagccccucugcccggccagucgccccguccaggagggaggugggggggucagccccccgcccggccagcugcccaguccgggaggugaggggcgccucugcccggccgccccuacugggaagugaggagccccucugcccggccagccgccccguccgggaagggggagggggggucagccccccgcccggccagccgccccguccgggagggagguggugggggucagccccccgcccggccagccgccccguccgggaggugaggggcgccucugcccggccgccccuacugggaagugaggagccccucugcccggccagccgccccguccgggagggaggugggggggucagccccccgcccggccggccgccccguucgggagggagguggggggggucagccccccgccccggccagccgccccguccgggagggagguggggggaucagccccccgccuggccagccgccccuuccgggaggugaggggcgccucugcccggccgccccuacugggaagugaggagcuccucugcccggccagccgccccguccgggagggaggugggggggucagccccccgcccggccagccgccccauccgggagggaggugggggggucagccccccgcccggccagccgccccguccgggagggagguggggggaucagccccccgccuggccagccgccccuuccgggaggugaggggcgccucugcccggccgccccuacugggaagugaggagcuccucugcccggccagccgccccguccgggagggaggugggggggucagccccccgcccgaccagccgccccguccaggagggagguggggggggucagccccccgcccggccagccgccccguccgggaggugaggggcgccucugcccggccagccgcccaguccgggagggaggcggggaggggggggucggccagccgcccuguccgggagggaggugggggggucagccccccgcccggccggccgccccguccgggaggugaggggcgccucugcccggccgccccuacugggaagugaggaccccucugcccggccagccgccccguccgggagggaggugggggggucagccccccgcccggccagccgcccuauccaggaggugaggagcgccucugcccggccgccccuacugggaagugaggagccccucugccuggccagccgccccguccgggaggguggugggggggucagccccccgcccggccagccgccccauccgggaggagaggggcgcuucugcccggccgccccuacugggaagugaggagccccucugcccggccacgaccccgucugggaggugugccuagcgacucauuggggaugggccaugaugacaauggcgguuuuguggaauagaaaggcgggaaggguggggaaaaaauugagaaaucggaugguugccgggucuguguggauagaagugggcaugggagacuuuucauuuuguucuguacuaagaaaaauucuucugccuugggauccuguugaucugugaccuuaucuccaacccugugcucucugaaacaugugcuguguccacucaggguuaaauggauuaagggcggugcaagaugugcuuuguuaaacagaugcuugaaggcagcaugcucguuaagagucaucaccacucccuaaucuuaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaaaaaaauuaaaaaaaaaaaaaaaaaaaccaaaaagaucuauagcaguagucugccagaaaaaaaaucucaacaaguuaaaaaauguuugauuucauauaggugauauguuguuugauuaugauguaauacaauaauaaauuaacaaaaaaaaaaaaaaaaaaaaaagacuguccccugcccauuuuagguugcuacuucuuuuaauauuauaaaggaggugauugccauggaaaaggagauccaguauuuaugauuuagucuuacugcugaaggguuuuaaaaaauaugauuaucuccuguuuaccaaauacuauugcaacucuugauugaaagguauuaauaaauaaauguccccucucccaauguuuuauuuugaaaauuuucaacucuacagaaaaaauuuaaaaauugugugguaaacaucauauaucuuucaucuaaacucacaauuggcuaacauuuuuuuuaugucuuuuuuuuuuuuuuuuugagauggagucucgcucugucacccaggcuggagugcaguggcacgaucucagcucacugcaacuucuaccucccaaguucaagcaguucuucugcuucagccucccgaguagcugggacuacagacaugugccaucacgccugggcuaauuuuuuuguauuuuuaguggagacgggguuucaccauguuggccaugguggccaggcuggucuugaaugccugaccucaagugauccauccugccucggccgcccaaagugcugggauuacaggcgugagccaucgcacccaguccucuuuauauauacaaauaucuauguuuauuucuuuuugguaccaucugaaagaaguauauaucaugauauuucauuccuggguacuucuugcugaaagauuuuuguaaauguuuuucuuguauauucccuuuaaacuagaauguugagguguucaugaugaaugaugccagagaugcacucuuggaaaaucucauuuuaccauaagacuugcuccaaauaguuuccuccucacuuuauauuacauuucucuuuuuuugauaaguauuuuuugaucacccucuaucacgaccacuacgguaguacuacuccuuucugauaccuuuuuuccccacuucuaaacaauuguaaaauaucgauaacaacauuugccauuaaaauaauuuuuaaggcuggcugcgguggcucacgccuguaaucccagcacuuugggaggccgagguggguagaucaccugaagucaggaguucgagaccagagaccagccuggccaacauggugaaacccugucucuacuaaaaauacaaaaauuagcugggugugguggugcaugcuuguaaucccagcuacucgggaggcugaggcaggagaaucgcuugaaccugggagguggagguugcagugauccgaaauugcuccagugcacuccagccugggugacagagugagacuccgucucaaaaaaaauaauaauaauaaaauaaaaucugggggcugggcaugguggcuuaugucuguaaucccagcacuuugggaggccgaggcaggcagaucaccugagaucgggaguucgagaccagccugaccaacauggagaaaccccacaucuacuaaaaauacaaaauuagccaggcaugguguugcaugccuguaaucccagcuacucgggagacugacgcaggcgaaucacuuguaccugggagguggagguugcgaugagccgagaucgcgccauugcacuccagccugggcagcaagagugaaacucugucucaaaaaaaaaaauuuuuuuuuuaaauaugcaauucaucaauauucauuauauucacaguguugugcagccaucacuacuguaucuuuccaaaacuuguaccacuccaaacaagaaaucuauaaaauuugagcaguaaaucuuuauuccuuccuucccugauccuuaauaaccuguagucuacuuucugucuguauacauaugccuauucuacauauucuauauaaguggaauuguacaauauuugauuugauugaugucuggcuuauuucacuuagcauaacguuuucaagguucaucuguguuguagcauguaucagaaugucauuccuuuuucuggcugaauaauauuccauuguauuuacauauauaccacauuuuguuuaucuguuuaucuguugauggacacuugaguuguuucuaccuuuugacuguugugaauaaaccugaaaugaacauugguguauaaguaucccucugagcucugaauccuuuugguuuuuuuuuuuuuuuuuuuuuuugguauauaccuaggaguggaauuccuaggucacauggcaauuuuauguuuaaguuuuugaggaacuggcaaacucuuuuccacagcagcugcaccauuuuauauucccaccacuaauguaugaggguuucaguuucucugcauccuugccaacacuuauuuuccauuucuuugaugauagcuauccuaguaagugugaaaugguaucucauugaguuuugguuuguauuuccauaguggccagugauauugaacaucuuuucauguacuuacuggccauuugcacaucuucuuuagagaguaucuauucaaguccuuugcccauuuuaaaaauugauuuaucuuuuuguucgugaauuguaagagaucuuuauauauucuagguaguagaucuuuaucaaauuuaugguuugcaaauguuuucucccauucuauagguugucuuuucauuuucuugauuaauguccuuuuaugcacaaaaguuuuaaauaucgaugaaguccaguuuaucuauuuucucuuuuguugcuugugcuuuucugauagaaccaucagcacauuuaucaguuguuagaugauuucucuccuggugaucccggauuagggcuugggcucauuuuuugguccaggaucaacaaaaauaacaguauucguugucacuaacugaguaccuaauauaugcuaggugauucugggaaaccugagaaagagaauucuaaggcagaaaagccucauaauuuuauucuugucaaguaaaguuuacugaaacuccauaacauuacaaagagguuagaagauagucuuccccaccauuuuucugcaggaaauuuaagucagaacuacugcuaguguccuacugcacugaacagguuccuggcauuugcacuggacccuaggcucccccacaacuccaccccuguggagguucucgauuucuguauuucauggacucucuuucuuagcuagcuuuuuaguuuaccagcuuagucuguguuuuuuugguuuuuuguuuuuugagagggagucuugcucugucgcccaggcuggagugcaguggcgcuaucucugcucacugcaagcucugccuccccgguucaagggauucuccugccucagccucccaaguagcugggaccacgggcgcaugccaccaggcccggcuaauuuuuuuauauuuuuaguagagacgggguuucaccguguuagacaggauggucucaaucuccugaccucgugaucccgcccgccucagccucccaaaaugcugggauuacaggucugugguaguuuuuacaaaaugcuuaagaaacucaagguaaaugaguuacucacagcgggacuaacauuuugaaccagacuuuaaaauccauuauaucgcacuagaaaagcgagaguuucccccacauuuacaacucugaaauuccuuuuggaaacucuguaaaugauguuguugauuuaaaaauuagggccaggagcaguggcugacaccuguaauccuagcacuuugggaggccgaggagugcggaucaccugaggucaggaguucaagagcagcccggccaacgugguaaaauccugucuccacuaaaaauacaaaaauuagcugggcgugguggugggcgccuguaaucccagcuaaucaggaggcugaggcacgagaaucgcuggaacccaggagguggaggcugcagcgagccgagaucaugccacugcacuccagccugggagacagagggaaacuccaucucaaaaaaaaaaaaaaauuaggcuuuuccuauuuguaguaugagugcauucucucuaguacauuuucccucagaugacccaguaguuguucaccuuuuuccuucaaacuguaaaaacacaaaaaugaagagcucuauuaauguuaauuuuauucugauuuauuccccuagcggaucugaaaagaacaauugcuguccuucuggaugacauuuugcaacgauuggugaagcuggagaacaaaguugacuauauuguugugaauggcucagcagccaacaccaccaaugguacuagugggaauuuggugccaguaaccacaaauaaaagaacgaaugucucgggcaguaucagauagcaguugaaaaucaccuugugcugcuccauccacuguggauuauauccuauggcagaaaagcuuuauaauugcuggcuuaggacagagcaauacuuuacaauaaaagcucuacacauuuucaaggaguaugcuggauucauggaacucuaauucuguacauaaaaauuuuaaaguuauuuguuugcuuucaggcaagucuguucaaugcuguacuauguccuuaaagagaauuugguaauuugguugaugugguaagcagauaggugaguuuuguauaaaucuuuuguguuugagaucaagcugaaaugaaaacacugaaaaacauggauucauuucuauaacacauuuauuuaaguauauaacacguuuuuuggacaagugaagaauguuuaaucauucugucauuuguucucaauagauguaacuguuagacuacggcuauuugaaaaaaugugcuuauuguacuauauuuuguuauuccaauuaugagcagagaaaggaaauauaauguugaaaauaauguuuugaaaucaugacccaaagaauguauugauuugcacuauccuucagaauaacugaagguuaauuauuguauauuuuuaaaaauuacacuuauaagaguauaaucuugaaauggguagcagccacuguccauuaccuaucguaaacauuggggcaauuuaauaacagcauuaaaauaguuguaaacucuaaucuuauacuuauugaagaauaaaagauauuuuuaugaugagaguaacaauaaaguauucaugauuuuucacauacaugaauguucauuuaaaaguuuaauccuuugagugucuaugcuaucaggaaagcacauuauuuccauauuuggguuaauuuugcuuuuauuauauuggucuaggaggaagggacuuuggagaauggaacucuugaggacuuuagccagguguauauaauaaagguacuuuugugcugcauuaaauugcuuggaaaauguuaacauuauauuauauaagaguauccuuuaugaaauuuugaauuuguauaacagaugcauuagauauucauuuuauauaauggccacuuaaaauaagaacauuuaaaauauaaacuaugaagauugacuaucuuuucaggaaaaaagcuguauauagcacagggaacccuaaucuuggguaauucuaguauaaaacaaauuauacuuuuauuuaaauuucccuuguagcaaaucuaauugccacauggugcccuauauuucauaguauuuauucucuauaguaacugcuuaagugcagcuagcuucuagauuuagacuauauagaauuuagauauuguauuguucgucauuauaauaugcuaccacauguagcaauaauuacaauauuuuauuaaaauaaauaugugaaauauuguuucaugaaagacagauuuccaaaucucucuucucuucucuguacugucuaccuuuaugugaagaaauuaauuauaugccauugccagguagaaguuuggaauaauuguuuagucucuccuauuagauguggacauuuuuguuuuuguuuuuguuuucagggaugaaauaaaauauauuauuucuaccua
